United States Patent 7,482,117 (GENETIC POLYMORPHISMS ASSOCIATED WITH MYOCARDIAL INFARCTION, METHODS OF DETECTION AND USES THEREOF) - sequence listing, part 3

SEQ ID NO: 17554 - DNA, 105314 bp, Homo sapiens
cagtttgctgatatcacaggagatctgctatttgatcattttgcctgccaacttggatgtctgtctcagcaggaaaccatttaaagaaaataaatgaattctcagcacttgacattttctggaggacctgagtcctttccaagtgagctcatatcaagcacagttggtaagacagagacgggaaaatgtgctttctccctgttaagaggacagcctcgctgaagcatcttgggcagggcagtattaagtgacttttccttgttgatgaggggtcctctcacctttgggagagaggtggccctccaccctggaggggctgcaggaagtggaagcaggttccatagctggggggtgttacaagtgagctgaaggagaagtagcatggaattcctcctcattttctctcccgagtccaccctgcctcctccttcccaacagcttgtttattacagcatggtgacttggggcaacgtgattatatgagatggtttttttctcccttctctgtcctccctcctgggcacagtgtatatagtatgagagctactgtaatgaaaggtgcacaggcctttttaggaaagtgattgcaggtgaggccaactcagccaggaaaatctcctgttgcttcctaggatgggtcaggggaaaaggagagggactttaaaacatggatacttcagacctggctgcacactggactcaccaaggggattaaagaaaaacaatgcttgggcctcacctccagagattcagatttaattgatctagggagtggctggggtatcaggatttttaaatctccccaggtgatgctaacatgcagccagatgtaaagatggtaggtttagagggagagaatgcaatggttttcactgttgtactgcagggtgatgatatggggcagggcaggagcctattccagcccctacacctgtggacacttgcgttagaggtgtccacacttctaccttgaagctgcagcactggaatacttcctccacactgctggtgctctggagcctttgactagccagggggccgctgagtaacaaaccttcccactgtctccttccaccatggaccaggggcagccatcacacttcctcatgttttttagtgacattacttatcatttaccttaaagtaaatgataaataaaggtggacctaggggtctctcttgtttttcctttctttctttctttctttctttctttctttctttctttctttctttctttctttctttctttctttctttcttctttctttcttatttttctttcttttctttcttttccttctttccttctttcttttgatggagtctcactctgtcgcccaggctggagtgcagtggcacaatcttggctcactgtaagctccacctcccgggttcatgccattctcctgcctcagcctcccgagtagctgggactacaggcgcccgccaccatgccaggctaattttttgtatttttagtagagatggggtttcaccgtgttagccaggatggtctcgatctcctgacctcgtgattcacccgcctcagcctcccagagtgctgggattacaaattcctttcttttttaagagacagggtcttgctatcactctcttccaggctggagtgcagtggcgagatcatagctcactgcatgctcaaacccctggcctcaagcaatcctcccgcctaggcctcccaaatagctgggactgcaggtgcacaccaccatgcccagcttcctcttattttcataaaagaataatttgtgtgtgcacatctttctttggaatcttggattgatcaaaggaggtatagttattacatgtgtcctacatgctgaagttgaaagacaaaactagagaagaaaaatgcctagtttctgtgggagtgattataacaaaatagctaatatttttgagatactatttatgaagtaatcaattaagccattacaataattctgtgagctaagtaccaatagtatccccatttggctcaccgtaataatacgtaattggctcaatgaaataataatgcgtccagggatctgagatacacacttgagaaaattagtggtgagtcaacataattgccaaattatatgatattattataaagcaaagctttgggtgtaatattaaggcctatgtctctttctgtaaatggttaaactgaggcaccgagcagcctgcttaatcgaaatcagagcacaaaagaggggaggaggtacaatcctctaaaacacatactgtcatcaacctcttcatcttgaaatattcaattaaatgttatccaaacccaaagttactaatgaatttggaaatgagctggctgtgactgtgagtatggaaattggtggagaggagaaactccagagactggggaggagccacaggctgcctggcttcagagttgttaggtagaagagaaagcagacctggaaagaaagatacagggagggaaagaaggaaaagggagataaaaattacagaaccattgaaggaaactgctccacagtttcccctctgcctttgggcaggagaatgtctcaagagcgttcccaagcttcatgtgcacaggaatcagtggggtcctgtgaaagacgacttccattcagcaggtctggggcagggcctggcactctgcatttccaacgctctctcctaagtgatgcctatgctgctgctggcccatggacctccctgtgagcagatgggtccactgggatcctctggggagagggtgattgaaaccccctggaatccttctcccatacctctgacactcagacccatggtctcccacccccgtcattgctacagtggccccggtaactggccagttttgtacttattggagtctgggggagtgtcatgggaaccacgggacaacatgagcaagggagagtgagcaaactggcagctggaaggcaggcaggctaagttacccaaatgacagaaggaagagaaggacaagaaggcagagtctgctcactcactcaagtcaaggtgattaatctctctatgcctcagtttccaccctgcaaaatggggatactattggtacttagctcacagaattattgtaatggcttaattgattacttgataaatagtatctcaaaaatattagctattttgttataatcactcccacagctagatgtcagcccttgcatgaaatcaagcattcggcaaacatctatgcagcgtggactctgctgggccccagctgggtccctgagcagagggtctggattggccatacctcatttatattgagatgaatgaactccttgttctttgtactgagagcctggaacacccctgataggaragaagggggaaaggcatccttttaaagacaattcctttaccaagtttgtttcccagcgaccaaagggccttccagtggagcctgtggggaagctgctccatctggtggtaaacaaggactttcatcaagggcggcgatgggactctcatcaagggcgggctgaaggtgaacttctctgaacggatggaggcatccagtcctgtagcaagccagtggtcacctaagccagtcagccggccagcagctcctggagccaaagcaacgcccctatcttaaccttctggggggtacagggcccttgaaatccataggccccagaaaaaaagcacacgcacgtaaagttttgcatgaatctgaaagttgttagtctcgcccttgtaggaaggtgccgtgggtgctgtcagaggacagagtggcacaggagagcgtgccagcactgagctgggggctgggtctaccgcatggtgtagtgacctgagtgcacctgagcaagtcactgccctcttggggcctcagcctcctcaccttcagaagacgaggtcgagccaatcagccctggcttcacttgagaatctctcgggtagctttaataatacaacccaaagcggggtgggggaccatcactggacacaagaaatggaagagacccaacaaccaaacatggtgactgggtcttgtgtggatcctgagtcaaccaagcaactgtaaaaaggtggcctggaagacttgggcatgaaccgggcactagagaatgttgagggtttgctgagaatttcgttaggtgtgcaaatggtatgaagatgatgctaaaaacaagtctatcagctggagatactcagatgaatggacagagtttctgagatctgctattaaattatttagggggaaaatgtatgtgttgcgggagcacaagggaaaagttagcaagatggtaattgttgaggttgggtgtaaaggtctggaaacacctggcgaatttgcgtaactcccaatgctgtgtgccacccctgagattctaacagaattggtcaactgtgcagcctggtcatcagcatttctttaggcacccctggagattgtaatgtacagcgaagtttgagaagtgctgatgtggagtgcatgggaacctattatgattctttatatctaactggagggttgacattcttacaataaaaagttaaaataatactgcagcaaagctccatccttggtaattctaaaagttctccaggcaaatctaatgtgaggatgccagagtggatggtgttaagcctaaagggtcttcaccctaatattcctctactataagaaaagctgaggcactcccaccccccgttctgggaaggattacacctgggtggtttagaaagggaaagagcaatggagagaagagaaactagcaaatctcattatttctagggtcagctctgaccaccctgtaagtctaataacagattctgtttcaggaggggtctttctagaatgcacctctcactagctaccagtaaccccttagggaaagccggcttcctggcttgatatactagaccctttggggcctgctggtctgtctctgattttctctcatcattccttaatcaacacatactcattgattgtccagaaattacggctctcctggagcttagagtctagaggggctgtgcttcaggcaagtaattagtgttctattaccaaagaagcagagggagctatcatgctgataaccaagggtcacagccctcacctttttattttaatttaatttaattttattatttatttatttatttatttatttatttatttatttatttatatttttgagatggagtctcccactgttgcccaggctggagtgcagtggcaaatctcagctcactgcaacctccacctcccaggttcaaggggttctcctgcctcagcctcccgagtagctgggattacaggtgcataccaccacatttgactaattttttgtatttttagtagagacaaagtttcgctatgagctggtctcgagctcctgacctcacgatccaactgcctcaacctcccaaagtgctgggattacaggcgtgagccactgtgcccagccccctgccttttttttttttttaatcaagtattcatacctcgaagtggcctatggaacacagattagaaaataccaagcaggacaaaatggaaatgcggggccccctgctcctaagttgtgaagactttcaagatggaaacgccagaacattaaaccaagcacgaggcacccttgagggcacgggtcctttggcacctgcacacagggcatgtcctcatagccactccagtactgagttacaggccctggacatgcttcactcagcctcaccttcaaaaccacctttgaggggcaggatggctatgacaataaactgcaaacactgaagcgcacgggcacataatccctctctatttgtggtgtaacaaatcttatttgagataactgggtcaatgtctagggcttacagggcggggaaggggggaggaagggggactgagactctcctgtttctatatgctatgatgggatttgacctgcaattgaacctttcctcaaacacaaggcacaaacctgccccagcccatcatcctcccacagaggcactgtgaatgtataaagaaaggcgatgctaagaaacrtgctgcaggggaggctggcacattctgctccttagctaaccgcacaggcccatgggtccacacacatcagaccatggctctctgtggtctatctttgccattactttaaccaggctgtttctcatgcgctcatggagggtgactgaagatgccaccccgaggtgcaccctcagcctcgctggacacttacggctcgcattctccagccggaccaggcagttgaggaagtcatcgaagtccagctggagctcctcatccgcatacctgagcacaatcagctgcaggaggtggctgctcagctgaaagcctgtggggacaaaggaggagacccaggactcgctgtatccgagccccgaggtgagtctgcacctttgagggagctcccaggcagctgaggagagggctcagaagaggaagccactgtttcactcctcaaagckggggtccccagacccagtgggactgctgcccttggtgtgaatgcagcgtgagagtgtgaatctgtggtgcaggggcgagtgtgcgggggactctcaggcgtgctttctgtgtttaatggcttctgagtttagcgagtttgtgatcttaattttgatgctaacatcacccatagagtctcgctgactttacaggaagctttgtttgggggaacttaacactgggtggtgtctgagccccaagttcattcctacaccagcctcccctcgygttctatgtctcaggtcacttccagctgtggccctagaaagtttcttggaggggatgctgctgcccacggagaatgatactctgccagggcccattcctacacatccacgatgggggaagaatgacaggctatagccaggaggcttggatctgagccctggcactgctccagccgtggcatatgggttcagttctctgggctttggtttcctcattgtcaaatgaggagtttagacaaagtgaacttccttctggatttgatatttagatttttttttttgagatggagtttcactcttgttgcccaggctggagtgcagtggtgcaatctcggctcagtgcaacttctgccttctgatttcaagtgattcttctgctgcagcctcctgagtagctgggactacaggcacctgccaccacaactggttaattttgtatttttagtagaggcggggtttcatcatgttggccaggctgatctcaaactcctgacctcatgatccacccacctaggcctcccaaagtgctagcattacaggtgtgagccaccacacctggccagtgctttgatttctaattagtgcccttagaagtgatttctttccccctttcatttttgtctacatgttcactttctaggaggtgttcacaggattgttcagaaatccacccagggtctttctgcttcttcctaattccagcagaggagcaggcaggtcagacacagagcacagagtcyctggagcctgcacggcagtgctggctgccagccttggccagaatcctgatgtttggggctagaggagggggatgaggggcgattctccccacaccacgtcagggtaggaaagacacagccatgcccctcctctctgagtgctccctttgtcccctgctcagttcctcctcctaccatggaaacagagtcatcatcccctaagaaaatcaggcgccccttctcagcctggcactttgctcatttataaatcatctgattttcttctccctcacataggacccgagatggtcctggctgtgtatacttcatccttttatcaggcctgagcctggacatgtttccagattttgctttccctgggagrgaaccactttaaaaggttcaggaggcccctatctgtgaggtgtgcttggtgagaagcgcaggcagcccggcaggcgggaggtctgcagagcgctygtggaaactacggttgtgtgtgcaggacatgggaccacagagatgccgacagccatccagcaccggacaagagtgggaaatgccacctggagcccagcctttgggtaagggagcagggtataaactatgatgcagtcatccattttggattcagagtctgatgctgataaaacccgggacagggccacaggtggcagagggacgtgcggaccccaaaccatgggtgctgcatgctctgtctcatccacgataacaaccatctgagagcagaaatgagaagtttggaatcactgcagcttgccaccaaagagccatgtgttaagtactgggccagaaaacatggtcagaggctatgaggcctccagagggcaggccaagttcatttttagcagatacatttaaaaagtttctaccaatgttcacagtggtttaaaatgagggccctggtgtcaggaagtgagtcctgggtctgaaccctggtgccaccactccaagggccrtgaccttaagaatcaccaactgggctcagaggcccacctcctgggcagcagagagaagacctgccatctgctcaggttgcccacaggcagtacctggcatgcagtcagccacctgtactccagtcttttctttacctgcagctttcagtgcagtccgtagttcataggtagayatggtgccggacttgtcagcatcaaaccgaaggaaaaggttctaaagggtggagagcagaagccttgagaaggagcgtgcctgaaaggcatcgctgrtggcagtaaatgggtgacagccagcccgggggagctaccctctaggggccgcagaggccacagttggactgggccttccaaaagaagtcggtctcccttttgtcttccttttcgtcttgggtggaagcacggtggtactcccgtaagyatcggaatagcatgatgctgttttcccttctcccctgtccraatacaattcctctagcctatagcctgcagcctgctgcaccattttaaatcccctctgctctaggttcactgggtcccccagaggccaagccctgctccaggttacatacaatccactgcttcagcttgtcccagaacactttgaattcatcaaactccagcttcccattgccgctggtctgtgccatgtgggttaagggagacatgagcagtgtttcaacctgaggctcctcgtgggacctcagctctgggactgcagagggggagggccgatgggctggcctgggtgcacaggtttggggccctggggaagtggttttaatgattaaaccacaaatctctgaagaggggaaacggcagaagtggaatgggggtggtccyggaaagttcacaaaaacagaactctgttcccttggatgggatcccaaagtggcaagaagacccccaagtcccttcaaaagctccccacccccaccactrggcagtcttgtgcatcttgattctgatccaatttcagcatgggggtcccccagctttgggttattttctgtgaagaagactattctgctggctaaggatgtcatgttcttggagagtctgcactattgaagattactctactgtgcttaaagcccaggatccatgtctatttctgctcaaatatttggaaggatacgtccatcagggaaatgatgtttttacaggagatcaggcttagcttcttgaatttgatgtccttttctgaaattgcacatgaaagctgaattcagttgacccgataagataaacctatgtacccatctgctgaaagcccaataatgtggctaaatccagggctgttgggggctgtgatgtggctactctcttatgatgctggtaggagtagaagttaacatgacctttcagaaggaaaattggctaaatgtgaaaaaagcaataaaagtgggaatacgccttcatccatttattctagttctaagaaccccgagcaaagaatwacatatgaagatttttgtcatcatattatttatagtggcaaaaatttggaagtgaaataatgaccaatagagaggcatggtcaataccttaggctatgtctatataatgaagtattatacgacccttaggaatcatgtttttgcagcatatttaatggcaggatttaaatttgttggagaaatttgtactcccatactgctgctggtgaaaatgtgaaatagtcactttagaaaacagttggatagtttttaaaaacattaaacatagagttaagcaatcctcttaactaaacatataattaagaggatggttatgccaccatgtaaccatagactgttgcattgtgatggaaccatcctcataactatatacccaggagaagtaaaaacacatgcccacccaaaaaacttgtataggagtgtttacagttgcattattcataatgaccaaaaaccggtaacaacccacgtggccaccaatagatgaatgaataaacagaacagggcccatccatacgatggaatgttgtctggctgtaagaaggaatgagacattgatacatgctacagcatggatggacctggaaaacatcacaccatgtgagaaaagccagtcagaaaggaccacatattgtatgattcctttttttccccctgaaacggagtattgctctgttgcccagcctggagtgcaacggtgtgatcttggttcactgcaaactccacctcccaggtttaagcaattctcctgccacagcttcccgagcagctgggattacaggtgcccacaaccacacctggctgattgtgtgtgtgtgtgtttatttttagtagagatggggtttcaccatgttgaccaggctggtcttgaactcctgacctaggtgatccgcctgtctcggcctcccaaagtgctgggattacaggcgtgagccaccrcacccggcctatgattccttttatataaaatattcagaatatgtaaatagaatctatagagaaartagatgagtggttgcctggggctgggggaaatgggtacagggttaacactgttaatgggtaaagggtttcttgttggagtgatgaaacattctaacattatatgtctacgcatatgacacacatgtacatacatgcagatacacatatgttaagagtggttatttatggtggtgagatcatttgtgactatctttgtcattaggcttttctgcatttttaagaattttctactataaacctgcatcgtttttggaatcaggaaaacaaacaatgaaagctatttttaaagtctacctacaaatcagccctgggaagcagatctgcggctcggaggagcagggaggggacccaggcagtgtggtcgcttgtccctccataggtgccccaggacccygatggggttggcacttactcttttgcagcacagcatttaaaacatactcaagttcctctgctgtcacctccatgtcctgttgaagtggagacaattgtttkttatagcccttggcaccttcttttatagtttatttttgttttaaatcagttctgagcttcatttggctccagtgacagaccagccttcaggaccctgctgtgggcagatgtacctatctcctgtgtagctgcagctatgtgtctcatatgtcacatgttttagggrcatgccagcccaactaggagagagcctaacttgagagacatcccaacccaggaaagcgcatgaaaagctgggcagggcaaggcagtggtttcccagcttccctgagggtcagaaccaactcctggaattgtcctaagctcctcagatgattcctatgttggaggcagtttgggaaaaccagactgagtcttcctctgtacagtagaaccacctgcagagctttaaaatagtcccgcatctggggcttaccccagggaatcttgaaatcagaggacctgagaatatggtcctatttttaagacctaggagttgatttagaattaagaataagggtgaatttcagaatcatggatctaaggcactccaggaaatctcagcagcccccaccccagaagctggttagaaatggagagtctcagaccttgccctgagactcaggctttttttttttttttttttttttttttgatacagggtcttgctctgtcatccagattggagtattagtggtgtgaccacagctgactgcagcctcaatttcccatgctcaagcaatcctcctacctcagcctcccaagtagctgggactataggcatgcaccaccatgctgggctgattatttttgcagagatgggctctccctatgttgcccaggatgctcttgacctattgatgaggaatctgtgttttttttcccaggatgcccaggtgactttatgcacatgtgtgtttgagtagcactgacatagacctcattttagtcagggttttgcgctagccgtgtgttatgctgtggagtgcttctaacacatgtccgtcctgaagcctctgggcctggggaatgggggtttgggatgtttggtgttggtaagaaagcactgccccagccaggcccccactgaaagaggaggaaagagaaatggagccatgtgcccaagtcatccaactacttggaagaaaagcaggacatgagtcaaggagggctgaactctagaggtactttttggttgttaataaaggtcgactgaaactcctgcaacattcaccgcttcccttccaaactctggatctccatctgacaacttctgcgcacccgcatgaacctctttaactcctctgagcctgtcttgctgggtctgacccagcatgctccagatagcacctggagcagggaggtcaccactgccttcccccctcaccatgctctgtcccgcccagggctrcgctcagccaccttcctgctgtgctttaagcagtcacatgagcccccattttctccatccgatcctgtggtcccctaatctccctgycttgcctgtttattgcagtgcctaatatactaccatcagacagcccctaggtttagatatcacccctccaggtgacccctttcataattcaggaaccccagtttggggaaacacatgaagctaatagagtcattagcaccttgacatgaattagttcatcagctcattgtatttatggctccaagagagcacctctggggcagtttctagaaagacttccctcccctgaccccagcaggtggaggaagagcctggatctgtgtgaggctccatccagtgtccctaaaaaggaagctgagcagtggaaagagctaggatagggtgggggacaggaagttgcaattgaatagggacctccttgaacatgatcccctttactacagcaaacagagtattctaatggcagtgattttcaggcagagttcaaaggagtcacctcttcaaggcttgctctagcctcccaaagaaagcacctggggccaggcgtggtagctcatgactgtaatcccagcactttgggaggctgaggccagaggattgcttgagcctaggagtttgagaccagcctgggcaacatagcaagactctttattatttatttttttaattagctaagcatgatggcatgtgcctatagtcccggctactcaggaagctgaggtgataggatctcttgagcccatgagtttgaggctgcagtgagctaggcttatrccactgcactccagccagggtaaaagagtgagactctgtctaaagcaaaacagaactaaaaaacaaagcgtctgggcctattccaagcttctttgggctcactggccccatccacagccgcagactgtgtaagtaaatgttgtaaacagggtggtctttgggccttgaatgatcagtgctggtcttactttgcaacaagctccatcatgcctcaggatgacgttgctgaccaaccccacgactgcaaccctttgctaggaagcaggtccaggccctcagsctggtggggagatggaagtggggcatgtcctacctcaccagcgacttgttcaaacagagcccgaaaccrctgctcctcctctgtctcctggtcaggtggagttggctttggaggctaaaaaacagccaaagaaacttgcacaaaatgatccacaaaaaagaaacatgacaaaaatagcaggaaagaagccaggascctgtgtgcccagccccatgtcaccctcctgaggcrgtgtgcacaagctgcgtcctgtagcgtgaggaacattttctcatgaaggctcttttagaaggtgagactagaaggactttattagctggacctgtggagcccttctgccttacagacgaggaggccaaaggaccttgacccgtgcctaagttaggtcctggccattggattttcatgcttcctgcccttcctctggcttacttcttaccaccctggactggaatgacttacttcatcatctgttttgatagctggtaaaatcgttgaaggcaagagtctgtttctaccactaagctctgggcttggtatatagaaagagctcagtaaatgttttgggtgatttttggtttctttggttttttagcaccattaataagctgtgccccagcatggaacagcaaattccctcctaaaagcagatctctgctgtccctggacgtgtcagactatttccagctatagtatctcagggcctcttgcgagtcctccagcccttggacgagggtaaagccacccccatgtcaccccttccacaccacataacataggggagatgtaatrtgttcccctgagtccacagtaaaaaacatctccctgcctctctggttttcttttcattgattagatttcttaaaatacaattaaaagtctacccacttcagaagcggcagccttctctcaggtggagttggtagtgtgaaagttattgagtcaaaatgaagtcactaatgttaagaaaaccctgacaaatagagctcgggaaggccagaaggttctcatgcttatttgcctgataacaaaaatatcacaaaaggctgcaaaacccacaacctttcacagaggccctcgcaaccatacacaaaaatacttctacctctgcctagcaactgcctgtccaacatcagactggcttcacttttgttattgatctttgtagccaaggataattatttcaaaacaattatgtaatccttctcattttttctttaaaaacctttgtcctcctttacctccccaaataggtgcatagtttactatggcatgcaccttcccattgcagtgctttatccctaaataaatagcttttcttttagagagtgtctctgtgtttgttatttcagttgacagtagcacagaggaagatgacatsgaacagaactttataccaagcacccacctcactcccatgccaggtccttgtggactagaagagcacagactagaacacacacatcttggtctccaggaggttagaatcatagatgcttacttgattgcatgtaaccatccctgaactgcagagttttacatgatgctgtgattagaaggaaggtttccagaaccatcacctgaatcccatactccatagcaacatcagaagactcacctcaggaaggtcaatgtctacatttccatccatatccctgtaggggcagaaaaacacactgcctcaattgtggattaacttcccattgggatctgcagagctgaagagcccagagcctgggaaggttctgtccctttgaatcccttattgttcagtgctgtttacatttcacagagtttgcagaccccatgcattgacacccccacccttagtcactcagaccttgctcagaatgtaaataagagggacagccattgtgttagaccattcttgcatggctatagagaaataacagagactaggtaatttataaagaaaagagatttgattggctcatggttctacaggctttacaggagcacagtgctggcatccgttctgcttctaaggaggcctcaggaaacttacaattattgcagaaggtgaagggggagcaggcaagtcacatggaaaaagcaggagcagggtggtatgggggagttgccaaatacccttaaacaaccagatctcgtgcaaactcactatcgtgaagacagcaccaagccatgagagatccgcccccatgacccaaacacctcccatcaagccccacccctaacactggggattacaattcaacatcagatttggtggggacacatattcaaactctatcattctgctatgggccctcaaatctcatgtccttctcacactgcaaaatataattatgccttcccaataacccccaaagtcttaagtcattccagcattaactcaaaattccaaagtccaaagtctcayctgagataaggcaagtcccatcacctatgagcctgtcaaatcaaaatcaagttccaagatatacaaattccattttatacttccaaaatacaatgggagtataggcattgggtaaacattcccattccaaaaggccaaaagaaaggggctacaggccccatgcaagtttgaaacccagcagggcagtcattaaatcttaaagctccaaagtgatctcctttgactccatgtcctacatccagggaacactggtacaaagggtgggatcccaaggccttgggaagctctgtccctgtgactttggctgctgtcatgggttgttgagtacctgtggcttttccaggctcaaggtgcaagctgccagtggatccaccattcttgggtctggaggatgatgrccgccttcccacagttccactaggcagtaccccagtggggactctgtgcgagaccttgaacctcacatttccccatctgcatagccctagtagaagttctctgtgagggctctgtccctgcagcargcttttgcctaggcatgcaggcttttccatacatcctctgaaatctaggtggaggctgccaagcctcattcagtcttgcactctgtgtgcctgcaggcttaacaccatatggaagctgtcaaggcttatggcttgcactcttgcaccctctgaagcagtagcccaaactgtatctggtgcctttgagcagagactggagctggagcagctgggatgcaggtaacagtgtcctgaggctgcatagagcagtggggccctaggcctggcccatgaagccatttttttcctcttaggcctctcggcctgtgatgggaggaggtgctgctgcaaaggtctctaaaatgcctttgaggccttttccccattgtcttggttatagcacttggctctttttagttatgtaaatatctctagcaagtggttgctccatagcctgcttgaattcctctctcgaaaaagctttttctttctctgctatatagccaggctgcaaattttccaaatttttatgccctgcttcccttttaaatgtatatattccagctttaastcatatctttgctcccatatctgagtataggttgttagaagcagccaggtcacatcctgaatgctttgctgcttagacatttcttcttccagataccctaaatcatcactatgacgttcaaacttccacagatccctagggcatggacacaattcagccaagttctttgctagggcataacacacataacctttgcttcagttcccaatgagttcctcctttccatctgagacctcggcagcctgaacttcactgttcatatcactgtcaacagttaggccataactatttaaccagcctctaagaagttataaacttttcctcatcttcctgtcttcttctgaggccttcaaactcttccaacctctgcctgttatctacttccaaagtcacttccacattttcagttatctttataacaatgccccactcttctgtaccaattttctgtattaggctgttcttgtactgctataaagaaatacctaasactaatttacaaagaaaagaggttcaattggctttacaaagaagcatggtgtattccctagaagttaacttaactccttgacttctagggagacctaggaaactacaatcatggcagaagggggaagagtcatgtcacatggcaaaagcaggagcaggggtggggcaggtgccacatactattaaccacatctcacaagaattcactcagtatcacgaggatagcaccaagccatgagggatccacacccatgacccaaacatctcccaccaggctccacctccaacattggggattacaattcaacttcagatttgatggggacacatattcaaactaaatcagccatcaccaagaacttgtgaattctggatttatgaaactaaaagaagttaagccagcagtcactccttatttctttaatgtactttaacaagggcaactgataaagtgttttgtagaatagcagcacctccaaagacgcataaacagtgcagttgcattacacattcactctccatgaactttgcatcttcaaaggagatacatatctgttggagaccattcagcctattgagtggtaggcactggggagggggtgcattttaaaagattacaaagttgaatcagaaccaaaaaaaccaccwttttttttagacggagtctcactctgtggcacaggctggagtgcaatggcatgatctcggctcactgcaacctctgcctcctgggttttaagtgattctcctgcctcagcctcccaattagctgggattacaggcacgtgccaccatgcccagctaattttgtatttttagtagagatagggtttctctgtgttggccaggctggtctcaaactcctgacttcaggtgatcctcctgcctcggcctcccaaagtgctgggattacaggcatgagccaccgtgcctggcctaaagaycaccttttgaagctgcatccctaactcctgcctctcatcacagatgtaaattcctgattccactggtggggttggggagggatgggtgtctctgtgcttatgttagggaaaaagaggaaaaatgatgcaatcatgtttttttgctattcacatatttagggggacttgtaatatttggatagtagtaatattaagaggaggagcaggcttcagcttttgatgatgctaaaaacatttggaagaatacagtctcatagactaaaacttgaagggctctcaaagaaaaactgatacaaagtcaaagggaatacaaataaacattaacatcaattgggggtagtcctccctttcctcctcatcccctgggcatccataacataaccctttcagaacttctgtttgtttaatcaggagtctgtctgagagctaaaccaatgcraacacagctcagtgtgaatttttgttaccaagctacagagctgattcttatactcaatatcatagcagattaaagaatcttgttcagagcaagattgagtatggagttttttgccatgtacaagtcaccttatgcatgtcagtgactctgagctcaccccactaataagatagagaacaagaggcatggcattggcataacttgggtctctcttgttcttgccacccataagagatgtcaatctgcatggatctcatacagggtacttttgtgtgaacagatactaggatattcatccccatcttgtactagtatctgggagaaggctggagaaaaattctctggtagagtgtttaaaaattaaagacttttctgcatctatttagccaagagaaagaaccatgccttttgtaatcagcttgggaaaccccactagacttcataattgagagtcttttcaatgcatgccaccaatctaattctctctcactaaacgaaagatgaaactagagtgagtcatgtattcacagctgtctctcttgttaactctgtgcagattgatcttttgttggagacttatctagcttaaatacagaattagcagattttagcgttctccttaatctttagaatattgtcatcgggaaaagaaatggattcctctgtcttgaaccatttttccccctgtgccacagagcaaccaatggtgaatgggcagtaatgggaaacattttccatagaagtaactgatataaagtaatttcgctaagacactgtgaggaaaatgtggtggaatattgggtatgtaaaatgagaggcagatttgccaacatttatttaaattggagctgaaagaacatgtcattcttgaaatttgcaatagccacccccttcatcatgcccagaaatgtctagcatccctgcatgtggctcttatccaagaagcttcttggtaatagggtctgaaaaatgaaggtctccacccaagaatgtcttgtgagcatgactctgggaccagtagaaaacagcaacttttcaatggtttgcttgagggagcgaggagcagagctagaagggatatgtgccttgccttgcagataagctaagaaagtgtcctgcagcctggcgtggtggctcactcctgtaatcccagcactttgggaggctgaggcgggtggatcacctaaggtcaggagttcgagaccagcctggctaacatggtgaaaccccgtctctactaaaaatacaaaaaaaattagccgggtgtggtggtgggtgcctgtaatccttgctactcgggaggatgagccaggagaattgcttgaacctgggaggtggaggttgcagtgagctgagatggcaccattgcactccagcctgggcaacaagagtgaaacttcatttcaaaaaaaaaaattaataataaataaaagaaaagaaagaaaccatcctgccttgtttctcaggtacacatgggaaagggaagaatggagtcttggctccagcagttcccaggtgacttctgtgtgaataaaccactaaaagaagtgggattctggaagctgttcctctgactcaccgggtaatggcttttttctctgaaaagattctcagacagaaatcagcttcctggtggggctcaaaagtgctgggaatcmggatgtactccccagggggcagcttgaaccggtcggagacttctctcaggttgatgaacgtcttgcttctggcccgagaagcgtggtatctgaagaagtctttgttcaggtgttcrtctttgtcagggcactgcaatgggcaagaaagggaggggtttcctagggaagttcctcttggcttttcggacacaattcatggactcttggttgagtctcgggtgtgagaccgaggaggagccgcgaatttagaactcagatggagaactctgaaatgcagtgtggttcccacctacctcataaatggcatagccgattgtcagcacattggcaccaaatctcttgagtttccttctatctttctgcatcagggctacaaggaaactacactcctcctgcccctcatctttctcagtcagagacaattttatttgtggattggtccaaaaggtatctgtcatttgggagaggtagattattttccccttttaaaaaacaacccacaaagaccacacacacacacacacacacacacacacacacacgcacatacacctatctgccctcattatatgtcctaccaaacatgagaaagtaataccttctctccctgttcaataagtcctcctaccctacttttgataatccccaacgggaatgcaaaatatcctctctttcatttccaccttctcttcaaccatttcctatgcagtttcttaaggacattcttctgggtctagtctgctaaagcttgttctatcagttttttttccacttagtatttcaaaggagagtgcagtggacttctggttgtccccctggcatctacttgatggtgggccgtttgagtaggattgacctcgagcactgctccagcatgaattctgattggtctgtgccagtcctttttgccaccgaggattggacaaagccaatcaatgcatagcattcactggacaatattagttcaaggaatttccaattagagggaagttgagggcttttttttgatacccccaggagctcttgctgttcgtgtgaatgagggctcaggaagccctggatactgctgccagccctcctgtgattataaagaaagccagacagagaaagaagtcaacacataaaagagggcagaacagtgaattacaagcaaatggaaccagggccctgatagaactgtgcctgaagcccaccctacttttcctctgagctcttcaattatgtgagataacaaatcctttctattgctaaactggcatgagtcatgctttccattacttgtaatggaaaataacctaagtggtaaaacaaaggaggtttccccaaacaattcttatccaactaaatctttgcagccttttttccccagtcacttttgaaaccttactatgtttcaggctttctctgaggacccggcccttatcctttggtgtcctgagttggaagggacacttgggagtggcagagagagtgacaggcagcctacctacccaggaaattgcggcagcccccagccgtggagccgcgaacccagcttccctgatggaccgtcacctcccatttgtggatcgcgtcttcctycagggcatcgggagtgaggttgcagatctccactttatcaaaktgggccttgaagtcctkaaatgccatcctgcagcaaagckgagagacacgatgcacaggagggcaagagtgagggcatcatccattcactcattcattaaatcattcacttattcattaaatcatcttgttcctgtccgcaaggagtggggggactgcaaagtgtggggagatggaaaattttttaaaagtaaaataaaggttaaaaaggtaaaaaccaggctaaaaatatagattgattgtagatgttaagtgctacagagaaaaaccaaattgggctgaaggatgggagcgtaggggtgggatgctattttaaacagggaggtaagagaagcccttactgatggggcacattctgagtggagacctgaactaccaggtcctgggcagggcagctctctgggggtctaggcagatggacagcaaggccccgaggcagagaggtgcttgaggtgctcacagaacaccaggaaggcacgaggtgtctgtaaggaataagatcaagagatcatagtacgtcaaataggtatagggattttggctttgactctgagaagatggagagcttttagaaggcagtaaacagaggagtcacatgctccatggctgctgtgttgagaacagactttggggacacaagtggaagcagagaggcagctaggaagttagtgccggtgtccaagtgagagacaagggtggcttggtccaggctgatggtatgggaggtgatgaacagtggccagatttgagacacattccaaaggtaaattttataggatttgctaatggactggatgtggggaaggagcgaatgaaaggaatcaggatgtttgatttgagtgactggaaggatggagatggggaaggctgtggtggggcagtttgagagagaagctcaggaggtcaggtttgggcacgtgaatgtgagatgtctattatacattcaaggagagatgttaaagtagaccattgaatatgtgactctggaatcctggggaaaggagctgaagatagaaacctgagaattagtgtaaagatagtttttaaagtcaagagaccagacgagacgcctaaagagtgggaatagacagccaggagggggaccatggatggggtcctgggacacctcagtgctaacaggttagggagatgagagggggccaggacaggatgttgagaaggagctcaggtaggaggaggaccaccagggcgtgtggtcccccgcaatccagcacgtcaagggctcctgatggatcaagataatctgatcgagcaaagtgagagtcggtggcgtccctggcaagatcagggtkagtggggtggtggggcacactcatagctgagtggagtcgagagagtaagggagaagaggaactggcgggcttgctgtagaggacaggagagagctgggttggtcacttgagtgggtcaagagaggctttttttttctttgcaggtaggagaaatgatagtgttggagtgctaaggggaatgattcagaagaaggggggaattcatacgtaaggggagagaagagagttgcaggaggtacatcctagagcyggtgaagaatggaaagaggctacacagggcttcagagtcaggattccaggaggaagggctccacgcacagagtgcatgatttaacaccacccatcaccttgggcaggctcagcccwggtgttggggctgctccttcaagaggggcagggcaatggatcactcacatggacgctcttctttgtggagcytcctgctgtgaatttccgagtttcctctgcccggcttctcccaccgtctgcaycagaccttctttccactagcctgacctcaggtagcctctcaaactctggtttctacctcctgctcatatgcagcaattactgtgatgktactaattccagaactcagctttcttcctgcagtttttgctcctctcttgtaaccccctaactcaaagtcccctgtacttcaaaattcaaagtttatctgtaatttctaatttgacagcttgggaatctctcaagcaccctgcatgtgttccacaaatctggggaacctaaaccctcatggttcccgaggcagagatggctggcagtcatcagcacaggaccaagactgcaccccactccttccatttgggagtagaatgtgagccgtgacgcatttacttctgagtcaagatttttagaaagtgagagtgtctttttcaatgttttattttattcttctcttctgctggctatgtgcagatgatgacgtgaccytagaagatggcagagccacacaatagaaggcgtttgggttcctgaatcactgtatgaacagagccacccacagaatatgaacatcctccctggactgtcataatgagtgaggaaaaaactttactgtgtttgagcctttatatatttggggtctattcactactgcagctagtgttaccttgagtcattggtgccttgaattacagaactgccacaacgaaattctaaaatatgttagcagttgagcaagagggatcatggaactgttcgagctggaaaatggttatctatgttatgcagtggcaaaacattgggtaaatctgttgcatgttgttatggactgaatgtttgtggtctcccctaaattcatatgttgaatcctaaccctcgaagtagtagtgtcaggaggtggggcctttgggaggtgactaggttgtgagggtggagccctcatggatggggttagtgccattataaaagaggccccagagagctgccttgccctctttctaccatgtgaggacagagtgagaaggatccatctataaatcagaaacagggccctccacagatacaggtactgcctgtgtcatcttcttggacttcctggtatctagaactgtgagaaataaattcctgttctttgtaagccactcagtctatggtatttttttatagccacccaaatagactaagacaactataaaaatacagaaggcagaacaaatcactactgaggctgtgttctatgggaaaagaatgaaaaaggctggaatagtcatggttttgggttgtagtattttttttttttttttttgagatggagtatcactctgttgtccaggctagagtgcagtgatgcaatctcggctcactgcaagctccacctcctgggttcacgccattctcctgcctcagcctcccaagtagctgggactataggcactcaccaccacccctggctaattttttgtatttttagcaggggtggggtttcactgtgttagccaggatggtttcaatctcctgacctcgtgatccacccgccttggcctcccaaagtgctgggattacaggcgtgagccaccgtgccctgctgttgtattttaaaagctgttacaagaaagagatgagctcaggcaagacttgattggttggagcacatgaaagggaatagagccagaaaccagaaatttgtggtctcacagggttagaagggccaacttctagaacccaaacaggaagaaataagactgaaaaagattctagagatgaaggcccaatacaaatgttcaattaaacaaagagattcaggccaagggaaagtccagagtagaaatgtttacttcctacgtaggtcgatatctttagatgctctcagggcagctgccttcaaaggtacctctcatcaagatgggtgtggagggaatggatcctgtgagcagtagggctgcctgtcttcaaattcactgtgtaaacctggatgacaaagagtgccaaggaggtgtgtcaggctagagaccagaggctcttcctctattggattgcaggaaccccctgaagactcttcaacaaaccgagagctggggtgagcccccaccaagacaggagggagattaaatttccctctaatctgggtgtatatgaggagtctgagacagatgaatttgatttgccaaaaatggagagagaaggctgggcgtggtrgctcatacctgtaattccagcactttgggaggccaaggtgggtggtttctctgaggtcaggggttcgagactagcctggccaacacggtgaaaccccatctctactamagatacaaaatgagtcgggcgtggtggcgcatgcctgtactctcagctgcttgggaggctgargcaggagtatcacttgaacctgggaggcagaggttgcagtgagacgagatcgcaccactgcactccagcctgggcaataagaacaaaactccgtctcaaaaaaaaaaaaaaaaaaagaaagaaagaaagaaaaaggaaagcgagagagaagcacagtgctccttacgccccagggccatgggacttgctcgtatctgcagttaacacaggaacaagcacggtaccagaattccccatcatccagagcagtgtgacacagacgyttctgctcagctggaccaacagaacgccactccggagaactaggagtaaacaaaattggtgttcaggcagaggtcatgatgaagagcaacaatggccttgatgtggaacccacagtgtgcggttatggaggaaataagacctgcttagtaactactcactgggtcccaaaaatgcacccagggatgtagcggcaggtgagccactggcccccaaataagagggctggtcagaaagtacatctccaagtgttgctgatggataaaatacccctgaggatgatctgaaccaccgacatggaagattatcttgggatagtcacaaggcattgcatgcccgtggggtagcagaagagcccggctggaagccacaagtctgctgactttcgtgcttggcctccaacttgccatgtgacctggagcagtacttggcccttccttaatggacaagctgacacttggaaaggtgataatgccttacacctgcccatgcttgatgttgtctgtacccggcaccttttgtatgtgacctcgctggcaagccaggtggggttctgtgagctaggtgtgcccgtcctgcagataagagggctcaggtaggcccatggaaacactctcagggaagagtaggggtaggaatggctgcctgtcactctccaaactcaggatttgtgactccaagttcattgcattttctgtgactcccacagccgcctccaaatagttcaaagtaggtcaccactgttgcggtgctacagccaacgtggcagctccctctcatcctgtgatctcaactcaacctcaggggagtgctcaggtgatccaaggggaggatcagccgggacctgtctccaggtgctcgggccagggtcagaagagtggaactggcagccattattttcttttggagccattatcctaagtggctcacacccagataattggcctgacaggctggccatgcggtgccttcaaccctactcacatgtcaccagcagcacagcraagtcagggartcgggayggcgcctgcccctcccatcacccatggaggctgcatgagtggaagacaaattttattccagccttggctctcagtcmctttcttgatttctacctctgtgagtcccagaaaatgggagacaatggcccattttccctttataggctacgatctcaaagttgaggggcactgcacatcttacaacgtgacgcagtctcactaattttggtttcagtagttctctgtgctttccatttctgccaggagagggaggccaatctctttcctcctcaacccatctcagctcatctctgccaatgcttcttggttctcagaaggcggcagccaaggccagagcagaggatggtgggacgagagcctccatggggacmatgacagcctggaaagcacaggcctgtgtgccctgccctcacgctggggtctggctaatacagcagcggctgcaccatgtctggygacctggtagctgtgtctggactgaagacaaacactggctcagttttaaccaagttctagactagcttcagatttccccagaagctcaggggccatggatgtggcaggaaagggcttcaggagcccaacaagcagcggacgagcaacagcytcaggcaggccctgccacgcacccacacaaacatccctggttcttagtcacctggtccacttcccaagggaccagagctggaggagctgtggggacacacacagaaaaggcagacctttcttgataactgggggccaaaactctggttaacagctctgtaatagataaaattccaattccatgtcctctattttttttcctttaaaaaaaaaaaaaaaaagagatggggtcaacatgctctgttgcccaggctggaatgcagtggtgcaatcatagctccctgcagcctcaatctctcatactcaagtgatcctcccacctcggcttgctgacgtgttggaattataggcatgagccaccatgctcagcctcacttctatttctctgctgggctattgggcctctgccatggtcagtgaccatcagagagaatcctatagttacatgctaggtaatatttcagggattccgacactccaaatacacacacacacacaaacacacacgcayttatgcatatgcacactgcttactggagttactcacaactacagataaagcttttcaccatatcactgggttataaacatcaccatgggaggtaacacatttatgtattgacataaatacaattcgtgaaagttagagtgctgttgtaaaagtctttcttgagaatcaaccttgatgcaaggtgggcctgagggctgaaaggggaggaagaaggggcacctcagaatcrggacaggatcctgagtcagagcccgggaggatagtagacaggccactccttcacatgtctgcacaagccagctytggccccacacgccccgggaaccagccagagaggcaggatagggtgactgacctgtcgctccaygacccgttccactcaacctggccccaagggttccggattcggatgagctcgattctctggcctcggaagcttacctagaagggaaaagcatgagggaagtgtgaaatgataaatatggtggaggtttggccacattcatctatgagctccaggtggaccagctccatccagaactggttctgttgaaagtctcttgcctaaaatgctgctgaaggtatgtagaagttcgccagttcttaaccagcccttggaaccttctaattcctattgaataattgctactattgccaatgatattatattaagcaccaaaatgcttatgccacatctgggaagtaaagtagaattgcaattaacaagaaattagtccatatgaatctaaaaatgggtttctctctagacttggatctccctagaggcaggagccaagtcttaggcatcttcagcatctagcagartgaatggtaaagagtagtcctcaaaggtgctcatggaactattactgaactttcttcatcctagcatcccatgcacagatgaatgataagaaaataagcacatgttggggatttaaacacaacaataaacaaaaacagcttttaygtcttctagacccaatattctccttatttcaggtgtctgtgaggattcctgctgttcacctcaatcacccttgagcctgtgtgccctcaggctctgcctgggagcagggacaagggccaatgcatttgagaagggttttagaggagagagagtgaaagtaaaagacttctagttatcractaaccagaaactgtagcagtcagaatgttttatcctcatgcatttggcataaattatattttggatgtgtaaaaattcaagtaacatcaactcttcrgagtccaagatgtggcttgtggctcaccattaaaggggctcatttaatttgaaaggttcagggcaggtgagttccttgtaggggggagaggaagcaaaatcaagcaaaccaagatgatgagaggtttctgttgttacgtggaatacgtagaagatctaacctagaaacatcacatgccygcttgagtgagcaatctgcaagtcatctatggatggtgaaggaggacaaaggagccaacacaaatagctaacattctaaagaatcccaaagagtccaayggcgtctcacaccttggctccagtgaggaggaagggcagrgtctcccttcagtgttctttactccccacgcattcagaggatgtcactcaaaaggtgggtggctacagaagaccaggtgcatctgcaccttctaagtactgggcttgagactggtccagggaggcatggagtgggcaaggcaggctgctgggctttgctgagcttgagtctggcagagtgatacctttggcttcttgtcctcctctttcattcaattctttcttwctcttccccttgtgcccctcaaggatctctcctcctaaccaacagctcccttgaagtcagggtggtgctgtgtggagtctgggtgtcccccaggatcagttccaccctgggctacagctacaagaatgggactcgtggtgattaattttatgtgtcaacttgactgggccatggggtgcccagatatttgctttaaggttattctggttgtgtctgcaagggtgcttctgggtgacatgaaatttaagttgattgagtaaaacagattgccctccccagtgtaggtgggcctcatctcatctgtgaagacctgaccwgaacaaaaaggcagaggaagggggaattcactctctcttcctgggtgcctgagctgggacatccgtctctcctgccctcagactgggacttttaccattggtgttcctggtggctaggccttcctttcagactcagaccagaactacaccactggctttcttgggcctccagtttgcagagagcagatcgtgggacttcttactcttcacaattgcatgagccaatgccttacaataaatcgtattacaggtgatcctggaacaatgtcaggggttggggtgccaaccctcctgcattgtcaaaaaatcttgtattccctaaagctgaactccgaatagcctaccattgaccagaagtcttatcgataacrtaaagaaccaattaacatgttttataattatttatattatatactgtattcttacaataaataagccagagaaaagaaatgttatcaagaaaatcatagggaagaggaaatacatttactatttattaagtggaactgggtmattgtaaaggtcttcatccttattatcttcaygttgagtaggctgagaaggaggaggaggagttggtcttgctgtctcaggggtggtagagatggaagaaaatccccatataagttcaagcctgtgttgctcaagggtcaactgtgtgatgtagatagatagatagatagatagatagatagatagatagatagatagatagatagatagataggtgtgtgtgtgtttaattgtatgtatatatatttggttccctagtgattctatttctctgaagaatcctgactaacacaggactgaaggagaattgggaaagaaaggaaattaaaaataaacaaagaccaggcgcttacagctgctaaacgagttttgtgctgcggtggaatcacatggtttctctctttcctggcttgccgttttgaattccagcctgcctctttaggtgacataatctctgaaatgcctgaaaggcagacatttaaactgcaatgcactgaataaatgcctaagggattagcattgtcacatgtctccccatagcctgcagttggagttcaagtcgcctacctggtcaattcccgttacactgtaggcatgacccttaataagaccaaacggcgtccgggcctcagattctgcagyacttctggtctaaaacatggraaragcagmgtcacacccaccgtctaagtcaagcctcccctgctggatcagacccagctacatgcctggcccrgtcacaacctccagccccttctgctgccccaggtgcaggccatgtgcgtgggctatgcacggggctcccctaggatgtttagcagtgacatgaagcaagttccagtctcttcccaggatggggaggcgctcgcttccagtgtggactccaaagaacagttcactattttgtccccaaacagaacaacttgtcaccttcatgtagtatagtgtgagagagaagacacaatcacatacatcccagagacgaaaagaagaatataacaacaggacacacagctctgcgtcacaaacctgaaagtgcagaggaactggctaattcattagcaaaaaacagaccccaaggctaatctaagaggaaacagaaaactagaattgattaaaaaaaatacatagtgtcatagcagtccataaaaaacaacaaaaagttttaaaaagatgagataaaattataagtgtgtgtgtttgtatgcatagagaaaattttaaaaaatatcattagacttctatctgctatttttttcatagtacatgaaatgaaaaaaaaaaaacaaatttcagaaaactagatagraagatcccrtttcagtaaaatcaaaccaactgaccttgatgtttgtgtgtggaagtgtgtgcctgtttgtacgagcagatagagagctgggaaggatacaggccaggtgatcccagtcccagggtggagctggagaacagaggcagctgagaaacgggtgggagggaggtaaaaatgcgcctgtatgggcctcaagattgttccatctgatacagcaagtacatcttacctttgttatttgacgactattaaataaaaacttgtgttttatttgttatttatttattagagacagggtcttgatctgtcacccagcctggagagcagtgacacgatcatagttcactgcggcctcaaactcctgggctcaagggatcctcctgcctcagactccagacacacaccaccatgcttggttaaaacttgtgttttatttatttatttttattttattttattttattttttatttatttatttatttatttatttatttatttatttatttattatwctttaagttttagggtacatgtgcacaacgtgcaggtttgttacatatgtatacctgtgccatgttggtgtgctgcacccattaactagtcatttagcactaggtatatctcctaatgctatccctcccacctccccccaaaacttgtgttttaattagcaggaataaacactgcccccaagagttatgcccctccttgggtgtggctggggtacctggtacagccccagcatagtgcctggaatgcactatgcagccycagcatagtgcctggaatgggagcccatgagcaacttacatcartgaagcagcccagcagggagcctctcttcaaagccttctctagaatctcatagaagttctcgggggcctctttagtttggaaggtctctgccacacccccrgtgaagtcttccatggcctcgatggcgctgcctcccttcagagcttcatagctcccatttagcctgcaagggtggcaagagagagaggagagagtcagggacctagggaggccacyrgggcaccctgctttcagagcttttctaactaagcctgaagcatctcccagggcttgccctggctgggtggtgtggaaggaagacgggaagcaagttatcagggtttgtttggagcttcgaggaagccaaagatcctgaccttcctgcaagggaggcagtgtggtgtggtggtatagagcagcagctctggtgcctgagtggccgcaggttcaaatcctggttctacgacttaccatctgaatgaccaagtcgctagtgccttcattttcttatatgcaaaatgggggagagagttgtgctctcccttctaggactgctgtgaggttcaaatcgtgtgtctcactctctaacctcccatggaacggggcctggctatgtggatagagagaggccctttcccttcttctctggtctcacatactcctaaccatttttgtcatagtcatctcttttattcatatgcattttacatatatgtgctctgcttgatttttaaataagcttttcaatttagaattttagaatctggtgggaggtgactgaattatggaggcgggtctttcctgcactgttcttgtgatagtgaatgagtctcatcagatctgatggttttaaaaatgggaatttccctgcccaagccctctttgcctgccaccatccatgtaagatgtgacttgctcctccttgtcttctgccattattgtgaatccttcccagccacgtggaactgtgagtccaattgaatgtctttcttttgtaaattgcccagtctagggtatgtttttatcagcagtgtgaaaacagacttaatacaatagcttatttgggcttctttagtttttacctaatgtcctttttctgttccagaatcccacccaggaccccacactgcactgagtcctcacatatccttaggctttttgtggctgtgacagtttataagactgtccttgtttttgatgaccttgacggttttgaggagtcctgggcaggcatactgcaggattagaatttgtctaatgttttttctcctggtaagactagggctattaaagaaatgataaatgcttgaggtgataagtatctcaattaccctgatttgatcatcgcacattgtgcgcttgtaatcagaatatcaaatgtgccccatcaatatgtatactattatgcactattatgcatccataaaaataaaaaatgaaacattttttaaaaattaaaaaaatagctgggtgtggtggttggtgcctgtaatcccagcatttcgggaggctgaggcaggagaatcacttgagcccaggagttgcaggctgcagtgagctattacggtgccactgcactctagtctgggtgagagagcaagaccctgtctccaaaaaaaagtaaataataataaaaaaaagagtggggctattggttagtggaaggaagaccggagaggtaaagctsccctctcatctcatsatatcaagagtacctgccgtccacatgccttaccacagctgatgctggccttgatcacctggctaaggtagtgttagtcaggtgtctccactggaaagttgctccttctctcccctttccatgctgaactctttggaaggaatcattatgtgaaggccgcatgaaaaaatcagggagttatactccacctcctcaaggatggaatataaacataatttatttggaattattctacacaggatatatgttccttcttccacatttatttatacaatcatttattcaaattagtatgaacccattgatatttattttctacttgggtttattttgtgtttttttgttttgttttgtttttgtttttgagatggagtcttgctctgttgcccaggctggagtgcagtggcatgatctcggcttactgcaacctctacctcctgggttcaagtggttctgctgccttagcctcccgagtagttgggattacaagcatgcaccaccatgcctggctaatttgtgtatttttagtagagactgagtttcatcatgttggccaggctggtctcgaactcctgacctcaggtgatccacctacttcggcctcccaaagtgctgggattacaggtgtgagtcactgcacccagcttctacttgggttcataatccagtactgctttgtctatttcgttggttgaattcttctagctttggctgtttggagctccttcagtatgctcttgtgcccttttggcataacctcatttgtgtgtgtgtgtgtgtgtgtgtgtgtgtgtgtgtgtgtgtgtgtgtcttgcatgtgttctcattttctggcactataagatgatctaggttcattttatgtatgtatgtatatatgtatgtgtatatatatgtatgtatgtgtgtatgccccagtcctagaatcagccttatctccaagaagccccagttcctttgattgaagaatgatcttagaaaccaagacttgagacataggtgtgcttgttgctacaggattgtcattgcttctagttcctctcactgacaaagcaaggaaatacatatgtgtatgataacccaagtatagatcaatatatatgtgtatgataacccatgtacagatccatgtatctctacataaccatctctgttaagctaaatctaagttcattctggaatctccaactctaatctgcatggatcattctggcctcctccccttgcctatctgtaacctctcaatccaacagtgagaaactcggctcccgccatccaccatccgttcactcgattgttcagctcaatatacatgtataattagatcaatttttcatttgtactcctacaagaaacaattttagcaactagagcatagcactcacgtacagtttcttttgcctttaatcttacagactccactgatttccaaagttacttaggtcagcacctttctctccaaccccttcaatgaggttatttcatacgtttgaaattggctctcatagttacggacgccaagaaatctcacaatctgccatttgcaaactggagaaccaggaaagctggtggtatcattcagtttgagtccaaaggcctgagaattggggggttgatgatgtaagtccaagtttgagtccaaaggtttgagaacgaggagctccaatgtccaagagcaggggaatatggatgtcccagttcaagtagggaaagggaattcacccttcctttgtcrttttcttttatttggatctttagcaaactgaataatgctcgtccacattggtggcagcaatcctctttactcagtctactgattcaaaagctattttctccagaaacactctcacagacacacccagaaataatgcttcaccagctatctgggcatcccttggcccaatcaagttgacacataaaactaaccataacaccatctatacagtttttttttggtgagctgttctgccaaccatttttggcctttttaartgaccccaataaatcttttttatgtttagaaactagatggcacacagttkctgttgccttgcttgcatcctgatgtggggggcactcaccaaggggcagaggtgggcttgggtcccacccactggacttggaaacagtgccctttgtccccttaagcctgtctggtggcactgatggtgtttgcacagacctgggtgggacagagggcaagcgtgggcatctttggttcttatttgatggctttaattctgtcctgctgatttcaggattaatttaaccacagtatgmctcccctctattttgccacttttatgtcccacttggaggtagaagcaagaccatccttgcttctgtctctggggatagtattctcatggcttgaagatccaggctgaacctgaaagtggctcccaggagctctgccatcatctgtggatcaaattcaggctgttgtggcctttcactaacgagctagtgggctggaaattgagagcctgaggaaactgaggccatttggctggtgattaaaaatgaatttcttggttccacttatatgaggttcctagactagataaatcataaaaacagaaagtagagtggtgttgccaggggctgggggaagggaggaataggaagttatttgttaatagggacagaatttcagttttgcaagatgaaaaagtgctggagatagatcgtggtgatagctgcacaacaacatggatgtacttaatgctactcaactgmacacttaaaaatggtaaaatttatgtcatatacattttatcatatacgattatttatcgatatgtcatatacgaytttttaaaaataaaaaagaagcatcccgtaggacggacaattgatgtctctatatcmacgtgcgtaatagcccagatgtttgagccatgccagtgtccgagggaagtgtgaagcactaagtgctgtcggcacagccagaattcccctccgcttgccttcccagctcttccaaaggccagattcatggcccagggagaaaaagggtcatgaatgtagcsactgctcccaaagatgggcacatctaggctacgacaggaaaaccacctccaaccccgcttgagccctgagagggttgggtcctgccgagcctcacctgcaaacccagagccctgattttttcccagcccttagatgctcactacaaagactagtrtagagactcctgtcgggaggctgcytgagctggggaagctgtcactcacttggcgtaggctttttccagcaaggcgctccagaactcrttgtggtcggcagagtggaggaaaaccaagcggtccctgaaggtgggcaggcggtcatcgatcaccacgtccagccactcactgtgctgccagaactgttgcccaggaaaaagacagaaatgatgygagtcagctacatgggagctccaggccctgtttgtaaatgttgatcctgttgcttttttcccctctgaccaagctacccatagacagctttgaaaatcacacacgggttccaaggtagggcacctgggctttgtccwccaagttacaagctgagtattccacccagcactaaccattgacatcagctgaaagactcagggtcaacccatcaaagccgcaggcgatgcagggggcaggacaggactcacaagtagacactctacggtgctctgaattagtttttcttcttcacaagaaagttgtttttgtgggggagggagaatggtaacgtggggtttgggtttgctgttttgtagcccagttctctgttattctctcccatccagtttcagggtctagctccaattttccttaaccttgctccctcctcgcccataagtggagcccctaagactgatttgttggccattcacataggaggcaggtggactcagtaatccctgcgtgccagtgaggagacatgagtggagtgtgggtgtgtgtgaatgcatgtgcgcacacatgtgtatacatgtgcatacaggcaggcatgacaggtatgtgcactgtttgtggtttatttatacattgcatgtgtgaaagcrtgtgtttgctcacatgtgtgcatgtgtgtgcatgtatgtgtgcaygcatgtgtttgcaagtgcttctacacacgtgtgtgtttgagcacatgtatgcatgtgtatgagcttgtgtgtggtctgctgggaacaggaagggaggttggaacgagtcaaggaccatggtagtttctctgtgtatcctgcagtgacccacctcctacccgttccttctggttcagttggcctgagagcgatcctaaggtaacctctaagagtaaraagaaaagggttgaaagaggagggtaggcacagtggttttgggagccatttatttacagctttgctgtgtcatcctgagcatcttgctgcatcagtgattcaatcccaatcagaagagttggccacgatgtggctgagggtgtctgtgtgtgtgtgtgtgttttaaggaagattcttgtcacctgctccagctggacctcccctccagggcttcccgcttttggggctatccacagcttcaggtgggactgaggcacagttgggttaggtgtttaaagttcgggcctgggccttggggttcctgagcaggggagcagtggggaggagcctcagggctggctttccttgcagaggggctggctcagggggcctgtgagtcaggagagattatctgccagcccagagagctctgctaacttcctagcacgcacacctgcactgtggctgaggagtggaagaggagtgtgaaggaggtggatttatttccaaagctctgcttcctagaaggccaaggaggggagcgggcggagtattgttattgcgggactgacaggcatcaacagggtcactccccacccccacatgatccctggcagcacaaaaggatgctggatccagaactcctgagttctaggtctggcttggctacttattgttttgtgaccctggatcaaccacttccactccctgggactcagtgtcctcgggagttaatgagaggactgggtcaggggattgccaaggctcctcccagctgtgacattcaagggacaagaacactgttccttttgggagcccaagaggtggtggttctggttctggtttagaggcagtagttctgctggttctggttctggtttagaggcagtagttctgctggattttctgagcttaaccacccccaacactgccaccctggtgtgtttaagaggactggggaaagaccggctcctgggggcgccatcaaaccaagactgtggtctcagcagaagtcacaggatgggaagggagacagccaggtggtggcaggtctgtgagagagcaggggtagagtttccctgggacccaaagtggctctgtccccagccggcgcaggaggcctgacccctgggaattgcatgctccctgagctacatgtgacctgctcactctctttgcctttgaaacacttctgtgctattggtgacagggcttgagagtacctctgcttatcagattgcaggcytcagggacagaagaaacgggctggccctgagtggtggcctgtgagtcaggagaaggtgacactgtctggggtggaaggtcaaggaatgcctactcggtgcctggctctgtgccrgctcctgtgtgtgatgccatttagctctacrggaagcctgcagggaactgtcagtctctccttttttcagacgagtgtagaaaggtttaatgtcactaagaaaattgtctgaggtcacccacctaagtaagaacaaggggcaagtttcagtatctggtcgaaccctatataaggacaggggtggaggagagactggagggatagaaagtgaggtgaagcagcaggaaaccatctcctgggggcaagcctctcctgatgtgcacctcggctgagggtctgcgggtcacacgggactccagcagatgttgtctgtatttttctcagtttttattttttaaaatccctcaagatctccaaatttacaattcttccataaagagaacctctctgtttatgagaaatcaaccagtttcctggaggtataattggtttagtcaatttgtgcttaaagcacaagaaattccaaataataaaacccttaacagatggacctccagatttgccaaaacatcacttatagttttaaatgtatgctccataaggattcaccgtgcaatgccgttaatgttcttctgaggcatttagctgttattccatgataaaatgtggctttagcatggtttaggaccatatgtcacacagatctgatgacatttttttctagggttaccaggcagtgtggaaatgcacctgccctcatgcygggccccagagaggtaaacccactggcycagggctccctcttacctggaaatggaatatcccggcataaccagggccaaakctttggtcctgggggatgactctggccagtgctttttgattaagcgtaagggaggcgatgrcggctaatagccagcagtctcctgcaaaatggaagccataaatcacaattttcattgctatttcacagcaaataggaaaactctgtgtcagaaggggatgtggggagtttcagatgtggccacatcttttctacctgtttaaaaacagacaggacaccaacaaataactctctcctccccttctgcctcccttgcctgctcttctctgcccgtctatcataaacagctgttgccttcttggcactgttataggacatgcttacttgggtttcagacatatggctgcctgatgcatcagctctgtraattccagcaactccctttccagaggwccaagwctgcatacatcagtgtcagcaygggctgggcgagcagacatttcatagctgccacccaagtggttcggcagtacttgggagggtggttagaaatctccctgcagccccaaccyagacwcagcttaattacagataatggtatctccgtggtggctccatttgctttaaattatcttgcattttcaagatttattgactgacctactgaacttcccagctgtgtcttcatgttaacacacatctggaggaaaactaaaaagtgaagtcaaacatcaaacatgattttatctgtgctatctgtgctgttccagactcctggaggcattcctttgcccacactgagtgtgggctgtgtctggtgtgtgcctcacagtgtctcagatgccgcctgtgtaagcagatatctgggaggatccatttatccgaatcacctttatccagattcacttgttttcagtagacaacatcaacgtcatcagaacmtaaragcccatcacactcagcttggcagtttctgagttcacatttctggaaagcaccgtatgtcactgggcttgggacattgtaatatggccytttctggctgtttgacacaggcaagagagactcgccagggcygaacatcgggaaagctaattccgaatcgccctggttctggctttctgagaggtgtcaccagcagagtacaagccacccccagccttagctggagcacagaaggattggtttctaatgcatctgctggtctttgggagcctcaggtcagctttgggagatgctactaggaagtgacatggctggaacctgcaggatcgtttgttcagcaaactttaccaagtgcctctagggtggcagaccttgtgccacgcagaagatgcaaagataaggagagacttggtgtctgctttcagcttcagggcggccaggccaacaggagtctaatagagtgacctctgctgtgggctgacctttcccagctctcctccaagtttcaactttgcccagttgaggaaaatgagtgttttccggcctgagaactcaacacctcacgtgttttcagccagaaatgctctgagcttttggcggggagattgagaagccaaaacaagattgcttttctctctcttgggcctgggcagatggatggggctggccacccagctgtgcctggaagaagtgccctctgtgggtcagcgtgttgctcggctatctgggtggtgcagagcagagggcactatgggaggagcaggctggagtgaagtggcaccatctcggctcactgcagggggaacgctgtgcctcttgggttctcagggaccccatactgcagtcgctcttgatccagcaatccaacctccctctcgccatgctccatcccctcacactcacccagctccacccctacccccaccccctgcagataacagcatgccttgatgctgttccaagtgtgttctagttttttttttttttttgatagagatgtggtcttgctatgttgcccaggctagtctaaaactcctgggctcaagagatcttcccacctccccctcccaaagcgctgygattacaggtgtgagcactctacatgaccagatgttctagttcttattgtgggtggcaacagatcacggctgttcattttcttgttattctttataacatatatatgccatgtacagtactttggtgtagtaaaagtgttacaaaataatctttagaatcaaccatccactaaggtaaaatataaggttgtaactccaaatatatgtttatgccaatgtgacaaaccaaaactttgaaaaacaaaggagccagtagaatgatttcctattggatagcaatggaggactacggggtcgaggggaagggaggcagaggaagagggggasaggtgggcagcggcagggaggatctcctggagaaggaccacctgaatgtaaaccttttgaaaagtctacattgtatctagaatatggcatacatgggggattggttccaggacccctgtgtataccaaaatctgtgcatactcaagtcccacagtaagccctgtggaatctgcctataccaagtcagccctctgtatatgcgggtttcaaatcctggaatagtatattttctccyttccttccttccttccttccttccttccttccttccttccttccttccttccttccatcctccctccctcccttcctccctctctcccttccttctttccttcctttttttcctttttgtttgtttgagacagtgtcttactctgttgtccaggctggagtgcagtggcatgatctcagctcactgcagcctcaacttcccaggctcaagcaatcctcccatctcagcctaccaagtagctggaactatggtcatgcaccaccaagcctggctaatttttcaattttaatttttagtagaggcgagccctcactatgttgcccagactggtcttgaactcctcggctcaagcgattctcctgcctcggcctcccaaagtgctgggattacaagtgtgagccatcacgctcagcctggaacacggtattttctgtctgtgtttggttgaaaaaaaatccacttagaagtggtcctgcactgttcaaactcatgttgttaaagggtcaactgtaattccgtctatcatccatcatctatctatacccatccatccatgtatttacccacctaccttcctatcattatttactaccatctatctattattatatatttattttgtatggtctatcagtcaatcaatcaacctatcaacctatttatctatctaattatgcatccgttttctacctatcatctattacttattatctatgtttctatctatctatccatttgcttctctctctctctctctctctcaattgtctctctgtctagctaattaactaacatcagtctaggtttgtgactttggatcttgtgtttaggatagctcagttgctcagcatggaggttccagcatggcctttcttaaccaatagaccacagtgacaacctcagctagaaataagtcagggtccacacaagcttgcagtggtttgttctctaggctgatttcactggtattttttaaaagaaagtctctcgctctctcactytctctgtctttcatagatagaacaaaggtaaacccagcccagttggattaagtcctaaaatgcaggacccaatttgagtgacttgaggtgcactcaggttcattgcaggagggagactggattgctggggagcggctccccagggtgtgtataatggttagcagtaagggctctgctgctggagtgtctgggttcaaatcctgattgcctgtctaccacctctgtgaccttggacaagttacttagccttcctcagcctccatttcctcatctgtgacgttaggagggtgggttgtgaagatggaatgaggcaatgtgtgctggggagagtacctcgcaggtgactgagttcatgtgtgcaggtgttagctactgtggtggtgtaggagagcccgaccaacgctgctgggtgtcactttcctctgtaaactccggggctgtgagccccacatcacaggcatgtctgactctagaggaacrgaggtgcaggggcttgaggccactggactccattcagagggagtgaggaagcagaggccraagcagtgttgttcccccagccccrtgcctcttgggtcctcagggaccccatgctgcagttgcttgcctgtcccagtgactcaacctccctytygccatgctccatccacttacactcacccagctctccctggcagatatcagtcctggtggcccctccaagaatgaattctgggtttttcacgatttcctggaggaatgagagtgttattaggctgaggcctgccatgctgcaagccactatgaaagggtaggctcagggtctctctgctttcttggggcagagggctttccctgtgcttgattcttttccctgaggagggccacgtggatgtaaaaggctgccacctctctatgctctggataaggctgggctcatctttggtaaatctcctccgccggggagaggtcctgcctcctgagctgcactcagcaccaatctctggccagaaacacaggccacacccggccacaaagctggacatcagccacacactgaggattcctgtgctcactcaggcactgggctaggagtccagggctatcccagctgtgagctctgtgacctctgtgggcttcaaggagctgagtaatgcatgtaccacaggctggggccttggactaaacatactccctacccacccakcttctccatttctttctttatataatccttcccccacaaagtggattccaaatatatataggtttagagacagaatcttgctgtgtcacccaggctggagtgcagtgacatgatcatagctcactacagccttgaccttctgggctcaagcaatcctyccacctcagcctcccaagtaactgggactacagacgtgagtcaccacgcccagccactttttaatttttttttttttttttgtggagatgggggtctcgctatgttgcccaggctggtctcaaactcctggcctcaagtgatcctcccgccttggattcccaaggtattgaggttacagacacatgccaccctgctcagtgtttctttttacagagatgcrcttaggtaaaatttcatgtatctataccatataaagagagatatgcacacatctctcatattgtttcaccgaagtgcattatatatatatattattctatattacacataagcacatacactatgtgtattaatgtaatcattaatacatattaatatatacatatacaatatggaggggtatttataaaacatgaacaaaaaagtgtagaaagcaatcttatgatatgcatatattcttccactctttgagttgctgggctccattcctgacattggacgacaacaaagagagagggaaagcccctgccctggtggagctgccctggacgcggagggcggtgctctcggaagccccgccccttcccagcctcctgccccgcccctcccccagcctgcctcagccctggcctcacccacggcgcccactgtgcctgcagctgccaccacctcccagaagctgttgtttcgttcaggagagttttgcaaattgcatttgaggaagagacaaaccataaaccaggagagaaaagagcgaggatggagagggaaggggtgggatggggcaaggstagctacagcagtcagcaggggaggcgtctctgggggaagcagaggagcacagacctaaacaaagggagggagggagggagggagggagraagccgggccggtcycgggagaggtaacagccaawcctgtggcagcgaggcmcgttctggctcaccctgcaggggtggtgagttaactgggccggggcctgcagaggagtgaaggatttttcccacctcttcccacttttccaggcaccaggactgaggaggggcctgggctggaggtggaaggttccagcagtgtctgggcggacgccaygtggggagctcaagctgcgccgccttccccgagagacctctgctttgaattgtcttcctcaggcttctcagcaccctgcttctcctctcatcttgtgtcccaaagaatcaaaggcaggacagagatttctttgaagtcaaggggattatcaggaccaagagcagaagcttcaaatgctggtgctctctctgcattccccaggatgtgacaacctggaggagtgacagacaccaggggcgcctgcccagggagagctatgtgtggcattagtgtctaaaatactcaagaaagcttggccaggagaattkctgaagaacacggggtgtttttagatgcgccaaaaccccaggcccggcagaagtaaggacctcccaaatgctggcctgtcctctgccaggtctcacacgtctttgcattcccacccccagctccaggtagctttggcgccatttcattaaatgactctgatctccgtggtggctggaaagggagtgaaggtggggggcagctgctcagttctggggtcctggcttggcttgcctgtgcggacccctctcatctgtaggaagcrcactgctcttcttcctcctccaccttggctagcgcaggagtttgcaggtggctctgagctgagcccagaaggacaatgcaaaccaggaccatgtcagtgggcctcaatagagtcccaggaatagcctgcccsgctcagcagtagggttcagggtgggccatttaacttctcacggctgcatcctcatctgtcaccagcttagacattctgggcttgytgcagaatgtgcctgcccgaagggaaacccaggagtcccccaagccctccctgtcttgattgcccagcccctgccaggggatagccmtggcaagcaatgcccccactgccaatgctactcactcctcaagtggacataaaatgtactccaaaagccacagatccctgcccagcaggctgtgctagctcctggggcagggctgttcccggatgcccgcctccttcccatcctccctgcccctcccctcccccagccttctgcaggcctggccccgccaaccgtaccaactgtgcctgcagctgccaccgcctcccagctcctatcttgcaattggttgttttgttcaggagaggtctgtttttgtttttgttttaaaccaratcgcacccaatgaggagaaaaatacaaaaggaaaaaactcagaaactctccaagtaaacacaaattagccatcgggtataaattggggaggtgtctggatgtgtgaccgactcctctgtgggtcagtgyttctggkaattggtgtgcacacgtgccagtcacagggggttctgcggacgcatgtgtggaaggggcagctaggcggtgggcctgggttagatgcctgggagtggtgtgtatgctgacggcccacatgcccacatgtgcaaggtgcctgtgacttgccttgttgtrtgtgcccaggtgtggtacacgtgtgtgcttgtgcatgctccacatgtatgctggttgcatgtgcacttgggagcattgtctacgtgtgagtgtcctgcatgtgcgtgtcgatcctggatgtacatttgttcctgtgaaatgttgcttgggaggccatgaggaaggggttacctgaagctacagtcctgtgataggacgatcagaggtgtctcaattgcaggggtcttgacaaacctgaagtgaacctagactgctgcctgaagccccgagggaggcacgcagacccctccccctccccctcccctcccccaccccacagccctaccaccaggtggttttcctggagcactaagggccaagcaccctggaatgtttgctttcagggactgttctgtttaccttgtacatcatcggggctcagccgaagacacactttcctctactaagcacagtgaataattcacaaagggaaaagccacccttctttctttctctttctttctttctttctttctttctttctttctttctttctttctttctttctttctttgtttctttcttctttctttctttctcttcttcctttctttttttctatctttctttctctttctctccttccttccttctttccttccttcctcccttcctcccttcccttccttccctttccctctctctcttcctctccttctctctttttctctttctttctctctttctttttcattcattctgtctttcacatggccttccagtgaagaaaagccacatttccagcaaggtctggagatgccagacgctgctgttcatagctatgtgccgatccctgtcatgtgcccagcactgtggaggccatggggcctttggggctgtcccagaacaactgacaacccctcctgggggtcaggggagcagcacagggaacggcaagctcaccgtgcaggagaggctgtggtcacatgccacgctgtgcacaggtctgccacaggggttgttcacatgggctagaggggtgtgggcactttcggggaggtgtcctggatttacactgagaattggtgggggggaattgcctggccaaaaataaatgggtacaggcagacaaggagggatggactgcatggtggctgttccccatcaggctgggagacctcacccgatactccctcctcctctttctgtgcacccacttccactcaggtccacagtcccttgcatgagacctgggggtgatctcaccttctctccaggttgagcctatcaccctctctgcctcccagcccctcccagccagttccctgagtcaccctcagtgcactccttgccctgggctcccttgagggcaagcctggctgtccactgccctccaatgtccccttggctttgtgctctgcccaccctccccaagyacagctgtgtttgacaagaaggtggtgctgaggaggagggccgtccagccccacggtcccacgggctgctgagaygtgcaccgtgtaatgctgagtccyactgcaaatgatgcccaagccacagaggtctgcagggaacctggcaatgcttgtgatttccctatggcccgctaccccccggctccctgcgactctatgctgcaaraagagtctccatgctcatcctcagcccttttgttcctgattttacagaaatctgtaagatatgatgtaaagctyctaactcccctaaataagaaacagataggggtacgrgaatgaggaccagaccaaagggacaatcttcagttgcagacaaaggaaaaggcagaacagattctgaaaatgagtctgtgggaacgacagcaacacagtagacctgggttaagatcaataaagggtctgccgtaggtggagacagtgggatgaagaagggacagagggctggtacaggggcatgggctgggtggcaggtcggggtgcatcttggcaggggcttgtgtgtatcaagggccctggcctgtggatgaaggcctcacccagcgtttggggcaatgccagaggagataatactaaggaagacagccccttggagcagagatctgggactctagagtcgctgggsaggccttggtggccctggtcccaggagggragacttctgaagggggagacaaagatgccctccatgctggtttgtgcgtccagcttttatctyggagaattctaactttgacaaaaagtaagtgagttgtagagtacagattacactttaaactagatgatgtcaatatagactgcaaggatgggggccctcctagagtcaggagacgatggtgttaggttacaatgacagcagtagaaataacaaggaccagcactgattctttacacaccaggctctttgctaagtgctctactcatggtaacgcagctgaccctcatgaggaccccataagttgcattattgtccccattttaaggaagagaaaaagtgcttccaaccttttcatatcaagtgcctgtagagaacatgagcatctgtatgaaaccctggatcaaacagaaagagccgctgcttctggccaggggctctgctcaccaggggcccaggaaatcaatttctctaactctatttcccagggctcctgacatcaactgcagggaaatctctgcccacagttaaaaatgcacccacagcctgcagcctgggcagctgcccacgcgcccatttgttcatgcgccgaggccggaaataagcccagggagacctaatggtcgtgggcggtgcccctcagagggtcactcttttatgtcttgtaacttctgcttttttagtttggaaatgtcctttttcttacttagcagagcatgacctactaatcctgtctgtaaagtgcaaccccacgtgatctgccagtgccgtgacctcacactgcaattggccatatgcagagaaccaaaaacaatcacagcgtggcttcggtgaggaaggtgcctgggagctttcaccccaactccgatagggccactgaatgctcactgtgatttccccatgaacatggcaccttgtgggatcaattacctggcaggtgaagatcaaagcacctgtgtgcctatgcatgcagtcacccaccccccacatacacgcctatgcatatccacacacatgtgcacacagtcacacacatgcacatacacagtcaaattcctacacacacaagtgcgtgcacacacatacaccccacactgcctactgcaggaaatagcaataaaacccttaccacttcggaaacacccacttaggttcactttggccctgcccctgaagagcccagaagttttgtgaatgtgcgttaaaaaaaattgtttttaatcatcaacattattttaatgttgggagatagtgaggaggtagttatgatgagtcctttgctactcatatgtaagatgagactcagagctaataatcattgtaatgatgataataatagtatcagtaatagtaataatgtgacaatagctgtaatgtactggaaaccttctgtgtgctagacattggcctgcrttagccattattgttcccattttacaggtgaggagactgaggctcagggaaatgaagtgatatgactatatgcatgagacaaattgtcaggataagacrggcactcaggatctcacttgtaggaccagcatcccttgtactgcccctccttgcccaaaagcaaccggaccccacaggagccactcccaggcccgtacmcacctggagggaatggaagccagcccagctggcgccgggtcagaggtagagccctgactaatccagcaccgcaaatattgacatggcgtcccaggcacaagctagcacctcttgggacccagtgaccagctggtgcctcttgggacgacacctccagactgtcagaggtggggcactgttcaccctgatctctgggaatggggggtgcatggttctygggagaagattcctgcttcccttgtattccatctgtcacccggttgctgagaccttgctgagccaaacatccatccacactgagcaccctcagctctgggccagaagccacagaacactgtgcataacgtgatctcagtgttaccacacacagggtgggggcctgtccttgtggataaggttttgattcgtgcctatcacctgctgacaagacccactctgactccaggtcctcagcctcggtrggagtcagacagcttggagccggggagcgggtacaaccagatgccccsggtccccaccgcagagcatcccaggcctgtacattattttctgcctccaaactgcaaagctttccacggtagactgggatgatgcamctcagttgcactgagcgtagccggcccctccccagcacccctgtttccacttcctgcgggggctgctgarcctcggcctcatctrtgctccttcccctgctcrccccactcacccctggtcgtttccacacaaaggggatctgcggcctctcactgtagaacagggaggaattgctggctgggaagtctgcatcctcaaacagggtgcctctctgcaggcactcctgcctcatttgctcaaagctctggcctgaggagtgggtgatccgggcgtccttgggaaccgggtgtgcctgaggccctggggcccggtagaggtaaggcatggctgctccctggaaggctggcttgggtccggcagtggatggaaaagaaagtgaagaagcgagctgtgtgtgccggtcaagaaggaacagctcagagggccactgggctgagtggccctcacctccacctattttctgggcacctccctgttagactgagatgggacacrccctgatggaaaacagcagagagagccctctgcccactctgcactcctgcagactcagaggcagctctggggcctggcacattccactcagaggcggcacctctgcttagtgcgctcagggggcctmatgggagagagaggattgcttcagaaggaaaaggagcaagaaacccaastggtccaggaggtggctttacggagaagtgcacggtgtggycttgagtcccatctcctgcatcagagaatggcagagttttgtagtcggaagggagsttggtgaatgaaagcaggatgcattatgtgaacacagctggcacagctcctgcacaggcaatcccatagtgattcagcactggggtcagcaaaccttttctgtaaaggcccagaccatgaatattttcagctttgtgggccacgcaaagtctgtgctgcaactactcaacttwgctgttgtagtgacaaagcagccgtagatgtgacacagatgaatgggtgtggctgtgttccaataaaactttatttacaaaggcaggtgggggttagatttcatccaacctgacccctgatagaggagaactcacagaggacatcggctcttcctctagggcacatgtgcctctttcrttctctagacatcatattaataaagttccttgttgttatagtcctacaaataggatctcacgtctgagaaaaaacaaatgttagaggatggaggtggtttgataaatgtgtttgcccatagaaatgattatacaggctgggtgtggtggctcacacctgtaatcccagcactttgggaggccgaggagggttgatcacccraggtcaggagatcaagaccagtctggccaacatcatgaaaccctgtctctactaaaaatacaaaaaattagcccggtgtggtggcggatgcttgtaatcccagctacttgggaggctgaggcaggagaatcccttgaacctgggaggtggaggttgcagtgaactgaggtcgtgccactgccctctagcctgggtgacagagagagactctgtcaaaaaaaaaaaaaaaaaaaargaaaaaagagagagagagagaaagaaaagagagagagagaaggaaagaagaaaagaaatgataaatactggaggggatagatagcctaaataccccaactcgatatcacacattctgcacatgtaacaaaatagcacatgtaccccatcaatacrtacaaatattatgtatcaataaaaataagtcaataaaagtattagtcaccacgtgaaaactctgatgttctaagcactttataatgatttctgtgtgattctctaactagtcaaagttgaggtttggagacaaggggtcttgagttaatgggtacagttaaaaggccatgatgtgaatttttatataagctcacagttcccaggagtgtgcactcagtctgacacacgttctgtctagtagatcctgcatatggttttacaggggaggtctagacattagagttggggatatttgggttttactctgctatggcctgattgcttgtattccgcaccacccccccgaccccgccaaaatttgtatgttgaacccataccctgcaaggtaatggtattagaaagtggggcctctaaggggtgattaggtcagaagagtggagccctcatgaatgggattggtgtcattatgaaagattaggtcacagagggccccctcctcccttccaccatgtgaggacacaggaaccagaaagtagaccctcaccaggcatggaatctgccagtgccttgatcttggacttccagcttccagaactgtgagcaacacatttctgttgtttataagccaccctgtctgtgctgttttgttatagaagcctgaatgaactaagacaaattcccagttttccctggggtgatcttgggcgagttatccatgctgtctgtccctgcttccaagctgtgaatcaggataatcggtgctgcctgctagaggcatggcgggtttgtggaarcaaagccacttgcaaagtctggcacatggaggggatcaggagctgctgattcctccctttcccctatcctctctgcaccccctgccmctcccacagatgctgctgaatttcatggtctccttctgagcctgacttgcctcaamttgcaaggcatctcttttgtctctttgtttgcacaatgaaggactttggaactggggtcctctggctgggaccagagtgcagttctggccagtccaaatgattcttggctagagatgatggagctgcccaggagtgtcccattgcccactgccctggcagacggctctgtttcgaagtgattaaggagggcaacctagggagacaggtgtggcaatgtgagggccatccatttctggtgacacctcggcagggaaatgattaccagcccagatctctgggagcatccccttcaaatgccccagcaactgagaaaggaccttgaagtaaatttcagcactgaccagaactgtaaagggtttgctcagcaccagacccactcccagcttcagggatttacgttctcattctcctcccgatacaaacacctctccaggctggggtcttgtccttccacctgggacttatctatgtattggaagaacctgcctttttctttagagtcttagtatagttgctaggtaattggagaattgcatcatcattgtgagtaaaacaaacatgcctcagagtaggaaacacaccaaaaaggtttaacaatcctccagaaccacagctggaattcctcctgccccctaacactctgggactctgagaatgtctgcgggagggagtgcattctcaggatttacagcctcatcattcttcctgcccaatgtctgcccacagagccctgggtccatctttcctgcagagctcatggcaccggacttctccatgactttgtcttagcgtctaatcctgctcccagctcagcccagtgcagggcaggagcacgatgcacatttgctgagtaaacattgaaccaatgcctcaagaaagcagatggcattcttgggtgtcttcatttagttttccaaaccttcacttctcaggatgaacaatagttacagaaactgcagccatgcartctaaggtctaccaggccttgcacacttcctcacccacactgggaaatgccctgagtggctcagagggaaagggctctgagcttgggcagagaatcatgtgcactgtttttaataagctctgccagcttgtcgctagcctagagatgcaatcagctttgagccaagcgggggccatgcatcatgttaagtgtattttcttctctttagcagagcaatctgctgaagtgatttctacatgaaatgaacctgacctggcatctggggccttcctggcctctcttttctgtgctgttctttctctgtctcctccacactcaggcctstggcgaactccctttgtttctcttcttcttgttcatcttgaagggcagcaggaggtgaacatagtgcctgsgtggctctgggatgccatggggcaaaaccccaaggacaaatgctcrgaagcttcacatgggtgcagggagatgacctctaggaccccacccggtccaggccttacagcagggcctgggttttgagggatatgccaaacagcctggatcctgcagagggatctcagccctatgatgggctgagagtgagcccacccggctgcgacatttgtagccccttggcttgcagtgtggaggatggggtgggctggcgaggagggtggagagtggagaggcaggggacctgcacaggtgtccaggtgagaggggctgaggctaactccagatgtaaccagagtgaaggcaggaagggacagattcttctagaagtactgtcagggcgttctgctggggtgcaagggtggaggtgtaaaggtggcgtcctgccttcagacttgagcaaatgggtgatggtggtgacagaaggaggagaggcagacttggaagaaaagttgaacactttgggtatgttaagagtaagacgactgcgtgcaatggctcacacctgtaatcccagcactttgggaggctgagacagatgggtcacctgaagtcaggagttcaagaccagcctggccaacatggtaaaaccttgactctactaaaaatacaaaaaatgagtcaggcgtggtgggggtgcctgtaatcccagctacttgggaggctgaggcaggagaattgcttgaacccgggagtcagaggctgcagtgagccgagatcsagccacggcactccagcctgggcgaggagcgagactccatctcaaaaagaaaaagtaaaacacccccctacttgctgaagggagtgtaaattggtgtctcctttttggagaactatttatgaatacctctcagagctaccaatgcacccactctgatccagctgtttcccttctagaaatttatctttatcctgatgatagagccgcaccccgaaaagtgaaaggtataccagcttgytcatttcatggtggcattgtttacattaaaaaaggttggaaagcacttagtgccctctgttgggggaatggtraagaaaattatggtccagctaatcatgaagtggaacagtgtacagccataaaacggaacaaggaaactctgcatacactgatgtgggaaggtccctgggatacagtgttcaactgaaaagtcaaagtggccgggtgcagtggctcacgcctgtaatcccagcactttgggaggctaaggcaggcggatcatgaggtcaggagttcaagaccagccttgccaacatagtgaaaccctgtctctattagaaatacagaaaattagccaggcatagtggtgggcacctgtaatcccagctacttgggaggcagaggtaggagaattgcttgaacccgggaggtggaggttgcagtgagccgagatggtgctactgcactccagcctgggtgacagtgcgagactctgtctcaaaaagaaaaagaaaaaagaaaattcaaagtgcagaatggcatgtagagtatgccagcatttgtggagaaagaaggcaaaaaatatttatttatatctgcataaaaatttctcggaaactacacaaagatctactcataatagtggttctgttttctgggggtaggtggagtagatgggggtagaggaatgtggggagacttttctatatgccttttatatttttttagctttaaccctatagatttacctggttgaattttttaaaattttattttagagtcggagtcttgctctgtcactcaggctggagtgcagtgacatgatcatagctcactgaaggcttgaactcctgggctcaagagatcctcctacctcagcctccccagtggctgggactacaggtgtacaccacaacactagccttaactgttgtcgacttttaaaagcctagtttgaaacttaaagcccacaatgatgttttggcctaggtgggctctgccttccctcccccgtgtatctctcctcgcaagatgtctgtacatttgcaaaggagcttatctgtcctgagggccacccccatttcctagaagatgagaactagatcttcacccagaccttgcttccctatccatcccctcccaaggtcattggtaagcctgacatcaggtgagggtctcmctttcttcatccagggacttgtccatccctggaacactcctagtttcacccctgtcctagtgggcactcattcatgaaccataacaaatcttttcttcagtgggaatgagccgtgctcaggcatcacaccatagggtaagagccatctcctgaaaggcaacagagcacccagcccaaatctcccccacactcgctgctccacagggtgatgccagtctttggcctcagctgtctgactcaagagatcccagcttgtaggcgcataggctcgtggacgacctggtggttcccctggtttcccagggctgcacaagctgcctatagcttctctcagctctggccttgctttctggcttgattgtggaatatagtttcctccaaggcctaatctccctaagtaagctctagatcactgcccctatggcctaaggtgacaccgttgaaattgtacttccgtccctgagaagtagtttcactccttaaacattcattgttgaagaatgataaatatacctgtctgccttctgctaactctctgggatttctttccctggagtttgacctcagcccaagacgatttcctttctccttctcatctasgagctggaggttgatgctatgcacagatcttaggatgacttgaatcacaggtgcagcaggataggaatttactctccgcagtttagggcccaaaaaaatcctaatttttgagacagagtctcctctgttgccaggctagagtgcagtggtgcgatcttggctcaccgtaacccacctcccgggttcaagctattctcctgcctcagcctcccaagtagctaggactacaggcgtgtgccaccacatccagctaatttttgtatttttagtagagatggggtttcaccatgttggccaggatggtcttgatctcttgacctcatgatccactcacctcagcctcccaaagtgctgggattacaggcgtgagccaccgcatctggccaaaaatcctaattaaaaaaaatattatctcttcttgccctctggagtccccagttaccacctcgcaccaaaacttgtatttagattttgttgtgtgacactcttattcattttaaaatggtctctcttactctatctctcttcttctgtctctgtaaactagcagttacttcaaagttcaaatatcctgtaaggtttgtcagaggtgtttgagccagaatgtctccaacttgaataggggttgggtaaaataaggctgagacctcctggctgctttcccaggaggttaggcgttcttagtcacaggatgacataggaggtcggcaggtcacaaagatacaggtcacaaagaacccactgataaataaaacaagatgcagtaaagaagctgccaaaacccactaaaaccaagatggcgatgaaagtgacctctgttcgtcctcactgctcattatacactaattataatacattagcatactaaaagacactcccacctgcatcatgacagtttacaaatgccatggcaatgtcaggaagtcatcctctatagtctaaaaaggagaggaagccttgtttcagggaagcctctgcccctttcctggtaaactcatgaataatccaccctttgtttagcatatgaccaagaaataaccctaagtatactcagttgagcagcccatactgctgctctacctacggagtggccattctttctttacgtctttataaacttgctttcgatctatagactcgtcctgaattcttycttgcgtgaggtccaagaaccctctcctggggtctggatcaggacccctttccagtaacaggtccacttttccccaaataagtgatcttcctcctccttcctccttctgatagtggcatctaggtcagggtgaatcttaccaaacctgccactggagcagggacctctggctctctgggatcttcttggttgaggtgtctctgggaaccagcttctttccttacggtatttgctgtggaggggtcacagctagcataacttgtgtttcattttcctatcgggggcaatgcaccgtaattaccccggaagctcagcctggctccaacatttcccgttaatgatgagccctccacctggtttctctgtgcttgccgaacctcagaaactcatttgctcttctcagtggtccccagctttgggctctcagctctgcagactctgccacaccatctcatgccctgctcagggcaacaccctggtggacaaggtgactcttaattcccagccaccccccgccccatagtggaaattgtgattggacatttattattattattttattttagagacactgctggagtgcagtggcatgatcatagctcactgtggcttccaactcctgggctccagccatccttctgcctcagcctcctgagcagctgggactatagtcatacccagctaattaaaaaaaaaaaaaaacctgtagaggagggagtctcagtatgttgcccacactggtcttgaactcctagcttcawatgattctcctgccttggcctcccaaagtgctggggttacagatgtgagccactgcacctggccttattatgtttaattggagggaacattgataaagtctgttacatagtagcaagagtatccctaacatgccttaccactgagaaataagattctttgctgctggaggtgtgtgaagtttttctatagcagaaggagatgtaatttttttaaaagtcctttgactacagagatttttatattgtctgtgtacaatattactgggtttattaaaataatttaatttaaaatatctcatttgatttatcacctacatctacagttgtgtatttagttatgggacatacatctaattgaattcccatctttttgtggtaaaggtttattttcagcatctctttatgcatctcatcctttcccactctccattttctctttttaatgcaccattttctgattcttataaatgacgtatcctccccctttggcaaggtagcattagccagcaagcatacctaatatttgtgtggatggaaggctcaggaagagaactatttgtctctttcgagcttatggctttcacaaagtgtcatagcaatttttatgactcaactttcaaaagagatttattagcttgggtctctaggaaaaaataatttataaggccactgacaatcatagctgtgaagacataaagtaacatgataagcacttatttttatagcactttttacatatgagactaccatggtatgaagttcaattatgatgactgatttataaacatcatttcttgtttaacgtgggtaatttttaaaagtatgaactggtgagaatgtcaaatggtgcagccaatttggaaaagtgtgacaggtcctcaaacaactagacatagagttactgtaggagccagcagtttcactcctgggtatctgtcaagagaactgaaaacagatgtccacacaaaacttattcatgaatgcttacaacagccttattcataacagccagaaggtgcaagcaactaattgtccatcagctgatgaatggataaataatgtgtggtatatccacgtagtggaacattattcagccataaaaaggaatgaagtactaatgctacaccttggatgaaccttgaaaacattacgctaactgaaagaagcaagtcacaaaggacaacagactatggaaatctatggagacaggaagtcattagtggttgcttagggctggggatggggtgaagtgggaggggtgggggtgatggctaaaggctttctttttgagatgatgaaatcttctaaaattgactgtggtggtggttgcacaactctaaatatgctaaaaatcattgaattgtacactttaaataggtgaattgtatgtacagtatmtgaattacatctcaaagctatcttaaaaagataaataagctctgtgcctcattttgcctcctacagtgtttcgtaaagttgtagtactaaaagggagatttgatagcaataatgataataataataaacaggctgggcgcagtggctcaagcctgtaatctcagcactttgggaggctgaggcaggtggatcacctcaggtcaggagttcaagaccagcctggccaacatggtaaaaccccatctctactaaaaatacaaaaattagccaggtgtggtggtgggcacctgtattctcagctactcaggaagctggggccagggaatcgcttgaacctgggaggcagaggttgcagtgagctgagatcacatcatggcactccagtcttggtgacaaaagtgaaactccatctcaaaataataataataataataaacaatttctaagtattattcttagyagtcacctacgcatggcactttgtgcagatgactcctgcatgtgtcagggtttttcttgcgggcaatgcagtctgatcagtataaactaggcagagaggtatttgatgaagggtttggggaactcagaaaatggactgggaagctaagaaccaggcatggaaatgagcaagaactaggggagattggggagcaggagcagaaatggtcttgcaccagggtcagaaatgcctgtggttgaaagtcagctgtcttcagcgttcaaacctctgtgctccagattccagctccagggtggttggcttagtgggtacctgcctctcagcccaaggagaacagagctttcgattcacagagcttccgattcacagaatttccagcctccactcaagaacaacagggatccaggtgctgaaaagggatagatgcctcccacagactccagggaagcattcagttgtgaccacctctacccttttaagggatcgaagcccagcctagcaggaaactgagctttggggctttgaaattttgccccaaagtgctgctagaagaattggattagataggataccaccatgtcactgactacttagggggaaaagaaagctgaggtagtgaaaacatttaatgaaatcctgaacacccagagtaacctatttcttccttgctccgttcccatttatatctgagaactgtgttcatgccccagatgttgcaagaatactgcggaaacaaaagtgttcgaaataattcttttttttcgagatggagtctcgctctgtcacccaggctggagtgcagtggagtgatctcaactcactgcaagctctgcctcctgggttcacgccattctcctgcctcagcctcctgagtagctgggactacaggtgcccgccaccatgcccggctttttgtatttttagtagagatggggtttcaccgtgttagccaggatggtctcaatctcccgacctcatgatctgcccacctcagcctcccaaagtgctgggattacaggtgtgagccaccgcgcccagctgaaataattcttatgctcaggatcaaaatgataaggggtcaattgtattaaacacacacacacacacacacacacaaactttgccttaaacataaatgtgtttcagaagcttggaagcagaaaataattttaggagctgagtattattaatcagcctatgtgttttcaactgcaccaagaaatatagcaaagatatgcaaactctttggatttaagacatcacctttgtgttttgacactctttcccaaaccccgcctaaatgacaggtgggactgttttcttttaaacagtaaaggcagggtcctgagaagacacttgaatggggcaattggaggagtgtttaatcgatgaactatttacaaagatgtgggcaggaagaccatgatagactgagcagttggggggctggaagcagcagggtacccctagaatctacagctctgagggggtgaaggagaagcagtttcaggaaggagggcgggatgggagctgatgggggaggatgcagtcacctgaggccaacctaaggggaaggagaagctgtggagtggaagccagggaaggaagggagccctgtgacaccatctgtgtaatcagcctcccaggaggtggagcagggtgacaagtgcactccgagggaggggccaccaggtgagtcagcccagggcccagctgctaagaccaggggcaggcctcctccaagtggggttgggcaggggggcaaaggagaacaaaaaagccactttacctacttctgtattgagtttttaaaaaagactgtattaatttacattgtaattttaaaataaaaatgtaaaaatattaaacatgactcggaaatcattgagtttgaggatctcatgagaagttgatgacccttcttgaggtaactaacgacactttggaaggtgaaaccaggttgctcgcccactctaagaaggagcgagaaggaagaaggagaaacagcactgtgcccccttctcccgctgcagtcggggcgagatttccatgctctgggaggtagtggaaggaagcgttcagtgaggcccttaaagacaatggccctgccagccagttgtgatgttgacaatgttctcctgcaggagggcgggaggcctataaagtaccaagcgcagtcctccatgagcaacggggaggcgatgagcgaccctctcctccagggatagacacagaccctctcctccagggataaacacagccagttatggccgggcgcgatggctcacatctgtaatcccagcactttgggaggccaaggtgggcagatcacgaggtcaggagatcgagaccatcctggccaacatggtgaaaccctgtctctactaaacatacaaaaaaaaaagttagccaggcgtggtggcaggcgcctgtagtcccagctacttgggaggctgaggcaggagagtggcatgaacccgggaggtggagcttgcagtgagccgagattgcaccactgcactccagcctgggcgacagagcgagactccatctcaaaaaaaagaaaaacaaaaaaaccagccagttatatttaccagctattaattaaatttttcactggaagcagtcttgccttgtacatagggatgaaacacacacacacacacacamatacacacaccatatatatatttataaatgcatatataaaaattatggtaaaatacatgtaacataaaatttacaaccttaaccatttctaagtgctcagttcattggcatcaagtatatttgcattgttgtggactcatcacaccatccatctccacaattctttttatcttccccaactgaaattctgtgcccattaagcaaaatctccccattctcccctcccccagcccctggaaaccaccattctattttccgtctctatgaatctgactattctaagaacctcgtaaaagtggaatcatatagcatttgtcttgttgtgactggtttatgttacttagcataatgtcttcaaggtccatccatgatrtagcatatgtcagaatgtcctttctattttgcttgaataatattccatcgtatggatatgtcatattttgtctttctatttatctgttggtggacacttgagttgcattcaccttttgtaaatataacacatacacaatgacacacaaactccagtatgtgccagggacccgcacttgttaaagggtcatctataaaagagaaagagaaaatacatgtgccaacctaagtgagaagatgagaagcttcaagaagcttgagttgggcttctgtgcatcacaaaggtggagcctggactgtcatctgggcccggcctcttgggtagtggtccctgaatgactggcagaacaagaacatgaaatggtctccacgcagaagacagccacgtggaagtggctgactggtagaccagctgagatgaagactactccagtcytcacagcggtgctcaaatggccccatcaaatcaaatgtaatgaccaggcagagactagggtgaaaacagttgtggaaatccatttgtatgtctcctgtaatatatgattggattagctcatcccaactcaatgaacttcattgccaagttctccagaggaaaagtctgtccttctagtgccttctgttttcacacaataagcaaggatgacattttggcgtgacttgttaaattgtagcaaatgagacaactgtcagggtgtagacaaaggcaaacaaatcacttagtgatttgtcgagtgaaaatcgacctcaactaaaggcgctcactggagtctccttgtggcatttctcatgggcacttgctttcataagcatcgccctttgatgttattttgctaggagaatgtggaaaagtgtatttggaaacactgagtttcagagctgatagtaatgctgtatcatttcaatcagaaaggaattttgcaaaaaggaactgacttttttgtttgtttgtttttgagayggagtttagatcttgttgcccacgctggagtgcaatggcgcaatctcggctcactgcaacctctgcctcccaggtttaagtgattctcctgcctcagcctcctgagtagctgggattacaggcatgcgccaccatgcctggctaattttttgtatctttagtagagatgaggtttctccatgttggttgggctgatcttgaacgcccgacctcagatgatccacctgccttggcctcccaaagtgctgggattacaggtgtgagccaccgagaccagcagggactgacttttaacagatcagttatttaagcttgtcctctgtgcctgggatggttttaggtacctgtctgcattcactgtgttaatacagtrtagtcctcaaataccgttggtccttgaacaacacagatctgaactatgtggggccacttcttggattttcttccacctctgccacccttgagacagcaagaccaattccttctcttcctcctaagcctactcaacctgaagatgataagaatgaaggccttgatgatgatccacttccatttaatggagagtaaatatgttttctctttgttacgattttcttartaacattttattttctgtagcttactttgtgcacagtatataatatacacagtatttaatacctacgacataaaaatatgtgttaatcaacattagattatcagtaaagtttctgatcaacagtgggctattaggagttgagtttggggagagtcaaaagttattcttgcattttcaactgcgaaggaagtcagtgcctctaaccccagtgctgttcaaggatcaactgtagttcaccaagaaagctggggttgatcccattccagccctaccctgctcttggtgggcacagagagttgtgagacctacctctggccagacactgttctatgtgtggaaatattgcaatgaagaagatcaaccmtccaaatgctcactgtggccaggctcggtggctcatgcgtatcattccaactctttgggaggccatggtggaatgattgcttgaggcccagaatttgagaccagcctgagcaatatagcaaaactctgtctctacaaacaaacaaataaacaaacaaacaacaaaaaataatgctytctgtacataaaccagsacataagtaatataatttcatgggatgatagtcactatagagaagatargggtggtgcagtggaataaggtgagatagggttggtgggcagggctcttctctgggggtcatcagacgggtgaaatttgagctgagatatgagtgatgaggagccgctgcacaaagatgctggatagagggaacagcaagatttgtgycttaggaagctttgagtttctgtgggttttgttgttgttgttgttgttattattttttttgagatggagtctcactctgtcacccagtttagagtgcagtggcatgatcttggttcgttgcaacctccgcctcccaggctcaagagattctccttcctcagcctcctgagtaactgggattacaggtgtgtgccaccatgcctggctaattttttgtatttttagtagagacggggtttcaccatgttggccagactggtcttgagctcctaacctcaagtgatccacccaccttggcctcccaaagtgttgggattacagacgtgagccatcgtgtctggccaagtttctgtgttaatggacacagaagaagtcagcacagctggaaggcagaggacaaggaggtgcatggtccaaggctgtagagagaagggcagcagccaggtcgtgtaagtgactgcacacggcaaggattyaggagtttcctctcattgcaatgggcagccttggggagttttcctctgggaggaaatctcatggatttatactgaagaaatarctggctatgtgctgtgtgataacagatggaagggggctggaggggaagcagagaatcgggttgggaggcctgtgggaccgctagaagccacccctgcactaggtaaacagtgtggacctgaaagggacaggctgaagcacgaagtgtgatttacaaatattactcgagccagaataaagacagctgcctggaagcctcagacacaagtgaccttggatatgaactccatttggctttcgtcacaaggtttttaaaggaacaaaaagggaggagtcagggagtggcctgatacaaagttctgtcaggagttctcattggtttccagaaataacattgattagtgataggctatacattattaagctatagggtgtggtttacagtgtccagtgaggcattattaggttaattcataactactcttggcaatagcaagcagtttcagtggatgaatacatagctcaaaaggggcatgtaggatgcgattgatgtctaattttaatgcctatctgggcctaataatttgaaaaggctcacatccctcagataaaagttattttctttcttcaacagctgtgggcactgttggagaagtataatggaaaacaaaatctcccaacccagaaatcctctctacaaaggtagcaaagaaagaaaacactctcattattgagaaaaacattaaaccagaaagtgttacacaccacaagcaatctgctaagagacagccaagacagaaaggaagctcacctgcttatggagccaagcagacacagctcgttccacacacgttttcaagacggacagtaactgttaccaactgagtcagcttttcccctaaagatggtatcgtgaagccaatacatgaaacccaaagcgagcctcaagcagtgcrgactttattcaatggccaaagaatggagaagcaggagcatggccgcaagtcaacttcttgtctagtgagaggtgagggggttaaaatatagggtatcytggctgggtaccctgcctcacgcctgaaatcccagcagtttgggaggccgaggtggayggatcacttgagatcaggagtttgaggctagcctggccaacatggcaaaaacccatctctactaaaaatataaaaaacaaaacaaaacaaaaaaatagccgggcatggtagctcacacctgtaatcccagcactgtgggaggctgaggcaggtggatcacctgaggtcaggagtttgagaacagcctggccaacaaggtgaaaccctgtctctactaaaaatacaaaaattagccgggcggatcacaaggtcaggagcctcctgagtagctgggactataggcgtgcaccaccacgcctggctaatcttttgtatttttagtagagatgggttttcaccgtgttagccaggatggtttcgatctcctgacctcgtgatccacctgcctcggcctcccaaagtgctgggattacaggcgtgagccaccgtgcccaggccgccttcctgtttcttaaagataagatagagaagacaggttagagaagagtagaaattcagctatgtcatgtaggcattacactgggtgacataagtagtaagagaacttgacaacactacttgtcacacacagctcattctaactttacctggcaactgaggtgaccatctgtattagctaatgggctttatctagagaaaaacaagcttcttacatctttgtgacaggaggcagttttgcagcttggaggcatgtgcccactgaaggcaggctstcaccctcccacagacactgggagctggggccactgtctctcccttgatgtttgcctttcaaggagatggctcccgggtccttgagaaacacatgcctgggtaatcaagctgacaaaagtcctmtctgatcttcacaaaaatgttatatacatttgaaagagaggagaaagtgcttataattacaagttttctaaggtaaatgctctgagaataagagagggagggaaayctcttcccccattttcaaccgggagaattaagcctcttgtttttaagttgcatttgtccttacagtggctactaggtgttgggaacactgcccgggagctaggaagagcaattagggctggaggctgtttggcgccaacaggctgttgctgagtgcggatgaaagtccagagagagagtggaaggtgggggtcaaagggcatggtggtgccctgcatggcagatggtggagaaactgcaccaggcaggtgcctcaggctttctgggtcaggggagagggtcaggtggccyttgaagttctgtttgctgttagcctgactgagttaactgcatgggtacctgactgtctttgctcagtctcctagtggacaaccacatttccggaaggcttttcacgagtgatatagcaactaatgctctcccagggctcactgcctggcaggctctgctccaaatgctttcatatgttaactaattcaatcctcactatgaggattctctactcccatgagacagggattgcagggagtataaggttgtgttggatgtgtttcctggcattagtaaaagaggatgtgaggcaagagcaaaactaatgcatgtgctgaaagagctatggtgcaaagagtacacacaaaccttttctccccttctctgtatgctgctgtggacactgttacaaagcatgaaaatgaggccgtagatgcaaaagcttaaaagggtgacccatacctcaaaagttctcagtaagtggcagcattttattatcgtggctatyattttgccagttatatcttaacaggtataaatattgaaacctccttagcgaaaattataacggtgagcaaattatgacagcggaggagatctgacctaaccatctccttcttgccttttaayctctaaactgtcctgggtcattttggggcatgggtcaagctaactttaggagaaatttagtttatagtttaaatgatgatagaccttcccaaaactaagtcatctttgtaaaactaatgaaaggccaccaggtcaaaagaatgagaggggcctgaattctgctgagatgtagacatagttaagcaatcaccagccgttattctggaggtcatgaaatttgcaactttctcaattactcctataattaacatcactmctctagaccctaaaattggccttttcagattccttttcagacttttgtatttctgaaaccaggtgactttacctggacccacgacccctacctgtggtccctgacctagaagcaggctcagcatatgaggaccattttttccacacccctatgattgcatctccaaccaatcagcagcatctgttctctagccacctgcctaccaaactatcttttaaaaacccctgccttcatatttttgaggaggctgatctgagtaataataaaactctggtgtcctgttcaggtggctctatgtgtataaaactctttctctattgcaactcccctgtcttgataaatcagctctatctgggcagtggggaagatgagctaattgggtggttacaatattacctcttcaatgtgactgaggttcttgaaggcaggaaattgtcatataatttatgtctcccatgtcagtaccttatatagggtaggtatcaataattactcataaaagatgagaattattggttccctagaagtcattttcccattcyaggcatggtgccttttaggggacakarctctgactgaactttatatgtcctccttagttagttacttagggtcttgatttcttctggaggctgtatttstcatttaaattttgctagatattatgcatattacttaagttttcacacttaatggcataaatctgtccctagtattccctctcaattttctaatctcctctgtaactgcagtctatttatatgtcctcagtaaatatttgttgagtctgatagtttttggttaygatcatggactagtgcagtgagggcagttggatattttcctcctgggaggacatctgggattcacaatctggatgtttggtatcatgagacaatctccctgccctggcttggggggccacccatgggttaaggcataagtaacaattcctgacaagagtggrgtcattaatgtctggagcaggaagctgaggggagttgtgtttttctcttgcctcaacattgtaggaggagagagaatcctttctaggcatcagggtcatccctgagcactcctggtgtgattttagggttctccaaggcccactgtggttctaatttcctgccaccatccctgaacatcccaccattcatatcctcagtgtagaaaacagagatggtaactttgactccagaaggtcaccattcacatgaccacttaggagaaaaggagaagggagaacttccagtattttatccaaattctttattcgtcactcagctagcccagacgtcttcttaggaagcattggragatatgagagagtggtgtggggtgggaagcaaatggttggggagacatagcatctggcttttttgggaagccctgctgggtttagacaaatctgcagacaggaggaagaatgagatgaatggcacttaagtgttattcctctccagatcatgattctcccagtttgaattaagactcktctctgagttttggaggagagatgcttggaaaggatgattgaagagattcattcacccattagactccctactattgattaaggatgtaatgaagtgatataagtcatccaataagctatgcttactatgtttttttttaaacatagtaaatgcaagccaaatagagccctctcccaccttagccagtagagtgacatcttaggatcttaggtgaagtcttttttttttggttcttttagtttttaaatttggaggattaggatgacaaaaatgacacctatgggtgaaggggtatggaaggactggaatgacattcagacttttttttcagtaggtttgctggtttaaaaactgtatctgaggacaaaatgcttggattcaaatcttggctccctaactaactgagatctgtcttctctgttctttgtcatcttcatcaataaaatgggggaaaataacactgtctatgtcttagggagaataagatggaacattgcatataaagtgtctaacacaagtcctggcacatagtcatcaataacttgtttattattgtgcttgttaaattccattcacctggaagatccagggatccattcaaagttggctctggctgccgtgatgccaagtgaagtcattccaattttgcagtctaaatagcacacactgccttgtccctaagagaaataccagccccagacattgtgaattgatcatttccactgaaccatttataaggcagagttgatccttatcattaaggtgagcaaagcagttgttgtgggcacttctcttcatgatgatgttcagtcatttaggtctctgtggaatggctggcaggaggccctaatggtgacagaaatcccagtgactactgtcctactggctctggttgggagcctttcctagcagtcctaccatgactggcctcttggatccactctgaattcttctacttctctttgcagtagaaagrcattaactgatatttctctttccaaatttctttgcaatgttttctgtagaagaactgaacattaaataaatattatttctagaactcagttttcgcaaaagatagcatttcagtcccacaagagcaatatttatatcattgcaactatggggcttcggtgggaaaaggatgacaatatttttccatttggatagctgtttcttatctaaacttattaaatggtgagcagaactcttcattgtagacttttcccaaccctgagtgccaaagcaaacacacaaagttcggaccactgacatgttgctgcagtagtataagggcaaataagtctgaatggagataacagacttggaaacggtactttgtgtctctactttcatggtccttccctctactgacatggaaatagcaccctaggcctgcccggggccatccctgaactagggatgcatcccccgtcaaaacaaactgaggacattggataattcacattttacataacagtattttactcagatttatgtggctgctgatgaattttcatcaaaaaagtattttctggaataaaatccattaaaccaatttaatcccttaatcaatttttatgtagtgtagttaaatcatttttatttttctaaaagttaatgaaacattttctatttttatttctgaaaagtaattttcatcaggatagattcttttccatttaaagcttataataaagagctaattaatcaattgatttttgtccccatcagattttcctgagtatagcttctgctactgtgagttttcttttatggccagatccaaagtttccttttgttttatttttcccctgctgtagtcaagtccaatgtctcaggctcaaattctgcacatctaaattttgccagcaatattctgtttgtttgtttgtttgtgacaatgtcttactctgttacccggactgaagtatagtggcatgatcatggctcactgcagctttgacctcctgggctcaggtgatcttcccaccccagcctcctgaggaagctgggactacaggcacgtgccaccaaacctagataattctttgtattttttgtatagatggggttttgccatgttgctgaagctggtctcaaactcctgggctcaagtgtttcacscacctcagcctcccaaagtgctggtattacaggtgtgagccactgtgcctagccagcaatattctttttaatcagttttygattggtgaaaaagtgactatttctacctataatattcattatggattggataaaacatattgtctaattattttggtgtcattatattcagaattcccagtatagtcatcccttcatacaggaatggaataataaaattatacattaaataagtgttgtaaatacagtagatgtttctaaagctaatttttaaatgaaaggacaatatataagtctakagctaactcctctgtcatgcacaatctgagttaacagaatagwttaggggttagcaagctttttctataaagggccatgtaataaatatttcaggctttgcagttcatatgttctctgttgcaacaactcaactgtgctgttgtagcacaaaagcatcctggactattcataaactaatgagcatggctgtgttgcaataaaacttgtttacacaaacagatggtggtccagyccagatttggcccatgggctgtagtttgccaatccttggaacagataaaygttcatgctattatttgtttagtaagagtattctttagttgccaggttgaccatgaactaccataaatagagagctcctggaatgtacattggaaaagtttttctttttgtccagtttttcaggatcacagctgttatacaaagctctgtgtaccaacaatgcatatatcaccaggctcatatacarttttcttagaggagctcaataccctgtggacttaaattaagaaccataaaactgcttgagagtggacaaagagaagataaccatttttcctatcttactgaaaatagaagcagaacaatcactcggactcacatcataggactaattatggatggagcatattagatgataaaataaaaactaacaggaaaggaaagcatgacactagctttggtattcagtcatggcttagagttactagcctcatctgggtatagcagacaagctctggccttaggaaaatattatactctacactttgatgactcccctaaaaacaaaacaactaaaacaattgtaaaaagcaaagcctattacaaagagggagccaaaattcaacatgaaatatactgtgcttaatagaattgaattcttgaataatgttcttctggcctccaagtgagaataaaggttgtgctatttaagaatgtttttcagctgcacataactgcctgtattagtccattttcacactgctctaaataaatacctgagacttggtaatttataagggaaagaggtttaattggctcacagttctgcatggctggggaggcctcaggaaacttacaatgatggtggaaggggaaggaggcaccatctttgtaaggctggagaagagagaaaagtgtgtgtgaaggaggaactgtcaagcacttataaagccatcagatctcatgcaaactcactctcatgagaatagcataggggaaatcgtccccatgatccagtcacctccctctcttgacacatggggattacaggtgcctcccttgacaggtkgggattacaattcgagatgaaatttgggtggggacacagagctaaaccgtatcattctccaccggcccttcccaaatctcatgcyttttcagatttcaaaaccaatcatgccttcccaacagtcccccagaggcttaattcattccagcattaacccaaaagtccaagtccaaagtctcatctgagacaaggcaagacccttctgcctaggagcctgtaaaatcaaaagcaagttagttacttccaagatacagtgggggtacaggcagttggataaattggccaaaacagaagggctacaggccccatgcaagtccaaaattcagtggagcagtcattcaatcttaaagctccaaaatgattgcctttgactccatgtctcacatccaggtcatgctgatgcaagcagcaaggtcccatggccttgggcagctccacccctgtggttttgcagggcacagcccccttcctggctgctttcacaggctggcattgagtgtctgtggcttttccaggtgcatggtgcaagccaggtggatctaccattctggggtctggaggatggtggccgtcttctcacagttccactaggcagtgccccaatggcaactctgtgtgagggctgcaaccccacatttcccttccacattgccctagcagaagttcttcatgggatctccacccctgcagtagacttctgcctggacatccaggcatttccatacatactctgaaatctaggttcccaaacctcaattcttgtctcctgtgcacccacaggcccaacaccatgtggaagctgccaaggcttggggcttgcaccctctgaagcaatggcctgagctgtaccttggccccttttagccatggcttaagctggaggggttggaacgtaggacaccaagtccagaggctgcacagagcaggcgggccctaggcctgcccacaaaaccatttttccctgttaggcctccaggcctgtgatgggagggactgtggtgaaggtctctgacatgccctggagccattttcctcattgtcttggtgattaacatttggcttctcattacttatgcaaatttgtgcagctggcttgaatttctcccaagaaaatggttcttttattttctaccccatcatcaggatgcaaatattcaaaactttyatgctttgcttcctttttaaacataagttcctatttcagatcatttctctcaagttcaaagttccccagatcctaaaggcaggggtaaaatgctgccagtytctttgctaaagcatagcaagagtgacatttgctccagttcccaataagttccttatttccatctgagaccacttcagactgaacttcattgtcaacatctctatcaacattttggtcaaaaccattcaacaagtctctaggaagttctaaactttcccacatcttcctgtcttctgagccctccaaactgttccaacctctgcctgctacccagttcaaaagttacttccacattttttgatatctttacagcagtgtcccactctctgcagtactaatttacttgcctaaaaatgctgcaaatagtactcacacaatagtgcagagataggcaatcatttgtactagtttaaataactctatatgccaagcaaaaacccaggtgttttctatcattctttgcttgctggcttttggtccttacacttgttgcctcatggttgcaaaatggctgttttgtctccagacattacatcaacatttgaagraggaagmagggttagtgtctgagccactgactctgctgataaaaggacagagaaagctctcccaaaagccctcaacagatttctgtttgtctcattggtcagaactatcttacttgaccactaatggttacagaggagagcagtgatgcaggatttttctyggyccctttgccagtcagggacctcttgctggtgatgctggaggccttgcttggggcacactacctgtccctggaggtgcctcacccaatcggcccccctgggccaggtctggcttgtataccagttcctgagttcttgtcccacgcccagaatgaatgaggctgtgctgaactctgaagggtgagggtgatggagaagaatttttttgaccaatgaaacagctttcagtggggaggggatgcaggggtggtctccctaccagaaggtgggaaagtcccccatgtggctgggtctggggctttttatggactcagaatggggagtatgtgttgattggtttatgagtatgcaaaaaaggttaaagcaaagactctactcaaaggtgggcatgacagtgtagaaaatcagttaggaaaggacaggtatatgtaaaataggtgaagggtggggatcaatcagaggaaagcacaccaaacaggaagacaagttctcaatctggtccaaggatttaagttgtagcttggctttcaggctttaaactgtcttcagcttggaggcgggatttcaccggggacccgccccatctgcctaggcatttggctgcctcctcctgcccttagtaggaaagtgagtgtttcattttctcaatttatctgtggatgtggacaaaggggaaaggggtagggaatagggggttgtagtcagcctccaacagrttattaccactgaaattgtgccctaaaggattaaagaagtcagtaactaacagaaattcttgagtttgcaaggtaagaaacaacttgctcaaatgctgaaactccctctgcttgtgagataaaactagcagaaatcagttggaaccaccatggccaactggagtttgcacacagtgagcttggtgaagtcacggcccgaatttctaccacgtgtttcatattaaccccttgaaattttctcatgggacccctgaggcaacatgaagagataactgtgcaaacctgaggattttctaggcctcccctttcctttcactaatcacctacaatcccaatatccaccccctaaaccttttctaataaaattatgccctgccttaaagccatctcagggagacaggtttgagcttgacccctgttgcaatagaaagcttttcttttgtcaaaaacccagagtcatagcactggcttctagtgcatcaggcagcaatcactttttgcttgataacaccatttttcataagtacctgaaactggattcactaattatgtcagctaatgttgacattgatagaggtaaacgactcatttcttatttataaatctgcaactgttgacaagaaaagccattggcttggttataacttttgaaatgtgctgcaattagccaggtgtggtggctcatgcctgtaattccggcactttgggaggccgaggcaggcggatcacgaggtcaggagatcgagaccaccctggctaacacggtgaaaccccgtctctactaaaaatacaaaaaattagctgggcatggtggcgggcacctgtagtcccagctcctagggaggctgagacaggagaatggcgtgaacccaggaggcggagcttgcagtgagccgagatcccgccactgcactccagcctgggcgacagagcgagactccgtctcaaaaaaaaaaaaaaaaaaacataatgataataataataataaaaaatagaaagaaatgtgctgcaatcacaaaatttcccagaactttatcttatatgaccgttttcctccagctcatggacagctatgtctgaatcaacagcagtccatagggcactgcccgaggtatcaggtgatgtctaaaaggattcaataggaggagcaggcatctgggaatataccaaaggaaataaagtcaacacctagtaacaatatctgcactcccaagttcaatgcagcattattcacaatagccaggatatggaaacgacttctgtctgtcaacagatgaatagataaagatttggcatactgtatacacacaatgggatactattcagccttcaaaaaagcataaaggccaggcatggtggctcatgtcttaatcccagcactccgggaggctgaggtgggcagatcacttgagctcaggagtttgagaccagcctgggcaccatggtgaaaccctgtctctacaaaaaagtacaaaaaagttggccaggtgtcatggcatgcatctgtagtcccaactaccagggaggcagaggtgggtggatcacttaagccagggaggtcaagactgcagtgagccatgattgtgccactgcactccagcctgggtgacaaagtgagaccctgtctcacaaaaaaaaaaaaaaaaaaagcggtgtggaactgtgccgcttgctacaacatggatgactggaagacattatgctaaatgaaacaaggcagatacagaaaggaaaatactgcatgacctcatttatatgtggaatcttttttttttttaaagtgaatatacagagatagagaatacaacagtggttaccaggagttgaggaggagagcagggaggagatgtaggtcaaatgatacaaagcagcagatatatacgatgaacaagtctagagatccagcgtacaacatgaggactatacttaaaaatgtcacattgcacttgggatttttgctaaaagagtagactttaygtgtccttgccacctaaatgagtaactgtgagatgatggatatgttaattttcttgactaccataatcattttactatcttcatatcaaaatatcatgctgtacaccttatataaatacaataaaaattattattaaaaaagaaagaacaggctgagaatggtggcttatgcctgtaatcccaacactttgggaagttgaggtaggaggatcacttgagaccagtagttcaagatmagcctgggcaacatagcaagaccctatctctacaaaaaataaaaataaaaaaattagccagatatggtagcatgcacctgtagtcctagttactctggagactgaggcaggaggattctttgagacatgatcatgccactgcactccagtttggaggacagagcaagaccccaactctaaaacaacacacaaaaatacagccatttctcctgggtgaaatgggggagctcagactattttgttttatttgtcaggagtctaaagcccatgtgagccaacttaagaaaattctgtttgtatttgagtgttctttattggaaagaaatggacttttccctaatgagcccattttacaaatcgagagctccaaatgcccggttccagcccccatgatatagatgggcagcaatgaggaccagaaatgctgggaagtgtccttgtcatgcaaggaaaacttggaacttcaaggatccatcatgggatgcaggacagtaggctccacccctcttcctgctttccagtaaatgatgttcagggctcacatgyctcttccaaggcatgatgtggggttgcagttctgatcccagcagagaacaaggctcctgtgaaacaattagttttggctcagaggcaaaaaatggaaaccccattcctgtatttacccttcattctttccttacctcatacagctggttccaggtttgattgcatcatatacataaataaataatctgctttcctggtttggtttagttttgctggagagaggagtttatgtgttcatcccatgactagctgggtggtcaagagattggaaagtaggagttctagtttagaccaagtctcatctcagaaaccacagagtagaactgatcccaaacgtcatcatccctgtagggaaaagaaagagagatcagactgttactgtgtctatatagaaagggaagacataagagactccattttgaaaaagagctatactttaaacaattgctttgctgagatgttgttaatttgtagctttgccccagccactttgacccaacctggagctcacaaaaacatgtgttgtataaaatcaaggtttaagggatctagggctgtgtcaaagtggctggggcaaagctacaaattaacaacatctcagcaaagcaattgtttaaagtacagctctttttcaaaatggagtctcttatgtcttccctttctatatagacacagtaacagtctgatctctcttttttttccctacatatcccaatagcacctgcctgactaatacatcatgctctgctgactccatatgtggctggtttcctggatccgattctgactgatggtatctgttctcacrctgctaataaagacataycagagactgggtaatttataaagaaaaagaggtttaatggacttatgtgttccacgtggctggggaggcctcacaatcatggtggaaggtgaaggaggagcaaaagcacatcttacatggtggctggcaaaagagagaaagcatgttcaggggaactcccctttataaaaccatcagatctcatgagacttatgcactatcacaagaacagcaycagaaagatccaccctcatgattcaattacctcccactgggtccctcccatgacacatgggaattatgggagctacaattggagatttgggtggggacacagccaaaccatatcagatggcttatttggtttctatgtagaacctctgcttttcattcaacagtcttcatttagccacagataagctctgtccctaacttccrctgatggaatgtacacataagaaacttccactgatggaatgaacacagaaggtgcctactgggaagaaaactggcctgaatctgagctgggtcaaatgtctgcagtcagtttgaatggctgctccttatgggaataatttacattctcaataaaattctctagcaattttctgattgattttaatgagctttaaagccttmcgtagaagatcccccagctgatagtcagccttgggcatggattaagggcttttaaccaatcttgcaacaagtttaagcagatattctttattgggtccaatctaaccaaaattattttcttatgttctccccagtaacgtgtcattattaagagaagtttggcttgcttagaggccaaatttagagggtcctgaaattttattttcttttacaccactttccagcatgttacctgatcagttgtttattatctttgctgttgaatggagtgatcattccaagggccygaggcaggaggcccaggcacagtggaaactctcccaaagaccaggatctttgttttgttccctgacatatgctgagcaccaggaatagtgartgaatgaaacaaattgtgaggctttaaagagccgaaatatttaaacactgggcacaaggttgttgcttaatcagtgctagatccttacctcccccttgtgtccaggtsgacttgttactgcagttaaaccacttgctgatcctcaaacaactagttagtggcacagccaggcctaggaccccagtctctactgttccaactaacccattcgcaggcaggagcactttgaatggtctcttattttaaaaaaattaaattaaaattgtctatttatttagagacagagtcttactctgtagcccaggctcgagtgcagtggtgcaatcatagctcactgtaacctccatctcctggcctcaaaaagtgtttgaattacagatgcgaggcactgtacctggcccgaatgttctgttcagacaaagccacctctaagtcgctgtggggccccagacaagtgatttttgaggagtccctatctataggaacaaagtaattaaaaaaatgtatttcagaatttacaggcccatgtgagatatgatttttttaaatgaagatttagagtaatgggtaaaaaagaggtatttgtgtgtttgttkattgttcagtcagtgaatgtacagcttctgcctcatatccaggcaccatctcttcctgctctttgttgttaaatgttccattcctgggtaatttcatgtctgccatcgtggatatgccgtggctccttgaacctgcttgtgttgaagcaggatcttccttcctgtcccttcagtgccctaataccatgtatttaaggctggacacatcaccactcccaacctgcctcacccactgcgtcacttgtgatcactggcttctggcgactctcaccaaggtctctrtcatgccctgttataaygactacaaaagcaagtcttacctataggaaaataagaattataacccttttactggtcatgtgaaacttaccatttgcaatttgtacagcataaacacagaacagcacatctttcaatgcctgcatcctgaaggcattttgtttgtgtctttcaatctggctgtgctattsttggtgtttaacagtctccccagctacactggaaacttccagaaggcacttttcacttgcttgtgtgttttycccagtgtctattagaggcctttgcacagggtaggctctttggagcagctgaaggtcacacatcccatgagcgggcagcagggtcagaagtggcccccgtgttgcctaagcaagactctcccctgccctctgccctctgcacctccrgcctgcatgtccctgtggcctcttgggggtacatctcccggggctgggtcagaaggcctgggtggttggcctcaggctgtcacacacctagggagatgctcccgtttctgggaaccttggccccractcctgcaaacttcggtaaatgtgtaactcgaccctgcaccrgctcactctgttcagcagtgaaactctgcatcgatcactaagacttcctggaagaggtcccagcgtgagtgtcgcttctggcatctgtccttctggccagcctgtggtctggccaagtgatgtaaccctcctctccagcctgtgcacaggcagcctgggaacagctccatccccacccctcagctataaatagggcmtygtgacccggccrggggaagaagctgcygttgttctgggtactacagcagaaggtaagccgggggccccctcagctccttctcggycttgtctctctcagatgtaactgagctgtgggctaggaggaaaaggccgggaggaggcacggtgatgactgaaaaacctctcccctctcataagaccagtcatcyggacgcgggctttcccccactcggtgcccacctggggtcttacaggaggagctgctcctcctcagcaataggacaagatggtcaggtcttcctgcttccgctgagaaaagttagggtcctcaggaacggagcagactggtacaggaacagagtcatcatggccaagagtccaccgggtcctcttgccatcaggaggaatagcagggcttgtrcaggaattggggctggagggaaggrccgggctcggtcagtctccagctgggatccccagagtggtcaccctacccctccctcgagacagactgcctgactgtgtgtcatcaggctggtcaccrtctccctgaacctcgatttgctcacctataaaatggaactaataacgatgcctgggctccctgtctcaggggctctggtatagctgaagagaactaatataacatgaaagtgctttctaagctttgggataagctaaaaggcagattccaattttattcgagggcagcgtagattggtgcttcagctcgtggatgacagagtcagggggcctggttctgagtcctagttctgtctcttcccagctgtgtgacgttgaacaagycactggacctctctgttcctctgcaaaacagcatgaaccaattcattaactacttctccaggatgcagtaggtcccagggactatcctaggaatgtgggctgtattagtaaacacaacagcgggaaccctgttccggggctcacattcacatcagagcaaacagacaaagacgctggacagaataagtgcataactacatggtacagagggttataaggagggaaaaggggagctggatgagagagttgagagtgcccggtgtgrtggggaaagctgcagggtgaaatactgcatcagggaaacctcagggaaggtgaggactatggtgaggtcagaggggttgatatgagaacagtgccctgcaaatggcaggcaccacaggagcatgagccrtcatcttcacctttagcattcagcccgggagaagtagggagacatagaaggggcaggtgctggccaagaggcaggggcaggagaggagaaggcggaggggcactcagggcgagggtgtcaggcccrccaccccagagcaccattactcccaggacgcggctgcgtgcagacctggaaccagcctagggagcagccgcagatcacaactgagaacaaacgacagtctctgcctcaaaaatggcccatggaattgcgtctctggagacgctgcctgagcaggagcagcacagtgagcgggctgcatcgaccagcgccatccaaaccccgaacagttggcgcttgtcaggcaggacttcccagcagtcggttcccacaggtttcccctgttgacctgatttgatgtgactgtctagattaggtgtgaactggtggcttaggcttctctgcacagaaaggcctgcaagcagcagagagagttttctgttccatttttccatgtcatgtggctcttcctgagaacagcggatggagtcaaatgcatggggagtggggtgagatggtagctgaggtcagaatttggcatttgaatgactgaagcagaacaaaacacaccaggtacttcagcagctgcaccgtgttgagggcaggtgctggttacgggtctgggtgagggaagccagctgccaatgtaagaagaatgactgggtatgcttagatgaagcagaaaaatctaggcatcaaggtggccttgagtcagtgatgacacgctacagctccaaggaagcctggcctagccctggggggacagaaaaggccaagaagtgacgatattgcagtacacccccctccacaagaaatgagtgagatgtggtacaaaatgttagaattgaatgaatcaatagaataaacgttcatcccttcaatcaagaagagtcagatgaaatgaattagcagggccagcccaagaacctcttctgggggtctcagggtagctttcatttgtagcagctgaggckgaagcccagctgcaaggcctttgagagaacgtggtgctggacccgtgtctagggcaggggttctaaaccctgcttacatatcagagtcacctgagaattttctatttttttttttttttttttatacgtggtcccagcacagactaaggaatccaactatcattgggcaagccatgctaggtatgcatgcctttrgggctctgcaggggatagcgctatgcagggatggttgagagctggttttggggttgagacacgtgggaaatacttggactttgggctgagcctgtggtgctcaatcccggctgcatgttgggaccacagggagatgacaaaaccatccccagccctcaccctagggccctcgaatgagcatctcaggggtctaggaggcctccacaaagacctactgattggcacacacttgtttctctaggaagagaacttacagctgcaggcaggagcatgtcttaatctgcttgggctgccataagtaccacagactgggagggtttaacaacagaaatgtgttatctcacagttctggaagctagaagcctgggagccagccatcagcagagttggtttcctctgggtcctctatccttggcttgtagatggccgtcttctctctgtgtccccacatggtcttccctctgtgtccccacatggtcttccctctgtgtgtgtccatgtcctcatctcctcttctcataaggacacaggtcatattagatcagggctcaccctcatggcctcattttaacttaatcatctctttaaagatcctgtctccaaataatggtcacattctgaggtcctggggttgaggacttcaacacgggcattatggccgttgggggaggtaggacataattcagctgatattggtgcattttgcacttggatcatgtagatattttccatggagctttgaatccatttcttcttttttttgtagacatgaatggatttattctgggctaaatggtgacagggaatattgagacaatgaaagatctggttagatggcacttaaaggtcagttaataaccacctttcaccctttgcaaaatgatatttcagggtatgcrgaagcsagcaccccagtctgagatggctcctgccggtgtgagcctgagggccaccatcctctgcctcctggcctgggctggcctggctgcaggtgaccgggtgtacatacaccccttccacytcgtcatccacaatgagagtaccygtgagyagctggcaaaggccaatgccgggaagcccaaagaccccaccttcatacctgctccaattcaggccaagacatcccctgtggatgaaaaggccctacaggaccagctggtgctagtcgctgcaaaacttgacacygaagacaagttgagggccgcaatggtcgggatgctggcyaacttcttgkgcttccgtatatatggcatgcacagtgagctatggggcgtggtccatggggccaccgtcctctccccaayggctgtctttggcaccctggcctctctctatctgggagccttggaccacacagctgacaggctacaggcaatcctgggtgttccttggaaggacaagaactgcacctcccggctggatgcgcacaaggtcctgtctgccctgcaggctgtacagggcctgctagtggcccagggcagggctgatagccaggcccagctgctgctgtccayggtggtgggcgtgttcacagccccaggcctgcacctgaagcagccgtttgtgcagggcctggctctctatacccctgtggtcctcccacgctctctggacttcayagaackggatgttgctgctgagaagattgacaggttcatgcaggctgtgacaggatggaagactggctgctccctgaygggagccagtgtggacagcaccctggctttcaacacctrcgtccacttccaaggtaaggcaaacctctctgctggctctggccctaggacttagtatccaatgtgtagctgagatcagccagtcaggccttggagatgggcagggggcagccctgcggacatacctggtgaccacccttgagaagtggggaagtggctgctccgctgggtccctggatgggccgtccacctcctggacctgctgccctactatgtgcacgactatacaacatcctttttcttacatcatttaatccccttatgatgtggtgaagaggtatttgtgcctttgtttaccagtgaagaaatagagactcggagaaacaaagtgccttgctcaagatggcacagccaccagtgggggtcctgggattgaaacccacatctcctggccccacagcccagttctacactcagaagggtcaggttcatatctcttgagaaggtcaggaactggggtccctggcccatgcagaaataagcaattggcttgcttaaatccctttcatgttaggaggggcattactgaaaaccctctactacaaagattgttgatttttttttttttttttattgagacagggtcttgttctgtcacccaggctgcagtgtagtggtgccatcattgctcactgtagccttgaactcctggcctcaagcgatcctcccacctctgccttccaaagtgttgggattaaaggtgtgagccactgcacccagccacagattgcttaaagcattcatttaacaaatacttgttgargatttgctacttgtaagactttaagcctggcatctcagaggaggccagaggagggctgtataggccctgcctccaggcttttaaaggtcaatgggcaaatgcctaggatttggagctgcagggaaacgtgctccacaaggtaactcagggaagcctcggggctctcagaggacagaggtcactggggagcggagagcaggccttgcctggcagtgagggmaacagggctggtgaagctaggagcaagcatgatgagcccagcctgcagagtttggggcaaggaacgaggatggggcggttggcttggcatgagtgttgaaccagaaaatgggcctggggagggcagagctggagacactttgaacgccatgcttggtaggtgtgggaatggggacgcgttctgttcagaggtcatcccggaagcctgccgtgtgcagactggaggcagggaggattgtttgaaggttacgcaagagtccaggcacacagtcacgggaacacgtgctcagggagcagctcggcaaatccatgggtggggtggggctgaggggtgtgtctaagagacactgaggaggctctgtcaagatgttaacctcgtgagggacagagagycaggcgggaggtgaaagacaagactgtggagaaagaggttcagtggcgcatagtgatttttcttaccacracaacctccttgaggtctttcccttcgggttcagggrgaggtgatagatggggggattgctcagccctggcactgactggtcacaggggcagaggccagcccgagggttgcccsgttgagggtggcagcacactgtgcagggcagagcagggacacatggacttagcctgctgtccctaggagaagtgytgggaggagcgctcactgagaaggagggtcctgcagaaggcaaaggcaagaaagccagtggcatctgaaatgggtctcccttcgaaagagagcacatccacctgacccagaccgcagagccaggccaggaggmagaggaggaagaataaaaaagccaaccacatcgggactcaaaggaagcccaggatcctcgccggcctccaccgcatgctgccctgaccctgccccacttcctaactttgctggcctcagtttccgtcaaaggaggcagccacttcctgcccacatggtctgtccagtgaggagatcgggggctgtctmgggacctctaggtttccctttagcaatgatgttctatttacatgacctcagcaggcagctagatgtgtcccactagagaggacctraggatctggggcctgatgggctccagggtaccgtctgcccagtgcttgctgtgctcctgagcatggggcgctggccctggyggtttccatgacaccaggtcctgacttgacctcgacagatttacctagcctccggatgagaatggtgagctgtgcrtgtcagacgagcagagggaagacggcagccactctcatgtcaaatcccagcrtcttttgggaggcagcttcccttttttagtttagtttgttggaagaaaagaattgtccytttccccsctctaaactawaarccttgccagcccaggtgggcagcaccgaggtccctgcagggaacgtgcaaggggaaccctgcagtttcccgctcacatgcccttccgagactgagtgctccgaggactgaggacgagaaatatgccaggtctgccactgccttcttacgagacccggacccaggggaggcacagccatgcccagctcctgcctgccagttctgtcctcccagctgccctactttcatgctgggacctccaattcagtacaaagggagacctcactgtttctgaaccatctctactcagactcccaagtgccacgtgcccaggggactgttctgtgacaaacttatacacaacttcaccctattctcctaagaacaaccgcagaataggcctttcaggatgagtgggaggacagccgagggcagggatgtgctagtgtaaggtcgaggcagagggtgggctgctgtcatggaaagaccccaggtaactgcgtcacacacaaatttgtgtccttctcccacaacgggctctcccgagttctctgtcatctgcacggccctgtgagcaggaggggaaacagagggctcacccctgyccccaaggcccagtgtgcaaatccattcatcacaacgaggttgtgtgagtctccccagtagcaagggctgctgaggaatggagccctcgtttccggggcctgcgtggcccactctgtattctatgactgtgatgggggagggtgggggccacaggacagctggtgggctctgccatggctggggctagacatggattaaaaagtgagtatgagcaggggcctctaggagtggtgggatagtgcggtggtggccacatgtcattctacgtgcgtccaaacctacagaatgtaaaacaccaggagggagactcaaagaaaactatcaactttgagtgctgaggacgtgtcagtgtaggttcgtcagttgcaacaaatgggccacgctggtgtgagatgttgatcacgggggaggctgtgtagtgggggacaagagttatatgggaactttctgtactttctgctcgattttgctgtgaacctaaagtcactctaaaaaataacatctcttaaattttttaaaaagtgagtgtgtcaaaccacagcctttgggtcaggacagttctaggtttgagttgacctggcaggtaccagtggcttatgtcccttaaggtgacagatgcaaaacccccggtttggtgcctggcatgttgtgtgtcttgcaggtggcggttagggctgcctcagtgaactcaaatggctgcattttacaggagaaatatttgagccacacttgcggtcctgtggccaggagaatgcagagtggcctggggggggccaaggaaggaggctgaggcagggcgaggggcaggatctgggcctttggtgtctgccagccctcattcctgcccctgtcttgggtgactcttccctccctgtctcctgtctggatttcagggaagatgaagggcttctccctgctggccgagccccaggagttctgggtggacaacagcacctcagtgtctgttcccatgctctctggcatgggcaccttccagcactggagtgacatccaggacaacttctcggtgactcaagtgcccttcactgagagcgcctgcctgctgctgatccagcctcactatgcctctgacctggacaaggtggagggtctcactttccagcaaaactccctcaactggatgaagaaactrtctccccggtaggagcctcccggtctcccctggaatgtgggagccacactgtcctgcccaggctgggggcggggtggggagtagacacacctgagctgagccttgggtgcagagcagggcagggccgyggtggcacggggctgggcaggcggcctgtgtgtctgtctaccagtcctcyatccagccagcacccagctctccagttagtgtctgtctttcaagtgcaggcaaggtaaaggaggagaggaagaatgctttttctacacttacacttgcctggtagttttggagggggagaaaacattgcaatccgccctctgagagaggaccattttggtcccacacctgacacacagcacacctgtgacatccaagagcttcttggaactgacttgccaggagggttcggacttcgcgtgagcgggggtggggccttctcagggagcgtcccttgactccagaacgcccttgctggcggctggcggctgggtggggataggtgttgttagctcctctttcctgctgcaattcctttccacagagccctggactcaaactacacatcaccccagatcatcgaggcctggaaatctgctcccagaggcaggcattgagtgacacgatggcttgacatcaactctgggtgttttttatgttttaaaaattgtgatggtaaaatatacrtaacaaaatttgccatcgtaaccattttcgagtgcacagttcagtggtactaggcccattyacactgttgtgcagccatcacccccgtccatctccatttatcttctcaacttcccaaactgaagctctgtcctgctgaaacactaactctccatttccccttccccttggccccggcaaccaccacgatgtcctcgaggttcacccatgttgtagcacatgtcagaatgtccttccttttgaaggctgaataatattccattgcatgtggttaccaccttttgtgtatccactcatccatcgatggacacgtgggttgcttccacctttgagctgctgtgaatagtgcagtgtaccctgtaaacatgggtgtactgtcagctcttataagtgcttgatacatcactggaaatgtccatgggctctgaaggatgccaaaagatggaagaggctctatacgaagatcaatcgagttgacatagcaacgtgtccagcacgaggttgacactgtaccctcctgcctctctccttttcatgggtgtcatgtcatcaagaacactgctgtggcagtagtaagacacagtgcattatttcagagaatagcatttaaaaattacccaagtaacacaccttcaatgcagccaacctaaaaacagaatgcaccaaaggacaaccattcctaggtcctcatcggtaaatcttctatgtccctcacatagtattgcaaatgacatgaaggatttttattgtaggttttgctgaaattttccccaagggggaggatgacttagttgggtgatgggggkagcaaacatccctgtcgtcagggttgggtgcaaggagcataagcctgcctggcctctgggagagccctcactgtgtggcctggagccttcctaactgtgcrtcatctccccaggaccatccacctgaccatgccccaactggygctgcaaggatcttatgacmtgcaggacctgctcgcccaggctgagctgcccgccattctgcacaccgagctgaacctgcaaaaattgagcaatgaccgcatcagggtgggggaggtatgtgtgagcctgtgtctgtgcctgacctgggttccaagtgtgcacagggtgggaggcatggatgtaagggacacagaggaggctatgggtggggccagcagggcaagagggagcggagagtagggccaaaggtgggagagaagtagccagagcattctggggccttccaggtgcagagcagcaaatccctccccatccctgctgtgcctcctcctgctaggtgtgtgttccatggtcctgcttggccttgccttgcctcagggtcctccagggttcctatagtggagttgaaaccgggatgaagacagcaagcacccctggacctggtgccctgggcccagccccttcttcagggaaatgctgagcagcagacagaatgtccccctgccatgtggcaccatgcacatctgcagctaccaaggatgtgccttgatgttctgggccctgtgctcagtgctggggagaaagtgggagttcttacgggggccagcgggaagagccctctgtgctaagttagctaagccctggcactggtgggccatggccaagggagccaggaattctgcctgggacatcagggcagaatgtgaagatgggaggatgtaaggggtgtgttagggaggagccggcatgtgagtttggccattgtggccaattaacggtcatctacacacagacacacccttgcctacactgaggggcaggcatacactgtgcatcctcctggcaggctggaaaatgtccccctccaggacagtgcacagcacagaggtcctgagcccaccccggccctctagccctcagcaccctgggtcacccagtgcgccctcagaatgatcctgatgtctgctgctttgcaggtgctgaacagcattttttttgagcttgaagcggatgagagagagcccacagagtctacccaacagcttaacaagcctgaggtcttggaggtgaccctgaaccgcccattcctgtttgctgtgtatgatcaaagcgccactgccctgcacttcctgggccgcgtggccaacccgctgagcacagcatgaggccagggccccagaacacagtgcctggcaaggcctctgyccctggcctttgaggcaaaggccagcagcagataacaaccccggacaaatcagcgatgtgtcacccccagtctcccaccttttcttctaatgagtcgactttgagctggaaagcagcsgtttctccytggtctaagtgtgctgyatkkagtgagcagtagaagcctgcagcggcacaaatgcacctcccagtttgctgggtttattttagagaatgggggtggggaggcaagaaccagtgtttagcgcgggactactgttccaaaaagaattccarccgaccagcttgtttgtgaaamaaaaaagtgttcccttttcaagttgagaacaaaaattgggttttaaaattaaagtatacatttttgcattgccttcggtttgtakttagtgtcttgaatgtaagaacatgacctccgtgtagtgtctgtaataccttagttttttccacagatgcttgtgatttttgaacaatacgtgaaagatgcaagcacctgaatttctgtttgaatgcggaacmatagctggttatttctcccttgtgttagtaataaacgtcttgccacaataagcctccaaaaattttatctttyatttagcagccaaacagatgtatacaattcagcagatagactgtgcaaacgaaagtgctttcctggactttggatggaatttccatgggaggtctgagccagtacttagcagtcctttgaagttttaggtgatgcttttctctggacacttccattggtaagcagtggtggccatctgtgtgatggacagggggcgggaagagggtgacagggaaggccccataccccatgtggcacctgggaaaggaaccaggcagatgggacttcttccgtcctggtgacacagggccagactgctgctggtattgtgccccgggagtggaaggtagagaaataaatcttcacaaataaatatttgcaattttcccccatctgttgagtgcctctgcctgctcctcctcgatgggattaggcccacagttcggaatcttggggagagccaaggaagcggtaggcacccagtaggcccacggccgtcggctgatagcaatggtgatgctgtcctacctacttgtgtaaggcattcgatcttcctcccttccatacatattgaaataaataagccgcgcaatgtgttagctattgatcagaactaaagtgaagtcagccacggggattacaaatctcggcttctcccctcatgttcctgagagtcttcccctggttttgaacacatctccctagctcgatgtcaaggtgagggattctgtcggcaacagcagtgcccttagttgcttcgtcgtaactccccgtcaccggttttattcagttaccttccagtcccactctcagagcttcctggcttgttctgctctcaaagcgggtagagctggcacacatggactctccgaaacggctgcaagatgccaagtttctcggaagaactggaagcacagagaccagaagtgccttaaggtctcgctattcagtgtggcgcttagaccggcagtggcggcagctgccctgggagcttgttagaatgtggcttctcacgcccctcctggacctacagagtcagaatctgcagttttacaggaggtccaggcttggaagttgctcgtagagacctgagacagcgcagccacgtgctggaaacaaagcatttaagtttgtgactttattttaaaaggcagcaggcagtcgacaaaccaatttcttctacttagaggcggcttcggcttctggaagtcgctaggagtataaagttgccaaccagcgctgttctcccgctgttttctgtgcacttataaatgggaagttaggtcaggatagatctctcagctattacaaggatacaaaatacgaacattctacaagttacttaacacacacacacacacacacacacacacacacacacaaaattaattccacaggtcagtttctctgaaacattttttcactaaattctaagtcttcctggagttgcaagtgcctatctcctagacaaggcaattactcaccaactaaaatcactgtcaatctgagatttcggctgggcatgagaccatggtcaggggatgctttgaacagcctctgaggaaattagtgagtttgaaaaatggaaagatttttattactcacttggcagtaaaacctgatggggacagacgtcaggctgtttaagatcctcagaagaaaaagttgatagtgtgaatattcctaaatttgccacacgaagatgtacatgtgattataaggtgctgttgcagaagcccctgggggtgttatgggatatacactatatgggccactttaccttcctaaaatctgaaaaacttcaactactgaaacatggactgaaggttttgaatagtggatggtgaatttgaataccatcccgtgtgatttttttttctagcagactttagttttttagagcagttttaagcccacaccaaaactgagaggaagatacagcaatttctcatataccccctactaccttccagtctcccccattattgacatcccccaccsagagtggtccatttcttacaacccacgaacctacattgacacatcattattactcaacgtccatagtttacattagggttggctcttggtgttgtacattctatgggtttagacaattttcaggagtttcactgacctgaaaatcctctgtgtccctcctattcacccctccttccctcctaaccactggtaaccaccgatcctattcccatcttctccatagttttgcctttcccacccaggatgtcatatagtggaatcattcagtatgtggcctttccagattagcctctttcacttagtaatgtgcatttaagtttcctccatgtcttttcatgatcgctcatttcttttttattgctaaatactatgccactgtctggatgtgtcacagtttatttattcacctactgaaggacatcttgcttgtttccaagttgtggcaattgcgaattaagctgctacagacacccatgtgtgggtttttgtgtggacatgtttaccccacacaatttttaaagttgctcaatgatcagagatgttctgagtgactctgatagacccacaaacatgtcagtgactctatcccttcaagagagtaagggtctcagggcccacacccctgaacttgagtaacctcattcttctgttaagttagctggagccaggagaggagtttatgactaagtcctcaaaagccaacacaacagaaacaaaaattgaaaactggcactaagtaaactaaagagcttctgcacagcaaaagaaactaccaacagaggaaacagatgaactaaagaatgggagaaaatattagtaactatgcatccaacaaaggtctaggatctagaatccataaggaacttaaacaaatcaacaagtaaaaacaaccccattaaaaagtgggcaaaggacatgaacagacacctctcaaaagaagacacacaagcggccaacaaatttgaaaaaatgttcaacatcactaatgatcagagagatgaaaatcaaaaccacagtgagataccatctcacaccagtcagaatgcctgctattaaaaaatcaaaggaacaaaagatgctggtgaggctgaggagaaaaggaaacacacacactgttgctgggattgtaaattagttcagcccctgtataaagcagtttggagatttctcaaagaacaaaaaaacagcattaccattgacccagcaatcccattactgcatatacacccagaggaaaataaaccattctaccaaaaagacacatgcactcatatgtttaccacagcactattcacaatagcaaagacatggaatcaacctaggtgtctatcagtggtggactggatacagaaaatgtagatatacaccatggaatactatgcagctataacaaagaatgaaatcatgtcatttgcagcaacatacatacagccagaggccattaccctaaacaaattaatgcaggaacagaaaaccaaacaccacatgttctcacttataagggggagctaaacactaggtacacattgggccataaatataggaacaacagacactggagactctaaaaaggggaggaaaagagaaggtcaagggttggaaaattatctactcgctactatgttcactatttgggtgacgagttccactgaagcccaaatctcagcatcacacaatatattcatgtaacaaacctgcatatgtacaccctgcagctaaaatgaaaaacagaaagttacgtggagtgagtgtcatccttcgaggcttgattctatgttttgtgaggtggcttcagagcagccctttacatcgggttaatttggctccaccgcaggggccatacccccaccctccacgtctttccactctggacacacttttcccaggcccgttttgctctggggcttttttctacctgctcctttctggggattctttccttggccttgacaacctctttacacaggcgggctggtcaatacccagctccaaaagcaaagcgacgctccacagacctgtctcctctccgttactctgcacccccagttccagcctcttcagtgtccccaaactccacaccgcctcctctcagggaatgggctgggctctggatgctcctgtgcatccagagaccctccatgctagacgctgggccatcgcaggacccccacctgccccttctctctaggaccctgcactgccggcatccgacactgagcagcgctgtttcacacagtatcgattttcagttgttcaggatgggagggtcaatcaggtcccaacatgccatcaagctggattacacaagagatttaaacagtcagaatgccactctgaatttcgctctgttgtccaggctagagcgcaatggtgcgatctctgctcaccgcaatctccacctaccgcattcaagcaatcctcctgcctcagcctcccaagtagctgggaatacaagtgcccgccaccatgcccagctaatttttgtatttttagtagagacagggtttcgccatattggccaggctggtctcaaaactcctgacctgaggtgatccgctcaccttggcctcccaaagtgctgggattacaggtgtgagccacaccgcaccyggccaataatacattttagttcaagattagtgagagctaaggagaaatgagaatgctgattgttctgaaattcagtctccacatgaaaaccagctgagggttgagtggaaaatggagaaactttcgcaatcaaatgaaggtaacacttccttcactcaacaatttacagatgttcacagccatccaacacgaagcttagtggctgatcaaaagtagcaggatattttcagggtaaaaactgagactcacgggcagcaccaagaatgtctgcacatctcaaaagacagacagcgtttcctttagggcgctgaggctgaggtcttacacagagaggaggattgccaactggcaaagccctgcttttcaccaactgctcgaacggactggactgcctggctgctgatagggagggagagatccaccagatctattcagatgccatgaacagagaaaataacactgccttcaaacggggacccctaacagatcttgcttaagaatctaacagttcagcatctgcagttgatcactgcttttgagttctgagacatgaacacaccatggaggtgtccacgttgtcaatgactcagccatgctggctccaattactgcaccaccagtgctgttgctgctgttagagtgacatctagaccccagtaccagagagcttcatggttgtttcaaaagggccccgcaaaggaaaatcagcccttacctcctgcactacagagttcctgagtgaccctgcttttattccatcactaggatcattaagccatggcagcacagcttggtgactgtgcggttctcatatgggcaactccatatagcagttctagggagctgcgaggaattaccaaaaaagaccccagatgagagattggggagttcatctacagaagttccaaatcctttttttctttctctccttcctggacacacagctaaaactacagttccaggccccacgtgcctgagcgccacacactggagtgagggggaaggattttgtgctcacccaaactggggccagagccacaccctgggcgcccccatcacactcttctccctttctggtaggttgcagtggagggggagtgggctgaatggtggccttcaaaaagatatgtccacatcccatcccctggagcctgtgaatgtgaacacatttggaaaagggtccttgcagatgcaattaagcaaggaatctcaagatgcgatcatcctggattaaccaggtgagtcctgaatctgatgacagtatctctatcagtcagaaggggagaaggccacgtgaagacggaggcagagactggggtgatgctgccgtagccaaggaacacctccagccacaggacgctggaggaggcgaggaatctcccctagagccttcagggggagcacggcccggctgacgccatgagtttagacttttcaaaactgtgagagaatgcacttctgttgtttccagccaccacacttgtggtaatttgttacggcagccctagaaatgaatgcaggaggttcctccagggtgaacttggaagccataggatggagatggctgacttccagtcagcctgggtccccgaatgacctactcatggcctccccagcagcattatagtagaacaaaaaaaacttctcctgtggctgacacccacttttgagtctgtatattagaaaaattgaaactaatgacaggtttacagtatgtaagtattatttcatctttaagctttattcaatagtaatttctccaaagcaaagcaaataaaacac

SEQ ID NO: 17555 - DNA, 16159 bp, Homo sapiens
gcgtctgctcacaaacagagctgtgcaggcaaattggagtgaggggttgggaatgactgctacagtggtatttatttactgatttttttatgaaaatggctaaatgtgtattttttttcttttatcttttgagaccgagtctcactctgctgcccaggctggagtgcaatggtgcaatctcagctcacctctgcctcccaggctcaagcgattctcctgcctcagcctcccaagtagctgggagtacaggcacacgccaccatgcccagctaatttttgtatttttagtggagacagggtttcaccatgttgaccatgctggtctcgaactcctgatctcaagcaatccacccacctcagcctcctgaagtgttgagattacaggcgtgaaccactgcgcctggtgtgtattttttttttttctgattgcaaaagtaatgcttattttaaagattgagcaacatcaaaagacataagcaaggaagcaaatatctacaatcccaaatatctacaatccccaaagataacccctgctaacatttgactacgtttcccgtgttttccctgtgcatacacatatatgtatttgatacaaaatgtaatactgtacattctactttttaatctttattgccacttagcatcctattacaaacacttttctatagcattaattatagctgtacattattttaaatagaagcatggtattccattttataaatccagtataatttgtataaacattttttgaagaacattgagattattgctgttttattattataaacaaccctgtgataaacttactttccttccttcctcctttctttccttccttccttccttctttcctttcttccttccctccctctctcctcttcctcccttcctcccttccctcttttagtggaatttcagcatcaaaggttctgcattttttggtgtgttcgatacacagctcccccacgggaccatgggggttgtgtacaaaataaataaataaataaataaataaataaataaataaataaagtgatcataagagcctgggcaacatagcaagaccctcatctctacaaaagtgttttaattatctggttgtggtggcacacacctatagtcccagctacatgggaggctgaggcaagaggatcgcttgagcccagcagttcaaggctgcagtgagctatgatcactccactgcactccagcctgggagacagagtgatgtcctgtcctgaaagaaagaaaaataaaggaaagtgggcatctgagcactcatttgaaggaaatcctccggaatcgattcagaaatcctcatgaagkacccagaattccctgctttggagccagccagaccaggatgaactaaaagtgactgaacacttattatctgccaaccactttacatatattaactaattgatcctgatgccaatcctataaactaggtcctacttttattatccttttgcaggtgagaaaactgaggcacagagtgagcatctaagctgcccaagggcacacatctagccagggacagagttgggatttgtaccagctggtttggagctcaagccttccatcatcacaacagcttggagaggtaagtattattatccccgtttttatagataaggatattttgataaatgttaagagatgccacaatttgccagttgactggcattcaggctgcacctgtcacggctttcttcgtggcactgggtgttctgcatagaatagaaaaatgctttcctatcaccacccaagatcacaaactagtaaagaagagccagtatttccatcctggtctgtctgacttcaaagcaaggaattctgggtccttcatgcggattttctgaatccattccggagcgtttccttcagatgagtgctcagacgctcactttccttttttaatttttctttctttcaggacagtacatcactctgtcttccaggctggagtgcagtggagtgatcgtagctcactgcagcctcgaactcctgggctcaagcgaccctcttgcctcagctttccatgtagctgggactataggtgtgtgctagtacatccagataattaaaacatttttgtagagatgggtgtcactacgttgcccaggctcactttatttatttatttagagacaggatctcacttcatcacccaggctggagtgcagtggtgtgatcatagctcattgtagccttgacctttctggcttaagtgatcctcctgcctcaccctccctaatagctgggactacaggcacacaccaccatgcccagctaatttttacttttactttttatttttagagagataggtcttgctatgttgcccaggcttgtcttgaactcctgaactcaagcaatcctcccacattggcctctcaaagtgttgggattacaggcataagccaccatgcctggcctatttatttatttgttaattttttttaaaaaaattgagattgcaggaaataatttttaaatttaattttagttttaaaacggagattgcaggaaacaaatatgctcacttttcaaggtccttctctggcttcctctggagactggagatcagggctgggaggtctgcacctggctaggtcacgtgtctgtcaatgcccctgtatctttaccactgcagccttgacccagtgtctcactgacactactccctgctcctctcatcctagaccacatttggtttccagaactctcacagttgggcatgttttggttgctggtaacagaaaagtcaacttaaactggtcttaacaataaagacaatttattggctcatggaaccgaagaaagtacagagagaagatggcctctgggcatggtttgttcaggactcttggtctgtttctctgattctctcaactctgccttcttctgtgtgttggttttttccttggactgtttttgccatttatggtagcaaaatggctgctgactgcaacaagactatatacttgcttttccacattcattgagcaaacatctgaactttgctctgactggatcatcttgggtcacagactcactccctgagcctgttgctgtggttacgaggacgtcactggggagagaggagaaacctccctctacccctttcctctactttgatcccagatccaagtggattcttctggaggaatgagaagagatgctgaagctggcataaggctgatgcagggacaaaatagatgttcttacagccacattgtgctgttcacatggtctgtgcagaagtcatcatgtttaaaacagagtggtaagaagatgtcacccaaagagatactacattttsccagttgactggcattcgggctgcacctgtcacagctttctttgtggcattaggagctctacatggaatggaaaaatgcttctcagcaggaacattctaggccattttaagagggcacagttataagtgggaagtgaggtatagaagataggttgggtgggctgacttgctggaacattttgaagtgggtaaaattttattctaaactcatctatatgtgctttctccctccttcagtgaaatgctcgtcctactgcgaagtgaaaggttctttccacccttgtcctccagatgcaacttctcctggagaccccagcattgctgttgccctcaccacactcatgcagcagggctgctccccttcactcctcgggctccaggagaccagcctcttccctaacccctcagtgattccttgaaatagactggaatagtgaaccgacttactgagggtttaggaaaagcagaagggaactatacaccaagaagaacttaacacacggtgttaaatatacctgctcttggccctggtctttctcaagggggtgtctcacaggggattccctgtctagcaactgctgcccccttgtggcaaaaactatccttctcccggcctcagggtctttcttgagtataggcaggtgttttgcagtctaggcccccgtcttttttctcctgtgtccccagtgactattttctgcccttggggctgattttccctagatgattaatagagggagtctcccacctcctgggactaccccatctttgactcctttctagtctaggcgttagagcacaatagtccaacatcagtaaaagcaaagcatgagtggctattgtccccttacacttcctgttaccatctatgaatgataaaagagcccaggaggaaagcacaacttagcttaaaaaataggcttgccggctgggcatggtggcttatgcctgtaatcccagtgctttgggaggcaaaggcaggaggatcactagaggctaggagttcaagataagcctgggcagtatatcaggaccctttctctacaaataaataaataactaaataaaaaataaaaataaaaatataatataaaaaaagaaagccagatgtagtggctcttgcctgtagtcccagctattcaggaggttgaggtgggaggattgcttgagcccaggcatttgaggttacactgagctatgatcacaccactgcattctagccttggcaacacagtgagagcctgtctcttaaaaaaagaaaaaaattctttccagtgcagaactgtaggaatccatggcatggtaaatttggcatttgtggtagggcaggatttatacttgcacagactggcattagctccaaacattagaggaaggttggaaagaagcaatgccaggcagaccaactgggctgtgtggaagtgaagctatcaggcataccagtgactttagtgtgtagccaaaagcaatagacactgaatcgtggtggtgacttatggtccatgaatcacaggagaaatgtctcccttcatttattccacaaccattgattgagcacctactatattccctgaaagagaacataaacatgaattgaagaaggttcttgctgtctcatggctcccaagctagaagagggctgacttgtaaatgcctcacagcagggttcatgttatatggagaagtgacgaaggtgccagaagactcaagctaggggacagccattagctgctggaggcagctaaggtgggttcccagagaagccgttctccgttactgagatgggggctgcagtgaccttgaccacagctcttccattcatggactgccccagctctgtggtctctctgctaaccagccagactctgggagtggcctatgccgtcagcctcagggccatttaaaccaactggtcattggcagtgattgtgcgaaagagtggctggcggcaaaggagggtttgtgttccattcaaataccctcaaaaagcctgaaaaataagtagagattgaggccaggccttggagttgtggaaggtggagaacactgggaagccaacctccaaagaagaccaggttggaggcaaaggaggaaggggagctctcgttggcaaaccaacagggaagccaaggatatcccagtaactgctctcacatccttgatgagaatgccttgaatccgagctaggccacctcaaagaagcctgcaaaataagtagagattgagtgcctgctgttcaaacacaactcaagcgcagtcctcctcctctttcccactggattgcccccaagtccctcctatgggggactccttctgaagtctctgctgtaagtcaaatccttcgccctttatacttggtcaggaagttgcaagcttccacaggtgatatactagggaatttaggaataaacaaatggaaataaattcaagaaaaggaaaataataaaaatgatcatccatagagtggagaattcagataatggaccctcaaccccagcttcacacctgggacccccacttggtcatatggaccctggcagtctctaatcacaagtctgtgatcccttgacttaaactgttcttccccaaatgtagacatgggtggggctcagaagggaggtgtcatctgatgtggtttccttatttccgtttattcatcaagtgccctctagctgttaagtcactctgatctctgactgcagctcctactgttggacacacctggccggtgcttcaggtaggaagccacctctgtttgctaggactttctgtggggtagggctgcttggcttgactttattttggaaaatgtattcatttctgtgggagctgaggatttctgctgcccgcttcctctcttgtgaccascactcatacatggagttagcaggtgaagaggacagcctcctcatcccctctttttataccttscccttttgtgggaagaggctgaccattccccaatttgatgtttattgcttcaccttaagactttgtcttcagtgaaaatgcaaatactggtagggagggaacacactaaaatgtgtggatctgagtggactcatcatacaccctcaggcctggcagcaaatgagaggtggatgattctgtcttcctcgatttgcagatgagaagactgaaatctataggggtacgagaccccactcaaggtcatgagacttatttatttatttatttatttattttgagatggagtctcactctgtcgcctaggctgtagtactgtggcacgatctcggctcactgcaacctccatttcccgggttcaagtgattctcctgcctcagcctcctgagtagttgggattacaggtgcacgccaccacacccagctaatttttttgtatttttagtagagacggggtttcatcattttggtcaggctggtctcgaactcctgacttcatgatctgcctgccttggcctcccaaagggctgggattacacacgaaacttattaatggtagaatcaggatggaatgaagactggatgctaggtgtctttacaaccaacctcggtgactttccaaaggctttcagacttctctggagagtcctggagctttgaggggctctttaggggccatctgggttcggagattagcacactctgccccacagtggctcarcttttatctgcttcacatactgggcttctgggaagatcttatttcagtaaactatttcacaataggaaawatatttgaaaactcttgaatgattctgtggattttttcaggggtggagggtttcagggaccaagatggagactttatcttctcaaatacttaaaactcctttagacagaggaacaaaatatgtgctcctcatttaaagaaggcttaaaatatacagtttaatgcaatgtgttgttatcacttccttcccccagtagattttaaggagggtaaacaagaatcagggagaacataggaatagaaatagtagaaggggacacctgggaacaggtttgccttcttgcattttgcttaatgctggcccttccctgaatgtctaagaccaacctggtccccacatccaaatgcacagacacagctgaggatggagaaggctaaagagggacagaggtagagacayaggctgagaggaggcagttgtaggttgagctagggctaaggtgttttccccatattccatcttaccccacactcaggccaggccttagagttgtggaaggtggagaacactgggaagccaacctccgaagaagaccaggttggagtcaaaggaggaaggagagctctcattgycaaaccaacagggaagccaaggatatcccagtaactgctctcacatcattgatgagaatgccttgaatccgagctactaaatcacatttccttccttctaaccttccagttagatcaaaccattgctgaaactgaagaggacatgtcaaatattacagatccacagatgtgggattttgatgatctaaatttcactggcatgccacctgcagatgaagattacagcccctgtakgctagaaactgagacactcaacaagtatgttgtgatcatcgcctatgccctrgtrttcctgctgagcctgctgggaaactccctsgtgatgctggtcatcttatacagcagggtcggccgctccgtcactgatgtctacctgctgaacctggccttggccgacctactctttgccctgaccttgcccatctgggcygcctccaaggtgaatggctggatttttggcacattcctgtgcaaggtggtctcactcctgaaggaagtcaacttctayagtggcatcctgctrytggcctgcatcagtgtggaccgttacctggccattgtccatgccacacgcacactgacccagaagcgtcacttggtcaagtttgtttgtcttggctgctggggactgtctatgaatctgtccctgcccttcttccttttccgccaggcttaccatccaaacaattccagtccagtttgctatgaggtcctgggaaatgacacagcaaaatggcggatggtgttgcggatcctgcctcacacctttggcttcatcgtgccgctgtttgtcatgctgttctgctatggattcaccctgcgtacactgtttaaggcccacatggggcagaagcaccgagccatgagggtcatctttgctgtcgtcctcatcttcctgctttgctggctgccctacaacctggtcctgctggcagacaccctcmtgaggacccaggtgatccaggagasctgtgagcgccgcaacaacatcggccgggccctggatgccactgagattctgggatttctccatagctgcctcaaccccatcatctacgccttcatcggccaaaattttcgccatggattcctcaagatcctggctatgcatggcctggtcagcaaggagttcttggcacgtcatcgtgttacctcctacacttcttcgtctgtcaatgtctcttccaacctctgaaaaccatcgatgaaggaatatctcttctcagaaggaaagaataaccaacaccctgaggttgtgtgtggaaggtgatctggctctggacaggcactatctgggttttggggggacgctataggatgtggggaagttaggaactggtgtcttcaggggccacaccaaccttctgaggagctgttgaggtacctccaaggaccggcctttgcacctccatggaaacgaagcaccatcattcccgttgaacgtcacatctttaacccactaactggctaattagcatggccacatctgagccccgaatctgacattagatgagagaacagggctgaagctgtgtcctcatgagggctggatgctctcgttgaccctcacaggagcatctcctcaactctgagtgttaagcgttgagccaccaagctggtggctctgtgtgctctgatccgagctcaggggggtggttttcccatctcaggtgtgttgcagtgtctgctggagacattgaggcaggcactgccaaaacatcaacctgccagctggccttgtgaggagctggaaacacatgttccccttgggggtggtggatgaacaaagagaaagagggtttggaagccagatctatgccacaagaaccccctttacccccatgaccaacatcgcagacacatgtgctggccacctgctgagccccaagtggaacgagacaagcagcccttagcccttcccctctgcagcttccaggctggcrtgcagcatcagcatccctagaaagccatgtgcagccaccagtccattgggcaggcagatgttcctaataaagcttctgttccgtgcttgtccctgtggaagtatcttggttgtgacagagtcaagggtgtgtgcagcattgttggctgttcctgcagtagaatgggggcagcacctcctaagaaggcacctctctgggttgaagggcagtgttccctggggctttaactcctgctagaacagtctcttgaggcacagaaactcctgttcatgcccatacccctggccaaggaagatccctttgtccacaagtaaaaggaaatsctcctccagggagtctcagcttmaccctgaggtgagcatcatcttctgggttaggccttgcctaggcatagccctgcctcaagctatgtgagctcaccagtccctccccaaatgctttccatgagttgcagttttttcctagtctgttttccctccttggagacagggccctgtcggtttrttcactgtatgtccttggtgcctggagcctactaaatgctcaataaataatgatcacaggaatgaaygcatgctgaaaagaccactcttttgcacaccatctgctcaaagctcctcttgtctgtcctgtccgctttcagcctccgtctgtccacttattaagtttgcctttgtggtttagcttcattagatgtttatctgtgtaaaaatgtcccaagtgaggacttaagatgtcagggctcttctgatggcaaatgatagaaagagaagtcaaactagcttaagcaaaactgagagtgtgggtttagcctgtgtggggaaggatcagggaaggcttgaggttgggaatagggtgaggctcagagacaggacctagatcaagcttcagatggggatcagtgattgatgttgaaatcaaagctgggatgggggcagggatggggtggcagcttgggatgaggtcagagaaggatgaatgccaggaatcggtagagatctacaaggagggagagtgagagtcagggtcacagtgaggtgttgggaacagggagattcaacatggagctgggaccagatatggagagtgagactttggaatgggataagtgtgggggagtggtgaggctcagggagggggtgtcaggcctggaatgaatatcagggaaggcttagtagctataaggctggagcagaagacgtgcctggtagggtcaccatcctatctggagcatcatctaagatcttcttccggggccaaaagacagaggctcctcagtctgtcctgcttaagactctccaggcaggtgagtgaggagggagttaggcactcgagccctaagagatagacctgattcagcagagaagacaagaaggatgcaaaggatgcacagagaatctagggcagaaggctgagaactggggcctccttttcctctcctccctccgctgatctccctccacctctcctactgtttcctcaaagtccaacttcctccttcttcaccttatgcttctgcaaggacaactccatcagaggcttcagtaagtaaatagggatccacactgggtccaggggaaatgcaaatgactcataacctcatgaaaaatgctcagtctcactaggaactaaatgaggctcaaacagcaacaaaataactcagaagtgttttaaacaggggagggatatagtggactcttcaaacaagtgcaacatttttcgattggattttttttttttttttaatgagacagggtcttgctctgtcacccaggctggagtgcagtggtgcatacacagctcactgcagcctcaaccttctgagttcaggtgatcctccaacctcagtttccagagtagctgggaccagagctgtgcgccattatgcccagataatttttaaaattttttgtagatatggagtcttgccacgttgcccaggctggtcttggacccctgagctcaagtgatctgcctgcttcggcctcctaaagtgctgggattacaggtgtgagccactgcacccaggctgattggaaattttaatgcagcctgtaattttctgggtatagctcaagacacaaatgatttggatttcagatttttaaaaaatgtcaggattttggtacttagttaacagcatattgaagtaccaaaaactgatatttcaattactagatagggtgaggattagatccagtcagagccagggagagtgtttgccttaaggagggactcccttgtccaggatggggctggcactagggatggggtgaatcttaggacaggagtgggggtcagaaatgggaggggtcagtgatgagattgggattacagaggggatgtacatcagggtaaggtgagggacggggattaggatgtaacggcatgttctgcacaatgcttcctgatgttaaaatcctaaagtttgttttgtagccttggtgacaacgtttgagactctaaatcaaaatgtgaaaatctactgttttcccctaaaccagttccacttctgaccaaccacagcctctcaccaccccttgccctccatcccctggcccattcttgttaattccagcaaaaatactaattgacaatcaacattttatgccatagaggtaaaatttgcccctttctcagcaaagtagtattttaataagagtctttcagagactgaaaaatctcatagatgcaaatgagtaacatgacaatctcctctttggtctaaggatcgtcccaaagaggtgccttcctagagaagaccactcaccaagagacagtggtggagccctgtcttttgccgtttccatgcagaggtcagagaggccactctaggttccacccagaaagccacaaggagctaacggcggagctctcagcaccaatgttttcttgcagcctggtattcagtttttaaatccaaagtcttccttccaaccttcagggtagaaatgaatcaaagacataataaataaaaaataatcgaaatatgttaactcgactttttaagattaaattttctttctattgtctaagtattttatacacattgttgaaaaaacgaaatggctttatgaagcttataacaaaaaaccagcagccttccagctccaatccctgcagacaagggcagcagctgtcagctctcatagctgtttcatcggatagtgatctatatatttctaaatatcatacttgttctgctagtttttttcttttttttggtctcactcagtctcccaggctggagtgcagtggcatgatctcagctcactgcaacctccgcctccctggtttaagtcattctcccacctcagcctcctgagtagctgggactataggtgcccgccattacgcctggctaattattgcattttttggtagagacagggtttcaccatgttggccaggctaatcttgaactcctgacctcaagtgatccccccacctcagcctcccaaagtgctgggattacaagtgtgagccactgtgaccagccctctgctagttcttgtttttctccccctccaggtttagctatcatcactgactctctcttttggctttgagaatgtaatattctcccagtccctctcctgctttcaccccaatccaagcaaacacaaatactgccttctccattctccagaaacagatgccacattttttggttaagtcgacattcaatttttttgttattatgactatgtaaaaaattattcacagtaggatccaattttttttgtacaagttttgttttccctggaattgatgagaggatgttccatgtacttatcatgacatcagttccaatgtctccctcaatacattcacactcagcggataatctattaatttttctttctcaaagacctctctccgggagtccttcattgtcttcttccaacctggacaggtgactcttaggaaaggggccagttcctctttactaaattgctttgactatgtttccagagaaattttagaatctgcttatcaatttctatataatgtccagctgggattttgatttggattatgtagaattcatagatcaatttagagaaaattgacattgtcatattgagtcttccagtccatgggcacgatatctttctctatttatgtcttctttaatttttttgcaaaggatgttttatagttcttggtacacaaatcttgtacatactttgcaaaatttgtccctaagtattttatgggttttttggatgcgattacaaatgatatcttaaaaagttttcattttccagttctttttttggttaccatagtatatagaaatacagttgcagtatgtatattgaccttgtaacttgggacctaagtaaattcatttattggttctagtagatttttttaaagattgctttggattttaactgtatgccatcatttcagaatttaaatcttctttttagttttagaatgcatgatgtgtaccttggtggtgtttttcttcattcattgtgctgggcgcctggtaaattttcttaatctggaaatttaggttatgtaaatttatctggtattagttctttgacagtgttccacccttcgttttccttattctttaatttttttaaaagaattattctattttattttatttttgagacaggatctcactgtatcacctatgctggaatgcagtggcccaatctcagctcactgcagccttgacctcccaggctcaaggaatcctcctacctcagcctattaagtagctgggactacaggtgtgtgccaccatgcctgcctggctagttttaaatttttaaatagagtcggggtctccctatgtcacccaggctggtctccaactcctgggcccaagtgrtcccctctccttgtcttccaaagtgctaggattacaggttgagtcactgcaccctgcctatttaaaaaaaaaaaattaaaaaatcctcctgcctcagcctcctgagtagctggggctacaggcatgcaacaccacctttggctaattaaaaaaaaatttgtagagacagaatcttactatgttgcccaggctcgtcttgaactcctaggctcaagcagtccttcttccttggcctcccaaatttccggaatttcaggcatgagccaccaagcttgacctatttaaaaaaaaaaatttaggggctgggtgcggtggctcacgcctataattcctgccctttgggaatccagggcgggaggatcatttgagtcaaggagttcaaggccagcccgggcaacatggtgaaaccccatctccacaaaaaaatacacacatgcacaaaattagctgggcatggtggaatgcacctactctgggggctaaggtgggaggattgtttgatcctgggaggcagaggttgcagtgagccaagattgcaccactgccttccagcctgggcaacagagtgagaccttgtctcaaaaaaaaaatcctccttccttagcccccaggtagctcggactacaggcacgcaacaccatctctggctaatgtttaaaatattttttggagagatggagtctcactatgttgcccaggctggtcttgatcccctggcctcaagtgattctcccacctctgcctctcgaagtgttgggattataggtgtgagtcactgtgcgtggcaaaaaatatacttattttaaagtcagatccaaattgctttattatctttagctcctcaggtgtgaattctcccatttgctgttgactgactgttgattgtgatgattgtcagctctttgtaacattttattgttaattcatcttttgaaggcatttttttgtttcatgggagtcttgcatgtgccctggattatgaagaagtctattcaggggtggctttatggctgtacctgctagggccttactgggttacatagctcagagcattttttgttattgatatttcttggccctgagtttccacaccattgcaaatgacagatttgggtcctcatcacttgatactagggcttgggattctggaatgttcctcaattggccccttttctctcatgacctaggaaggcagctcacttgggggttgtgtctcaggctgcaaagtgcttttctatccccattcaagggcatggcagctctttcttggtcctgacaattttataggcaatcaagttgtagtttctgctatacatggggcctttagggtcactggtattatcattcccatccttaaggtacatgatcaattctagtatctttctgggttcctctggctttaatcctactccctgataagtccatacatttttaagctccctcttcatttctggcccttggagattttttctctctctcttgcctgctattgacctcagatatttatttttaaaaattaattaattcattcatttatttttgagacagagtctcactctatttctcaggctggagtgcagtggcgtgatctcagcttactgcaacctctccctcccgggttcaagcaattctcctgcctcagcctcctaagtagctgggattacaggcacccaccaccatgccagctaattttggtatttttagtagagacggggttttgtcatgttggccaggct

SEQ ID NO: 17556 - DNA, 75007 bp, Homo sapiens
ttacatttttgatctaatttttaaaaatgttttaccatgctgcacgttagacagccagggacccttagtaacaaggcacaggagccggtgtgtatccagcccttgctgtgcagtgggcactgtgtggtcatcagcgtgtcactcatagacactcatttaatcctctcaaaatccgtaagacgtagtgacacaaacatctccattttacggtgaggatgtagagccctagagagcctgagtaactgcccctgcatcacgcggctcctgagagttgggagctgggattggaatcccacagtcagattctagaacccataccctggcgccgtagttcagcctctcagcccgaattaccgtcattatcgtaacggctgtagcaggtggcattttttttttttttttttttgagttggagtctcgctctgtcacccaggctggagtacagtggcgcaatctcagctcactgcaagctccccacctcccggattcacgccattctcctgcctcagcttcctgagtagctgggactacaggcgcccgccaccacacccggctaatttctttttgtatttttagtagaggcggggtttcaccgtgttagccaggatagtctccatctcctgacctcgtgatccacccgcctcggcctcccaaagtgctgggattacaggggtgagccaccgcacccggccaacaggcagcatttcttgagcacttactgtgcccgggtactgttccaagcactttgtcaacttgtttaatccttatgacaacccatcgttcggccccgtcatgtggatcaggaaacagtccagagtggaggagggaggagactgagcagggggtcgctggggctggaccgcaggagtctccatcccgcttccgcaggtggatagtgacaagggcatctcccttcgcttccctcggtttattcgagtccgtgaagacaagcagccrgagcaggccaccaccagtgctcakgtgaggtcctgggaagcaggggtgggccgcccagctgcttggccctaccagctttttagcgtggtggcctctctggaaccttgtggaggtgggagcagccagggagcttctgaccaccccgtcccaccctctctccgcaggtggcctgtttgtaccggaagcaragtcagattcagaaccaacaaggcgaggactcaggctctgaccctgaagatacctactaagccctcgccctcctagggcctgggtacagggcatgagttggacggaccccagggttattattgcctttgctttttagcaaatctgctgtggcaggctgtggattttgagagtcaggggaggggtgtgtgtgtgagggggtggcttactccggagtctgggattcatcccgtcatttctttcaataaataattatcggatagctactttgtgacagggtctgtgctgggctctgggggcaaagctgtcatgggtgtcacctgcatagcatgtagccatgtagccatggcctaggaactgccagagccagtgccagccatggaactgcctgcagtggtgggcgtcttctctatctgctctgtgcagtgtgaccgccactggccacctgcaatgcccgagcccttgacaggtggccagcatgacagaggatgcgaatttgttttgttttgttttgttttgattttgttttgagacagagtctcgctctgttgcccaggctggagtgcgatgatgagatctcagctcactgcaacctccaccttccgggttcaagtgattctcttgcctcagcctcccatgtagctgggattacaggaatgtgacaccacgcctggctaatttttgtatttttagtagagatggggtttcgccatgttggccaggctgatcttgaactcttggcctcaagcgatccaccctcctcagcccccctaagtgctgggattacaggcgtgagccaccacacccagccataccaaatattttatttaattgtattggacagcagtagtctaaaatctttacatacatatatttttttaacttgtttaaccttccagccatcccacagggaggcaccatcgtgagccctgttaaggaagacaaatgcagtgtcttaaaataacacagatgtattccctaaacagtttcggaggtcagaagttcaaaatcagttttactgggctaacatcaaagtggtggcagggccggttccttctgggagctccaggagagaaactgtgtcctttttccagcttccagaggccacctggttcctaggctcatggcttcttcctccgtcctcaaagccagcagcatcgcacctgcaaatctctctcctgaggtcatcaggtcacgtcctctcctccatcagatctctgtttctctcttccaagtactcaagtggttacatttagggccccctggatgatccaggataatctcatttcaggatcctaactcaatcccaaagtccctttagtcacataagatcacacattcacagaggccaggcacagtggctcacgccttggggaggacttggggaggctgaggtgggaggatcacttgaagccaggagttcaagactagcttgtccaacacagccagacttcatctcctctaattttattaataaaattaataaaaatgtaaaagggccaggcgcggtggctcacgcatgtaatcccagcactttgggaggctgaggcaggtggatcacctgaggtcaggagttcgagaccagcctggccaacatggcaaaaccccgtctctactaaaaatacaaaaattagctgggcatggtggcgcgtgcctgtaatcccagctactagtggggtgaggcaggaggatcacttgaatctgggagacaggttgcagtgacccgagatcgtgccactgcattccagcctgggcgacagagcgagactccatctcaaaaaaaaaaaaaaaataggtcacatcaaaggtttcagcgattaagacctggatatctatgggggctgttattattgcagccaccccacatgggatgatatgttagaggaaaaccatcgggaaatggtcagacaaggcaagcaggatgcctggaacacccacccagccctgggcaccacggggctggcttggggaaaacggctgcacgcggagcggggcccaggctcgggtcttccagagcaggaggcctctaaccccggggcccagcgtggaacaggagcttccgggcatgagagtgtcagggtgtcctgatactcccgcaggggggacacagggctcccagctgtcccctgcccctcacactctgtttctgcctctcacatctgccctccctccttcccttctctctcatcaggttcctctgcccttgtctcccacccgccctctctccccttccttctctatctgcgaggctttgctctctgccgtgcaagtctgtgccaggcttactttgctgtctgtcactgtgactcakcctccctgtctctcttcctgtgtctccatcatggtctcttgtgcacacaatctcttgggcattctgtttctatttgttgtagcccaagaagacaacattgccttccgagtctccttggggctagcagtggccctgtagccctgtgtgggcagacccaggggacataagcacaggggctgctggggacttctggagaaacatctttcctgaccaaaaaggacagccctggttgtggcagctcctcccctcctcctgccttgactagagatgatggctggagccaagtcaccaccttgtaatgatgaggaaaaagagtaacaaactctcctgacgaccctaaaccggcgaacctagggcagcagctgcctaactgtgggcttttgttcatgggagtaggggaagaataagccccagggcgattatgccactctaaaacatggctttcagccgggcacagtggctcatgcctgtcatcccagcacttcgggaggccgaggcgggcagatcacctgaggtcgggagttcaagaccagcctgaccaacatggagaaaccccgtctccactaaaaatacaaaattagccgggcgtagtggcacatgcctgttactcccagctactcaggaggttgaggcaggagaatcgcttgaacccgggaggaggaggttgcagtgagccgagatcgagccattgcactccagcctgggcaacaagagcaaaactccgtctcaaaaaaaaaaaaaaaaaaaaaagacttgtttctcatagctaagagttcctgatacagctctgccttaaagaactggcaaattagtgtgcatttgtgtttcaatttcaaataaaatgtttaaggcaaaaaaaaaaagtaaatgttgtatgtcaggggatccccacattactggctttgtgtggagaccatggttcctttgggcttggctcttcctccctgcaccagtgcagggccccaggaacacatctgccacacacggccgccatgtccctctgctgaagctagtcagggtcatcctcactcctcagtgaccctcatgatggctccaccaggtaggtacttttattctccccatttaacaggtgaggacactgaggggcacagggatgtaagttaccttccctaggtccactatctaggaagtggtgggccagggtttggtccatgctgtcagctccttgaccctgcatctataactactaactatactatggagagcctcatgagctcctgcgaggtgtagaaccttatcccgcaggcggggcagtggcatggtcaggtctaggagtgaaaagatcctgcgatggttggagttgcgggcactgaagaggtgagcctggcgttagggggagcaggggagaccatcttccccctggtgaaatcctgttctaaaattggtgatactcctgccttggcctcccaaagtgctaggattatggcctcatatctatttttaaaaaataagaattcaagctgggtgcggtggctcgcgcctgtaatcccagcactttgggaagccgaggcaggtggatcacttgagttcagcagttcgagccagcctggccaacatggtgaaaccctgtctctactaaaaatacaaaaataattagccgggcgtggtggcagatgcctatgttcccagctactcgggaggctgaggtaggagaatcgcttgaacccaggagacggaggttgcagtgagccgagattgcaccactgcacaccagcctgggcgacaaagagtaagactccatctcaaaaaaaaaaaaaaaaaaattcaaaacccatcgagttgggatgacgcttagtgctgggcttcaggaagagtaggcaggagggtagtatgggaggtttctaggagccactcttggaagcggtgctccccacagatgcccgattgcactgactggaactcggtcacatgaccacataactcgctcacatgaccacacctagctgcaaaggtgctgggaaatgtggtaccctgttgggaggccacttctgggcttcaaaccttcactgtgaatggagctcacaggttttctaaaaatggacattaaatgaaccagagttggccctaaggatctggctcactgcaacctccacctcccaggatgaagcacctgcctcagcctcccgagtagtagctgggattacaggcacatgccaccatgccgagctaatttttgtatttttagtagagaaggtgtttcaccatgttggccaggctggtctcgaactcctgacttcacatgatccgcctgcctcagcctcccaaagtgctaggattacaggcgtaagccaccacgcctggcctcaatatttctttttctgggtatttgagtatgatattatatatgatggttattagacagccagatgcataggaggattagctaatctgttttgaggaatacttatctccaatatagttatataacgacaacattctttttttgaatactggtctcgggtgcctaatgacagaagggtgacatcactaaggaagcctggaaagtcccagccctccacgtgatcccacggatgaaaatagctccgggtgagctctggaacagctgaaaaagctggagcaaccaagcagggcctacaagccgaggagggctgtttaaaggcgcaggggccattttaccctccaggttggccctgctcaggaccaggaggaaacacctccagcccgcgacctcctcccacagggggaaaaggaaagcaggaggaccacagaagctttggcaccgaggatccccgcagtcttcacccgcggagattccggctgaaggagctgtccagcgactacaccgctaagcgcagggagcccaagcctccgcaccggattccggagcacaagctccaccgcgcatgcgcacacgccccagacccaggctcaggcaagccgtgggggcagggagggctgtttcatcccgctggggcggccataaccaagtaccagggattgggtgcaattaaataacaggatttctttttcttttttattttattttattttatttatttatttattttttttgagacagcatctcgctctgtcgcctaggctggagtgcagtgacgcgatctcggctcackgcaagctccgcctccggggttcaagcgattctcctgcctcaacctcccgagtagctgggattacaggcgcacaccaccacacccggctaatttttgtatttttagtagagatggggtttcaccatgttggccaggctggtctcaaactcctgaactcgtgatccaccccactcggccttccaaagtgctgggattacaggcgtgagccaccgcgcccggctaggaatttattttctaacacttctggaagctagaagtccaagatcaaggtgttggcagggttggtttctcctgaagcctcttgcagaggccctaatctctccttataaaaccaatcaggctgggcgcggtggctcacgcctgtaatcccagccctttgggaagacgaggcgggcggatcctgaggtcaggagatcgagatcatcctggctaacacagtgaaaccccgtctcaactaaaaatacaaaaaattagctgggcgtggtggcgggcgcctgtagtcccagctactccggaggctgaggcrggagaatggcgtgagcccggaaggcggagcttgcagtgagccgagaytgcrccactgcactccagcctagggcacaaagcgagactccatctcaaaaaaaaataaaataaaataaaccaatcaaaccaaattccaggccaccctcaggaccccactttaacttagtcacccctttaagagcctatgtctggccgagtgcgatgactcatgcctataatcccagcgttttgggaagccaaggtggaaagctctcttgagcctaggagttcaagaccagcctgggtgacataacaagacctgatctctacaaaacataaaaaatttagctggagatggtagcatgtacctgcacttccagctactcgggaggctgaggtgagaggctcgcttgagcccaggaggctgaggctgcagtgagccacgatcacaccactgcactccagcctgggtgacaaagcaagaccctgtctcaaaaagcaaacaacgaaaaagaatcctatgtccaaatacagtcacattctgaggttctgggggttacaagtccaacatatgaatttggaggtggtggggggaagctgattaatttcataaggggggtcttgaaactgccttcgcagaaatgtaagtaatgagagaaagctaacatgactgaccatcttgtttctaacctcacaggctagatttttttttcttattctagtgcagaggccaaaattaccatgagaggaatttaattcatagttaaactttgagacaaagaaaactgacccccagtccttgttgagagattgaagccacattcatttactttttatttatttatttakttttgagacagagtttcactcttgttgcccagactggagtgcaatggcatgatctctgctcactggcacctccacctcctgagttcaagtgattctcctccctcagcctcctgagtagctgggattacaggcgcccgccatcatgcccaggtgacttttgtacttttagtagagataaggtttcaccatgttggccaggctggtctccaactcctgacctcaagtgatcctcccacctcggcctcttaaggtgctgggattacagccatgagccactgtgcctggcctgaagtcacattcataagacaaggttagaatcatgaaggtgctggaactttgctaaagaacagtcgtgggttgaagaatgacctgccatyccttagcttccttttctatatgtgctccagagtcacgtaaccaggggtcgcatgatttataacttccccagctacttctataaataatatcactgtcgtgaaacacagaactcagctttttagtggggtgtggtagctaacacctgtaatccccacttcttgggaggctgaggcaggaggattgcatgagcccaggagaatgagaccagcctgggcaacatagtgagacctcaatctctacaaaaaaattaaaactttgccagacgtggtggtgcatgcctgtagtcccagcaacccaggaggccaaggcaggaggattgcttgagcccaagagttggaggctgcagtgagctatgattgcgccactgtagggaccagccctgcagggtctgtgggtctttctccccatgtgcggagacgagagatcgtagaaataaaaacacaagacaaagagatagaagaaaagacagctgggcctgggggaccactaccaccaagacgcagagaccgatagtggccccaaatgcctggctgcgctgttatttattggataataaggggcagagtaaggagtgtgagtcatctccaatgattgataaggtcatgtgagtcacgtgtccactggacagggagcccttctatgttaggtagccaaggcgtagagagagaggatagcttatgtcattatttcttttatgttcttttcagaaagatcaaagactttaatattttaatactttcactaattctgctactsctatctagagggtgcagccaggtatacagagtggaacaggaaagtgaaacaggagtgtgaccactgaagcacagcatcacagggagatggtcaggcctctggataactgcgggcgggcctgacatcactcaggccctccacaggaggcggtggagcagagtcttccctaactcccccggggaaagggagactccctttcctggtctctaggcactgacgcaaccgctagaccaaggtccgctaggcaatgggcrtcttcccagacgctggcgttaccccaagaccaaggggccctctagtggccctattcgggcatgacagagggctcacacttgtcttctggtcactcttgacctcaagtgatctgactgcctcggcctcccaaagtgctgggattacaggcatgagccactgctcctggcaataatgtttcgttttgtttttgttttaaaaaaaagaaattgtctttgagatagttttcagagtgagcattttggcagaccaagagctaccacctggtcctgagacccgctcccaggaactgactcagctatacaaagatagttttggacacacctgtgatttcatccatagccgatcaattgttccctcagccccttgcccaccaaagtttccttaaaaaaccctagtctcaggtcggacgcggtggctcgtgcctgtaatcccagcactttgggaggccaaggcgggtggatcacctgaggtcgggagttcaagcccagcctggccaacatggagaaaccccatctctactaaaaatacaaaaattagccgggcatggtggtgcatgcctgtaatcccagatactcaggaggctgaggcaggagaatcgcttgaacccgggaggcggaggatgcagtgagccgagatcatgccaatgcactccagcctggtcaacaagagggaaacttcatctaaagagagagagacagacagagacagagacagaggcagagaaagagaaagagcgaggaaaaaccctagcctccaaattttcagagagacgcgcttgaaatatttctcccattctcctcgcttggccgcccctgagattattaaactctctctctttgctgcaacacctgctgttcgcattggttttgtctgggcagtggacaaggagaacccatgagcccgtgacagtcccagccctcccccactgtctttgctaagcccaacagtgggcacaggactaagaagagccatttctttggcaggaggactgagaattttctgaccgcagtgcaccatgggaaggtaagtcctcttagagctgaccactatggggaagcagagcatttgtgtaatggaatgcatagtragtgtcaagaggtgagggctgtgacagttcctctcgcttggtggagatagatggaaagagctgaaggttgggcatggtggcccatgcctgtaaccccagcacttttggtggccgaggcaagaagatctcttgagccccagagttcgagactagcctgggcaacatggtgaaaccctatctctacaataaaagaaaatatttttaaaaattagccaagcatagtggtacacacctgtagtccaagctacttaggaggctgagacatgaggatcacttgagtcccggtgttcaaggctgcagtaagctatgattgcaccaccgcactggtggtgggcaacagagcaagaccctgtcttattgttgaaccggggaggtggaggttgcagtgaactgagattgcgccactgcactccagcctgggcaacagagcgagactctgtctcaaaaaagagagagagaaagagaaagaaagaaagaaaagaaagaaagaaagacagaaagaaagaaagaaagaaagaagggagggagggagggagggagggagggagggagggaaagaaggagggaaggaaggaaggaggaaggaaggaaggatggaaggaagggagggagggagggaggggagggaaggggagggagggagggagggagggaggtatgtcaccatgttggccaggctggtcttgaactcctgggctcaagtgatccacccacctcaccctcccaaagtgctgggattacaggtgtgagccaccgcgtctggccccaaaattaaccattttgaaaagtgaataattgactggcattcaatgcattcacagtgttgtacaaccatcacctctatctagtttcagaatattttcctcaccccaaaaggaaaccatgtacccgtgggctggtggctacctgcttggacagcccagttctaggtcaaattctgtgttttatcccttttccctgtgaattttctggacttctttgtgttttctcctgggaagctctgaagtttccataattcctgggctccagaaagaagaaaaggcggccgtggagagacgaagacttcatgtgctgaaagctctgaagaagctaaggattgagsctgatgaggtaagtgaggggaggagggtggccccagagatcccagaatcgccccctctgtgcccagtgtccagggcccaactcagccagggagagctggaccgaaggatatgaacttctatgggayagaaatagaaggatatgaacttctatgggacaggcattgcccctgcctaagggagatcctaggtctcctccttctcctcctcctcctttctttttcttttcttttctttcttttttttttttttttttttttgagacaacgtctcgctctgtcacccaggctggaatgcagtggcatgatcttggctcactgcaacctccacctcccaggttcaagctattcccctgcatcagcctgctgagcagctgggattacaggtgtgtgccaccacacccagctaatttttgtatttttagtagagatggggttttaccacattgaccaggttggtcttgaactcctgacctcaagtgatccacctgcctcggcctcccaatgtgctgggattacaggcgtgagccacggtgcccggccccaggtacccttcttcttgttcccacctccatcctcaggctctaaacctctgatcgattttctccccaatgcctaggccccagttgttgctgtgctgggctcaggcggaggactgcgggctcacattgcctgccttggggtcctgagtgagatgaaagaacagggcctgttggatgccgtcacgtacctcgcaggggtctctggatccacttggtaagcatcactcatgtttcagattgctttctgacacataaatgggattatttttttcctcctgacaccaaatgtgtgtggttttttccaacgctgcttctcgagctctctggtactarctgggtgtcctacaattctgagcaattctgacgctggctacctggagttcacatcagattccacaggtgaaaggggctcagtcccaaaaaactgctcccacttcagacacgagttgcaattacctagccgctggtgcttctgaccgactggcaatagtttggggtttcccacagcttccgcctcatgttcaataatttactggaatagctcacagaactcaggaacacactttacttacaattgctggtgtattacaaaagatgggccaggtgtggtggctcacgcctgtaatcccagaactttgggaggctgaggcaggaagatcgcttgagtctaggagtttgagacccaggcggggcaacatagcaagaccccatctctacaaaaagtgaaaaaattagccaggcgtggtggtgcatgcctatggtcccagctactcaggaagttgaggcaggaggattgctttagcctgggaggctgaggctgcattgagctacaatcacaccactgcacaccagcctgggtgacagagagaccctgtctcaaaaaaaaaattttttttttctaaaaaagaaaattccaagggttttaggaactctgcaccaggaagcaggggaaaacaccaagtatctttctttgctacacaaagccatggacaaagcataataatactaccttctgacattaaaggaggatttacatgttcaggtgcacttttcacactgcaggtggatagaatacagcccttttaacttatcagcctctatgataaagtattgcattaatccgtgtaggactgtctcattcaggaggccccagatggcaggtatgaaacactcatgtctgcatgtttgttgccaagcccagggcagacatgactaatcgatcttggcacattttcagagcaggaggtaaggctaggcagagcagcagaggctcgagtgtgagataggcagggcagaggcatgaatgttgagcctggctggcctgatttgttttcatttctgtgctcaaagtttgatctggagctgggttctgagctggatgtggaggatgaggttcctggaggcgacagcatgaagagcagagctgcagagcttgggagtgggaaaggtcctgcagagtcacaccggacccctctattcctccaaggctcatctaacatgttgagtgacatggcgtgggggtttagctgtactgcacattgcagaactccagggggcgctattgagataggaaccccatgatttcttctggaatctttccgagactgctgtggttaaaaaggcaggcctggctggacacagggactcacacctgtaatcccagtactttgggaggtcgaggtgggaggatctcttgagcccaggagttcaagaccagcctgggcaacatagcaagaccccatctctacaaacaacaacaacgaaagccttatatttcaacagctttgggttagttcctggagctgtcctttgtgggctgttacgagcccagacatacttctttgtgccttggtttcctccgctgttgagcattgtaagtgtggacgatgaagactgggaaaggatgtgtgtgaggaggtccttcacaggaacgcctgcctcatggagagggcgacacacagaggaaatggaaaatttacatgaaataaatataactgcagaacggtcaagttcaaaggagcactcaaaatcatctgggacagtccttccatttcacaggcaggaaaatgagagcacgatgggagaaaggcctcatcagagtcaaatgttttttgcagccagcatttattaaaggtttacatgtgacagcaacaaactgtgctgatctcacagggctgtttgagaattaaatgatgaaacacatgcaaatcgtcccaacctgagctatcaagtagagctatgtaacatgagccacatctattctatcattttaaattttctttctttcttttcttttctttttttcttctggagacacagtcttgctcttgtcgcccaggctggagtgcagtggcgcgatcttggctcattgcaacctctacttcccaggttcaagtgattctcctgcctcagcctcccagttagctgggattacagacgcgtgccaccatgcccagctaatttttgtatttttagtagagacggagtttccccgtgttggccaggctggtctcaaacttctgacctcaggtgatctgcctgccctggcttcccaaagtgctggaattacaggtgtaagccaccatgtccggcccattttaaattttctagtagcctcttcaagaaggtaaaaagaaacagtgaaatgatccattttctttaacccaatatatccaaaacattagcattttgacacatcgttaagaaaaaaattgttaatgagatatttgacattccttttgtcagactaggtctttgaaagctgctgggcgttttatactgagcgcattccaagttggatgcagaagtctcattagatgttaaaggaggcccggggcagtggctcacacctgtaatcccagcacttcaagaggccgaggcaggtggatcacctgaggtcaggagtttgagaccagcctggccaacatggtgaaaccctgtctctactaaaaatacaaaaattagctgggtgtggtggcacgcacctgtaatcccagctacttgggaggctgaggaaggagaatcacttgaatccgggaggcagaggttgcagtgagccgagctcgaaccactgtacttcagcctgggtgacaagagtgaaactccatctcaaaaaaaaaaaaaaaaagatattaaaggaaagaacttttcatacccagcttgttccaaacatacttcagagtttcccaataactgaatggagtaccagtgtttaaatttaagctaattaaaatgaaataaatattttaaatcatgctagccacacttcaggggctcaagagctatgatgtatgtttaatacattggatggtgtgagggtagatagcacccgataagcagcattaagaacatcaaaaatttttattgagcccgggcacggtggctcacacctataatcccagcattttgggaagctgaggtgggaggattgcttcaggccacaagtttgagaccagcgtgggcaacatagtgagactccatctctacagaaaataaatttaaaaatgagcagggcatggtgatgcacctggtgggtagtggtcccagctacttgggaggctgaggtgggaggatcatttgagcctgggggtttgagactgcagtgagccaagatcatgccactgcactctagtctgggcaacagagcaagacctgtctcaaaaaaaaaaaaaaawatatatatatatatatatatagactctatgtgacacaccagctcccttgccttctgccatgagtagaagctttttgcaccatgcttcttgtacagcctgcagaactgtgagctaaataaacctcttttctttataaattaatatatataatatatatttattgagtgaacaaatgaatataaagtcttttttttctttttttttttctttttgagatagagtcttgctctgttgcccaggctggagtgcagtggcgcgatctcggctcactgcaagctcagcctcccgggttcacgccattctcctgcctcagcctctcgagtagctaggactatagtagctgggactgcaaccacacccagctaattttttgtatttttagtagagacggggtttcaccatgttagccaggatggtctcgatctcctgacctcgtgatccgcacaccttggcctcccaaagtgctaggatcacaggcgtgagccaccacgcccagctttttttttttttttttttttttttttagatggagtcatgctctgtcgcccaggctggagtgcagtggcacaatctcagctcactgcaacctccgcctcccgggttcaagcgattcctctgcttcagcctcccgagcagctgggaccacaggcgtgtgccaccatgcctggctaatttttgtgtttttagtagagacagggtttcctgagtatccggcactagaggtacccaccaccacgcatgccatcatgcctggctaatttttctgtatttttagtggagacggggtttcaccatgttggccaggctggtctcgaactcctgacctcaggcaatcctcccgcctcgtcctcccaaagtgctgggattacatgcatgaaccaccacacctggccccgttcattgattttctaggattatgtgagttaataggtataaaagactaaagacagtttgttgctgtcacatataaaccttttaataagtgctggctgcaaaaaacatttgactctgatgaggcctttctcccatcgtgctctcattttcctgcctgtgaaatggaaggattgtcccagatgattttgagtcctccttcgaacttgatcrttctgcagttgtatttatttaatggaaattttccgtttcctctgtgtgtcgccctctccatgaggcaggtgttcctgtgaaggacctccttgcacacatctttccccagtcttcatcgtccacacttaaaatgcycaactcactctcttcctctgtcctccagggcaatatcttctctctacaccaatgatggtgacatggaagctctcgaggctgacctgaaacatcgatttacccgacaggagtgggacttggctaagagcctacagaaaaccatccaagcagygaggtctgagaattactctctgaccgacttctgggcctacatgkttrtctctaagcaaaccrgagaagtaagtcattcccagctggggacctggggtgggggtaggagcaaggggtctcagggtgtggggttaccaaagatgctgaccagcaccaccttttaagtccttcaggattttcaagtcatcaaaatctgggcacttcggttgatgcctcaaaactaaagtatatcaggattactgtggttgcaagtgacagaaattgactctgattcgtttatgcaacaaataaagtgatatgatttactagaaagatacacagacatccagggcaagaagaacaatgaggacttatgatggaataaggcagaaatagggaaagtgtcagacccaagacaactttcctctccatctctgcttggccatttgatgtcttgaattcactattttattttatttcattttatttttgagacagggtcttgctctgtcacccaggctggagtgcagtggygagatcatggctcactgcagcttcgacctcctgggctcaagcaatcctcttgcctcagccttttgagtaagctggggcaacaggcatgcaccatcrtgcctggctaatttttaattatttttttttttgtagagacagggatcttgctatattgcccaggctggtctcaaactcctgagctcaagcaatcctccaactactgggttcaagtgatcctcctatctcagcctcccgaagtgctgggattacgtgtatgagccactgcatccagcctatcctaacacwtcgggtttttgttgttttttgtttgttttgtttattcttgagacagggtttcactctgtcgyccaggctggagtgcagtggtgcaatcacagctcactgcagccttgacctcctgggctcaagcaatcctcccagctcagcctcccaagtagctgggactacaggcacacaccactgggcctgacaaatttttttttttttttttttttttttagagatagggtttcgcttttttgctcggggtggtctccaaatcctgggctcaagtgatccttccacctcagcctcccaaagtgctgggattatgggtatgagccactgcacctagcctatccaagcactttgggtggctgaggcgggaggattgcttgaagccatgagttcgagaccagcctgggcaacatagcaagagcctgtctctatcaaaaaataaattagccgggcatggtgacatgcatctgtagtcccagctacttgggaggttgaggygggtggattgcttgagcccaggaggttgaggctgyagtggcccattattgtaccactgcactccagcctgggtgacagactgagacccctctaaaaaaaaaatgtggcctacgtgcagaggttccaccctstgggacccacatgcctccctcacactgtcttggcacmttctcccaaagctgcyggagtctcatttgtccaatatgaagaagcccgtggaagaagggacactaccctacccratatttgcagccattgacaatgacctgcaaccttcctggcaggaggcaagagcaccaggtaagcaaacatttagagggagggagaggtartaagggatggaacrgcacrgagtggaatggaagaatgtttccctgccctccccttggggagcccaggaagagggaagggctcaggattgcagaaaacagggtgctcagcttagacgagagaagagggaagtcccagaagtgaccagaggacatgcacttgctttgcatggatcaagaaaacctttaagaggccaacatggtggctcacgcttgtaatcccagtggtttgggaggctgaggtgggaggatcgcctgaaaccagaagttggagaycaccctgggcaacatagtgagatcccatctcaaaacaacaacattaaaaaacmaaacaaaacaaaaaaacacaataaattagccaagcatggtggcaggaacctgaagaatctacccaggagactggggcaggaggatcactggagcccaggaattcaaggcttcggtgagctstgattgcaccattgyactacagcctgagtgacaaagtgagaccctgtccccccaaaaagaagaaagaaaaaagaaaacagaggagaggagggacaaaagamaaaaaggggccgggcgcagtggctcacgcctgtaatcccaggactttgggaggccgaggcgggtggatcacgaggtcaggagatcaagaccatcctgrctaacacagtgaaaccccgtctctactaaaaatacaaaaaattagctgggcgtggcggcgggcgcctgtagtcccagctgctcgggaggctgaggcaggagaatggcrtgaacccgggaggcggaggttgcagtgagctgagatcgcgccacagcactccagcctgggcgacagagcaagactccgtctcaaaaaaaaaaaaaaaaaaagaaaaaagaaaaaagtaaagaaaactgtaataagggatgtttgaaggatggcggggtgggtgggtggggctgtctctcacttttttttttttttttgagacggagtttctctcttgttgcccaggttagagtgcaatggcacgatctcggctcaccacaacctccgcctcccaggttcaagcgattctcctgccccagcctcccgagtagctgggattacaggcatgcgccatcacgcccagcgaattttgtatttttagtagagacgtggtttctccctgttggtcaggctggtctcgaactcctgacctcaggtgatccacccgcctcggcctcccaaagtgctgggattacaggcatgagccaccgcacccggccatctctcactttttagatgtcttccttctccataggtccrattatcacccaaatgctggcagctctccagacattccagtttctcttttgagctcatctctctcctgagatccagacctccttaccctatttcctaagcataaaatgcactcacttgttcagcaactgtgtcctggtaagttctcacgatacatcaggcaatgttaccagttacctgtggttgggcgtctcctggcatctcaaggctcagaagcccccagtgtgaatggtgtttgtctgtttgtttgtttgagacagagttttgctcttgttgcccaggctggagtgtaatggcacgatctcggctcactgcaacctctgcctcccaggttcaagtgattctcctgcctcagcctcccaagtagctgggattataggcatgcrccaccacgcctggctaatttttgtatttttagtagggatggggtgtcaccatgttaatcaggctggtctcgaactcctgaccttaggtgatccactcacctccgcctcccaaagtgctgggattacagacgtgagccaccacgcccggccatgaatgttttatctctctcctcggtgtggatccttgtgctgttttctcaccagagcagatacagctgactccgtcctttccataagccccacaaattcagtcattcccagacctagaaatcaccccctcctcattttcatcctttgtgctcttctacatcayccccagaccaggtctcccagtctcctgggagactcttgtaattagttcctcactggcccgcccatcccaagctgtccacctccttccctggctacctgatggaagtttccaggatgaaaatctgatcatgtcattttcttccctggaatattctaatgactcacattggaatcatgcattagatttatgcccacagacaatcctccatgcaatcgtgtggctacactcttcccttgcactccaggattccatggagttgcagccacaatgagatggaagararaggcagggctgagggttcaagctctggaaaatattggaaacaggctgctgtggaagttatgagctgccaccagcagcgtagactcaggtctgaggatgagatccccagtggtttctgataccacacagtccatctctaacattctcctgtcatggttgtaattyctcattaatagatttctttttcctgcatacccgctacattcctggttctgtgctgggactcacttgccgttgtatttcctctgcagagacctggttcgagttcacccctcaccacgctggcttcyctgcactgggggcctttgtttccataacccacttcggaagcaaattcaagaagggaagactggtcagaactcaccctgagagagacctgactttcctgagaggtcagcgctggggtcagaggggattaaaagggggtgggaagtggaggagaggcaagaattttccttctgagggtctagtttgcccagctcttaaatttcttgggggaaagaaaaggacttggtaggcttccagaaagaggaatggtgtattccttctgctgagtcttcagtgtctctcaaaggtctccttaatgcggcagatacctgatatcctatcaaacaatccaggagagggagcttaatagaggggctcaagtccagggctgtggcttccaataagcagattcagaatgtgtttgggattacatggtgctttgggaggctgacctgggaggatcccttgagactgggagtttgagaccaacctcggcaacatagcaacactgtgtctctacacaagatttaaaaattagccaggcattgtggcatgtgcctgtggtcccagctactcaggaggctgaggcagtggaaggatcacttcagcatgggagttcaaggctgcagtgagttatgatcgccccactgcactccagcctggatgacagagaaagatcttgtctcaaaacaaacaaacaaacaaacaaacaaacaaaaaactagaatgtgttttgggcaccagcaaagcaaggggcatacaattttttttaaatggggyatttccagaaaaaattacaacaaaaaccaaaaacaaaacagtcatagtgagtaaaatcagaacttgattaaatgtccttgactgtagcttacacactggtatcacttttagttgtggcttcataatcttctcagcattcagggtctgaaggcattaccctgctgggcagacagctcccctacataggaccaaccatgccagcttgagaaagtcattaatgttacctgagcctcgtttttctcatagggaaagtacttacctcaaaatgtgggtgtgagagttaggtatgatccacaaataaaacactcagcccagtgtccagcacatggtaggaaattaaggatggttgactctccatgattttagcatacacttttgagacacactaggagcctgatactattttaaatgcaggggattcagtcatgagcaggacagtgaaggctcattccctaatgaagtttgcactccagggaaggagatgatgaatgaacacacacaaaaataagtatgtattataatgtcagatcatagtaaatgctatcttgaaaaataattcatggtaagggactggagagtgactacagtattatttttaattggtggtcagagcttctgacaggagatggcctttgagcatggacctgatgaaaagtgaagccatgcagatatcttagaggaaaagcatcatggacagagggaagagcaaatgcagagaccctgtattagtccgttttcatactactataaagatactacccgagactgggtaatttgtagacaaaggaggtttaattgactcacagtttcacatggctggggaggcctcaggaaacttacaatcatggcagaaggtgaaagggaagaaagaaccttcttcaagtggtagcaggagagagaagagcaagccaaagaagagctgcccaacacttatcaaaccatcagatctcgtgagaactcactcgctatcacgagtacagcatggggggatctgcccccatgatctgattacctcccaccaggtctctccctcaacatctggggattacaactcgagagatttgggtggggacataaagcttaaccatatcagaccctaagccaggaccaagtttgtcttactctagaaccaatgagaagaccagtgaggctggagcctcctgaatgaggctgagagagagggctagagaggtaggcagggtccagatcatatgggaccctgaaggacacagatgaagtttagtttggattccaagtgcgataggagagccagggaggcagtttaattagggtggtgaccgattcagtttatatggtaaaacatctcactctctctctctctctctgagcatggattaggggtgggtgtgtaaacttagaagttgggagcagttgagaagctaatggtcctggtgacagataatggcagtttaaggttgggtaccagaatggatatgggagggaagtggatggactctggaaacctggagatggatgaagaagaattacacctggattggatgtggagagtaaggagaatcagagatgacatcaaaggttccagcttctgcaacctggtagatggaggggtgttctcaggggaggagaacaaggtaggatgaaggggatcttccccttttctctggtctggacagacggggtccttcacattgccaagcctggctcctgtctcctatccccaccatctctttgctaaatctggtcttgggcatcagagattttgaaattgtcactcccaggtactccctataacattattatttccttagatgtatgtatcacctactgaagggattctgtacrtgtattttatccctcccctcacacaccagggtgctttttatttattattataaaataaacataacataaaatttgccattttaaccattttaaagtgtcaagtacagtggtataaatacaatacattcataatgttgtgcaaccatcactgccatccatctccataacacttttcatcttgtaaaactggaactctacgcccattgaatactaagtccctgtcaccccctcccttagcccctgacaaccacaatgctaccttctgcctctacgattttgactactctgagtatgacatgtaaatggaatcatgcagtgcttgtctttttgtgtctgtctgatttcactgaggaaaatgacttcgaagttcatccatgttgtaccatgtgtctgaatttcctttctttttatggctgaatcatattccattgtacgaatataccacattttgcttatcaattcatccatcgatggacacatggattgctttcaccttttggctgttgtgaaggaacctgccatgcacatgggtctatgaatatctctttgagaccctgctttcaattcttttgggtatatactcagaggtagaattgctggatcatgtatgtggtaattctacttttaaaattttgaggccaggtgtggtggctaatgcctgtaatcccagcactttgggaggccgaggcgggtggatcacctgaggttgggagttggagaccagcctgaccaacatggtgaaaccccatctctacaaaaaatacaaaattagccgggcatggtggtgcatgcctgtaattccagttactcaggaggctgaggcaggagaatctcttgatctcgagaggcggaagctgcagtgagcggagatcgcgccattgcgctccagcctgggctatctcaaaaaaaaaaaaaattttttttttgaggaacgaccataccattttccacagtggctgtaccattttatattctgcccaatggtgtcccaggtttccaatttctccacgtcctcatcaacacttattgttttctggggttttttggataccagccatcctaatgggtgtgtctttttttttttttttttttttttttttgagatggagtctcactctgtctcccaggctggagtgcagttgtgtgatctctgctcactgcaacctcccaggttcaagttattcccctgcctcagcctcccaagtagctgggactataggtgcataccaccaggcctggctaatttttgtattttttagtagagatagggtttcaccatgttagccaggctgactttaaactcctgacttcaawtgatccgcccacctcagtctcccaaagtgttagcattacaggcgtgagccaccgtgcctggctgattattcattttttatgtctccctgtatcatatacaratgtgtttggctaaaagtcactaaccaaccacagtgccccgaggacatgtgggattaattttcttacaaaagaaaaagacagactgagcaccgtgactcacagctgaaatcccagcactgtgggaggccgaggcgggcagatcacttgaggtcaagagttcaagaccagacgggccaacatggtgaaaccccgtctctacttaaaaaatacaaaaattagcagggcgtggtggtgcatgcctgtaatcccagctagtcgggaggctgaagcaggagaatcacttgaatctgggaggcagaggttgcagtgagccgagatcacaccactgmactccagcctgggcaacagagcgagatcccatctcaaaataaataaataatacaaagttaggtggctggtgacattggtttagctgtgcaacattaagcagaaggacccaggtttattctagattttctgctcctccatccttagcatattaagtcaccctcatgctgaactcctccacaccacgggatggcggctgcatccaatgaarctgcaactttttttttttttttkgaagtcagggtctctctctgtcactcaagctgccgtgcaaaagcacagtcatagcccaatacaggtcttgaactcctggcctcaagtgatcttcctgcctcagcctcccaagtagctgagactagagttgcatgccaccatacctggcctgctccttctgagaaggagaacaagcactttgcagaagtccccccagcagtgtgcatggaccagagcttgaccgtcccctagctgcaagggaggctgggaaatatttgcccttcctgcctgtgtgctgagaagggttggcatggacrggagcttgaaatggccttggggtagccagtctacagtgcccggctggctccacccatagaaggttcgtgaggacaaggacyttatctgtcttgtttactgctctattccaacagccagaagagtgccgggtgcccactaattgcttcataaatatttatggaatggaagaawgatctttcttcctgctgcagatccctgcagtgctttatgccagtctgctggtgctttgaatatcaarcatgacagtcacgtgatggagaatgtttgaattttattgctcttttcttggcaggtttatggggaagtgctcttggtaacactgaagtcattagggaatacatttttggtgagtatttggggaacagaamggtcaaascctagagatattttatgcaaggagattcacagtacttttcctactcatggcagaagagagacctgtgtgtaattgttctagcaactgcttttcctgacatttattctcatataattgggcagccaggatgaccacagagtggatgagagtacagactcccttggaaggaatgttgctctggtacatgtaagctttgtgacctccgaaaagttacttaacctctctgtgcctcggtttctgcctctgtgccatgcgggtgataataacagtagttatgaatatttgatgagttaattcattgaaagcttgtaggacagtgcctggtagataacggcactcagtaaacattagcaatcattacctggtccctcatttaacatttaacccctttaataccctaagaggcagacgcttttgtcccttccattttgctgagatccaccaagtcgtgggaaggatgcgtgactcacccacactgctggtcagtgagtgcagacgcggggatctataggagaactgggtggtggatctctaggggaatagtgtggtggttctgatccaaagcctgtctgcctggatccacatcccggctctgcttctcctgcactgctcactctggaaagctgcttaaattctctgtgacccaatttccccttcctaaaatggagacaatagtacgtagtcgcagtctcgtatatttgatgtggggtttaaatgacctcatgtatgtaaaatgcttagagccaagcctgacacatgggagtgtttcattacatgttaatcttatttttaggatcattactgagttcacaccctaaaccactcgtcattcatttaatgtatattcatgggacctcctgtgtgccaggcactgtcctagttcttacactttgactttttttgttgtttgtttttttgagacagagttttgctctgttgcccaggctggagtgcagtggtatgatctcagttcactgcaacctccacctcccaggcttaagcaactctcctcccgagtaactgggactacaggcgcgcaccaccgtgcctggctaatttttgtatttttggtagagacaggatttcaccatgttggccaggctggtcttgaactcctgacctcaagtgattcactgcctcagcctcccagtgtgctaggattacaggcataaaccaccacgcccgggctgatgttgttctttgacattggtgttcaccatagcttggttaaaaacaaaactaaaaagggaatctatctatatccaacctccaaatggctaactaaaggtgtgagatgggtctgagtgttacttctccagtgggtctgctaagctttctctctaaaaaacaaaaacaaaattcctgatatgtagtgtttgccaattcctgtggtgtaaatgttcccaccgtggccaacttcaggctaccaacatgaggtcactgagcacagagttggaagagaggtgcaaaattggctctcgagagccattggctgccattggagcccatggctgccatttctattaatgaaatatccctgcaggtcatctgtattttttatattataactagggactttgttgtacagataaacattcctcctgcttctactcttttgcagaccagttaaggaatctgaccctgaaaggtaagcatcctacttcatcatgaatccctgatgataatggggaccgcacacttgcttgaggccagccattgtcctaggaacattacatgtatgattcatttggtgcccatttgaattctttatctggtatttcaaagatttcatcttgatttggatctgttgctggagaggtagtgtgatcttttgggggtgctgtagaaccatgttttgtcatattaccaaagttacttttctgattccttctcatttgagtagactatttcttttaattattcttgaatttatgttggatttgactgtgttttttttttcttttttccgcttaaggatgtgactttaatgtccctagctaattatagcctaatttggtccttggtgctttcaggggtgaagattgtaagagttccttggatatagggagtcttcgtgtgatggctttctcatatgctggttgtagaagcgatgtgctcactgtgtgagcaagttcactgttgcctacagggctggaatggtagaagactcttgaagcttaactcattccccacaaggcatgcaattttttycccagtattttattgactggtttgatggttcaggcttcaggtctgtaggggagtgcataggaagtgattgtggccaaaacatgtgagtaaatgcaacacccaatggtgagcaaaggtcccagccttgacagaggtggctggaggagctctcagtgagttgcatcgagattttttttttttttttttgagacagagtttggctcttgttgcccaggctggaatacaatggcatgatctcagctcaccccacaacctccgcctcccaggttcaaggaattctcctgccgcagcctcctgagtagctgggattgcaggcacttgccaccatgcccagctaattttgtatttttagtagagatggggtttctccgtgttggtcaggctggtctcgatctcccaacctcaggtgatccgcccacctcggcctcccaaagtgctgggattacagccgtgagccaccatgcctggctgtgcaccgtggtcttatcaggcagaagggttggagccacctcagctcccctgccaggtcagccagaaagccatccatctctcagacacactcgtgatccagtgctccagctattcagatcagacgggcacctcttttcatctgtaggaatgttggtgttctgagtagagaggaactgtgaatctgtctcttatgcaagcctaaacctagaggggctcctcctgtggggatgcagtcgccctgatatgttccagaaaggctgtctatagttgtacccatgctgagctcccatgggagaaaccccaactgtgcctgtggcagtggaagagaggggaaagacatccccttatccaagacccttcatgcacaccagggctgtctgatggttgggttagagctgtgggctttccgtgctgagcccagcactgaaactgtgtccctgctgaaagaaacttcccaccagcagaaagatctgattttcaagtcctgctgtccagattcttttgtcccatggggtgttcccttgatgtggtgcactccccattcccctaggataggagtcactgagcaccagactacagtgagtgttattgttcctctgggtctagccacccagtgaagctgccacacttcaggctggttcttgggaatgtctccaaggaatccggtaatgtcccctgtcctcgagactcccagcaatgggaagcagcaccagctctaatgggggtggcaggagagagacacaggctctgtgagattccttgctgatggacagccttagtaggttggcttccttgaatgctagttatagtagtaatgaactgatcatgtggacagactcaggacctcctggttagccagagtggtgcatgcagtggtgatagctgaggacatagagccattttctccttcctgggcccagtgttatcctaccaggagatgctgtcatggactgtgttggttggcctccacccagcaggtggagcaccagctgcagtagtagcagtgggatattcacttgccctatgttgcccagggtggctactcttgtttctcaggcaatgggcagagccacagagttcccaaaagtttccgtcctttgtattaaagccaccagggcgggtggcagggcaaagccaggtgtgggctgggtcaggcagttttgtgctctaactctccctgtgcagggcaagcagcagctcctgtgggtatcagggggtgggggtggttttcagacccatgtgctgataatccagagaggaatgtttctgcctctgctgcacagaagagtttgtgtagggagtggggagtggcaggtggcagtaagccccacgcggatcccacacacttggcgaggcagatcccctcccaccctgttccactggcagtggtgagctaagttccaggcagcctgtgctcagaacttgcaaatgcccccaagtcataagctttccctgcagagatagcaaccactgctctcaggccatgcccctccccatctatcccacctagccatgtgccagggtcctgcacacgtgtctgcagcttgcttttcattcaccccatgtgggtggagaagttcacctccacccacagttatctcatgaaacccagctgggggcttctttcaacctgcgaccacccacctgaactttttggctgaccactgcagggtgccctgtgaggaacaataaggaatggcttccctgggtccatactgggatctgggagtgcatgcagggttcttcccacagctcctacttatattccacgaacctccccaagtcatatcctgcactgaatagggttaaggccttaccccagagactggactttcaggctccctggtgtggtgggggcgtgtgtcctgcaaacagtctttccccatctcacaccctggggactcgcagcccttcacttgagtcacagtataggctgcagcccgtcacttccttcaaagggactgtggattccttcagatttcctgtctaattcctgaatcacttcttgaaaaaaaagttcacagtgtgaatctctacacagtgttttgtccttccaagtgggaggggtatgccagcaatgcctctaatccaacatgtttgctgtcctgctctttcatagtaggacagctaggactttccagaagtgcccccataaatctgcatgggccagagcttgacctccctctagctgcaagggaggctgggaaatatttgcccttcctgcctgtgggctgagaaacgttggcatggaagggagcttgaaatggccttggggtagccagtctacagtgcccggctggctccacccatagaaggttcctgaggacaaatctgtcttgtttactgctctattccaacagtcagaagagtgccgggtgcccactgattgcttcataaatatttatggaatggaagaatgatctttcttcctgctgcagatccctgcagtgctttatgccagtctgctggtgctttgaatatcaaacatgacagtcatgtgatggagaatgtttgaattttattgctattttcttggcaggtttatggagaagggctgttgctaatgctaaaagcattggacaccttatttttggtgagtatttggggaacagaaaggtcaaagcctagagatattttatgcaaggagattcacagtacttttcctgcatgtggcagaaaagaggcctgtgtataatggttctaacaaccacatttcctgacatttattctcatacactgaacattgattatgggcagccaggaagaccacagagtggatgagagtacagacacccttggaaggaatgttgctgtggtacatgtgagctttgtgacctctgaaaagttacctaacctctctgtgcctcagtttctgcctctgtgccatgtgggtgataataatagtagttatgaggattaaatgagttaattcatcaaaagcacataggacagtgtctggtagataaaggcactcagtaaacattagcaatctggctggatgcagtggctgacacccgtaatcgcaacacttgggaggctaaggcgggcggatcatttgaggccaggagttcaggtttctgatcctggccaacaggtgtgtggagctggtgcctgctacttccaggcctggctacaaaaggccttctgtggctctccagctctctcctctcatggaacagacaaggagaccttgtgccaagaggagaagctcttaaacccaggaggcggaggttgcagtgagctgagatcacaccattgcactccagcctgggcaacaagatgcaagcagcctggcccggcgcagtggctcatgcctgtaatcccagcactttgggaggcccaggcggacagatcacttgaggtcaggggttcgagtgcaagctgggtaacatggtgaaaatgcgtctctactaaaaatacaaaaattagcyaagtatggtggtgcacgcctgtgatcccagctactcaggaggttgaggcacaagaatcgcttgaaaccaggaggcaaaggctgcagtgagctaagatcacaccactacagtccagtctgggcaacagagcaagactccatcacacacacacacacacacacacacacacacacacacacacacaaaattggcattcgttacctgttcatcatttaaccctttgaatgacctgaagaagtggatgctgttgtcccctccattttgctgagagccaccgggtcatggaaaggatgcgtgactcacctatgtaactggttggtgagtgcagacacagggatctataggggaatcgtatggtggttctgatccaaagcctgtctgcctgaatccacatcccagctccacctctcatgcgttagtgaccctagaaagctgcttaaattctctgtgaaaaaaattaaaaaataaagaaatgaggggccgggcgcagtggctcacacctgtaatctcagcactttgggaggctgaggtgggcagatcacctgaggtcrggagtttgagaccagcctgaccaacgtggagaaaccccatctctactaaaaatacaaaattagccgggcgtggtggtacatgcctgtaatcccagctacacgggaagctgaggcaggagaatcgcttgaacccaggaggtggaggttgcagtgagctgagatcacaccattgcactccagcctgggcaacaagagtgaaacacagtctcaaaaaaaaaaaaagaaaaaagaaaaagaaaaagaaaaaaaagaaatgaaacaamcaaaaaaaaaaaaaaaaagaaaagaaaatcaacaacaacaacaaaattctctgtgacccaatttctcctttgtaaaatggatacaatagtgcatagccccaatcttgtatatttatatcaaataaatgtaaatatacatcaaatatacaagattgggactatgtactatttgatgtggggtttaaatgacctcatgtatgtaaagtacttagagcaaagcttgacacatgggagtgtcctcttaaatgtcaatattatttttattatgtcttgtattgttagaaaaagcaagccagggccaggcgcggtggctcacgcctgtaatcccagcactttgtgggggccgaggcgggtggatcaccaggtcaggagatcgagaccatcctggctaacatggtgaaactccgtctctactaaaaaatacaaaaaattagccgggcgtagtggcgggcgcctgtagtcccagctactcgggaggctgaggcaggagaatggcgtgaacctgggaggcagagtttgcggtgagccaagatcgagccactgcactccagcctgggcgacagagcgagactccgtctcaaaaaaaaaaaaaaaagaaagaaagaaaaagcaagccgggcacagtggctcacgcctgtaatcccagcactttgggaggttgaggtgggtggatcacttgaggtcaggagtccgagaccagcccagccaacatggtgaaacctcgtttctactaaaaatataaaaattaactgggcatggtggcgggcgcctgtaaccccagctactcgggaggctgaagcaggggaattgctcgaacccgggaggcaggggttgcagtgagccgagatcgcaccactatactccaggctgggcaacagatcgagactgtgtctcaaaaaaaaaaaaaaaaaaaaagaaagaaagaaagaaaaagaaaaaaaagcagacaaaatttatttattgacaattcaaaaatttgaaaaagatgaagcagaagcttgacctaaccgacgtgtatcaggacttagctttctatcgcattttcagcacatgtggaaaaattgaattttgatttggtctcaagtaaaaagttataacatgtacaatattttaattataaggatcaacactgctactattaggtaataatatttttaaatattaagatttttttgtttttttttgaatttttacttcaatagcttttggggtacaagtggtttctgttacacgatgaattatgtagtagtaaattctgagactgtartccacccatcagtgtatgttttagagtatgttgcattcaatatgtagttttttggttttgttttttgtgacagtctcactctgttgcccaggctggagtgcagtagcaagatctcgtctcactgcaacctctgtatcctgggttcaagtgcttctcctgcctcagcctccctagtaggtggaattacaggcacgtaccaccatgcccggctaatttttatatttttagtagagatgaggttttgccatgttggtcaggctggtctcgaacttctgagctcaagcaatctgcccgcctcagcctcccaaagtgctgggattacaggcatgagccaccacacctggccccaatgtgtagtgtttttttgtttttgttcttgttttttgagacggaatttcactcttgttgcccaggctggagtgcaatggagcgatctctgctcaccgcaacctccacctcctgggttcaagccattctcctgcctcaacctcccgagtagctgggattacaggcatgcaccaccatgcctggctaattttgtatttttttagtacagacagggtttctccatgttgctcagactggtctcgaactcctgaccgaaggtgatccacctgcctcggcctcccaaagtgccgggattacaggcatgacccaccactcctggccccaatgtgtagttttttatccccacctccctaccctcctctttctgaatctctgaagtccgttatgccactctgtatgcctttgcgtacccatagcttagctcccacttataagtgagaacatatggtttttggttttacattcctgagttactttacttagaatgatggcctccatccaagtttctgcaaaagacattattttattcttttttatggctgagtcatattccatggtgtttatataccacatattctgtatccactcatttgtcaatgggcacttaggtgggttcatatcttttttttttttttgagacagtctcactctgtcacccaagctggagtgcagtggcgcgatctcggctcaccgcaagctccgcctcccaggttcacgccattctcctggcccagcctcctgagtagctgggactacaggcacccaccactgcgcccagctaatttttttttttttttttttttttgkatttttagtagagaccggtgttagccaggatagtctcgatctcctgacctcatgatccacccgcctcagcctcccaaagtgctgggattacaggcatgagccaccatgctcggctggttccatatctttcaattgtgaattgtgctgctataaacatacatgtgcatgtgtcttttttttttttttttgaggcagagtctcgctctgttgcccaggctggaatgcagtggtgcaatctcactgcaacctccaactcgtgggttcaagtgattctcctgcctcagcctcccaagtagctgggactacagatgtgcaccaccgcatccagctaatttttgtatttttagtagagatggggtttcaccatgttggccaggctggtcttgaacgcctgacctcgagtgatctcccctcctcagcctcccaaagtgttgggattacaggcgtgagccactgcacccagcccacaagtgtctttttcatataatggctgcctttcctttgggtagatacccagtagtgggattgctggatcgaacggtagatctacttttagttctctgaggactctccatactgttttccatagaggttgtactaatttacattcccaccagcagtgtgtgagtgttccatttgcaccgcatccacaccaacgtctatggttttttttgaatttttatcaatggccattcttgtgggagtaagatggtatctcattgtggctttcatttgcgtttctttaatgattagtgatgctgaccatttttttcatatgtttcttggccactggaatatcttcttttgagaaatgtctattcatatcattgggatgcttttcggtgggattattcgttttcttcttgctgatttctttgagttccttataggttctgtataatcgtcttttgtggatgcctagtttgcaaatatttgctcgcattcagtgggttgtgtgtttactctgataattacttcctttgctgtacagaagctttttaatttactcaggkcccatatatttgtttatttttgagacggagtctcactccatcacccaggcttcagtgcagcagcacgatctcggctcactgcaatctccgcctcccagactcaagcaattctcctgcctcagcctcctgagtagctgggattacaggcatccaacaccatacctggccaatttttgtatttttaatagagatggggtttcgtcatgttggtctggaactcctgacctgaagatccgcccagctgggcctcccagagtgccaggattacaggcgtgagccatcgttcccatatatccatatgtttatttttgtttttgttgcatttgcttttgggctcttggtcatgaactcgttgcctaagccaacatctagaagagtttttttgatgttatcttctagaatttttatggtttctggtcttatatttaagtctttgatgcaaattcacattgaatttgtgagttgatttttgtataaggtgagaaataaggatcgagtttcattctcctacatgtggcttgccagttatcccagcaccatttgttgaataaggtgtcctttcccccactttatgtttttgtttgctttgtcgaagatcacttggctataagtatttggctttatttctgggctctctattctgttccattgttctacatgcctaattttataccagtaccgtgctgttttggtaactataggcttgtagtataatttgattgggtaatgtgatgcctccagatttgttctttttgcttagtctttgctttggctatgagggctcttttttggttcatatggattttgggattgtggctgggcatggtagctcacgtctgtaatcccagcactttgggaggccaaggcgggtggatcacctgaggtcaggagtttgagaccagcctggccaacatggcgaaaccccatctctactacaaatacaaaaattagccaggcatggtgcatgcgcctgtaatcccagctacttgggaggctgagacaggagaatcgcttgaacttgggaagcagaggttgcagtgagccaaaattggccattgcactccagcctgggcaacagagcgagactaagtctcaaaaaaaaaaaaaaaaaggattttaggattttttgttctgtgaaaaatgatagtattttgatgggaattacactggacttgtagattgcttttggcagtatggtcattttcacaatattgattctacccatccatgagcatgggatgtgtttccatttgtttgtgtcatctatgatttctttcagcagtgttttgtagttttccttgtagcagtctttcacctccttggttaggtatattcctgagtattttattttatttttttgcagctgttgtaaaaggggttgagttcttgatttgaatctcagcttggtcattgttggtgtatagcagtgctactgtttgtgtacattgattttgtatcctgaaactctactgaattcattcatcagacctaggagctttttggatgagtctttagggttttctaggtgtacaatcatatcatcagtgaacactaacagtttgacttcctctttactggtttggatacccttcatttctttctcttgtctgatggctgtggctaggacttccagtactatgttgaatacaagtgataagagtgggcattcttgtcttattgcagttctcagggggaatgctttaaacttttccctgttcagtgtaatgttggctgtgggtttgtcatagatggcttttattacattgaagtatgtctcttgtataccgattttgttgagggctttaatcataaagggatgtgggattttgtgaaatgcttctgcatctcctatgatttttgtttttaattctgtttctgtgatatatcacatttgttgacttgcatatgttaagccatccctgcattcctagtatgaaacccacttgatcacatcatggcaaatttcaagctaccaacatgaggtcascgagcacagagttggaagacgggtacaaaattagctctccagaacccgtatcaacagactccaacccatggctgccatttctattaaagagacgtcgctgcaggtaatctrtattttctataactagtgactttacagttaaacattccccctgcctctgctcttttgcagcccgattactgaggctgcaagaaagttcacaaggggaacatcctcccccagaaggtaagcatcctactttgccatgaatccctaatgatagtgtggactgcacactggcttgaagccagccattgtcctaaaaactttacgtgtctgattcatgtggtgctcctttgggaatggagaggagcatggactctcccaggtgcctgaggccacgcagccaggaggggcaggatcggagttcaaactgacactctgtgaaaaatgatagtattttgataggaattacactggacttgtagattgcttttggcagtatggtcattttcacaatattgattctacccatccatgagcatgggatgtgtttccatttgtttgtgtyatctatgatttctttcagcagtgttttgtagttttccttgtagcagtctttcacctccttggttaggtatattcctgagtattttattttatttttttgcagctgttgtaaaaggggttgagttcttgatttgaatctcagcttggtcattgttggtgtatagcagtgctactgatttgtgtacattgattttgtatcctgaaactctactgaattcattcattagacctaggagctttttggatgagtctaaccataggatccatgtacatagtcgtcagatataccctaggtatgcctaggatccaagtgtcagaggcagaaaatgggaacagcctgaggcaattagcaaattgagaggaaaaatacttcccaaaactacataggttgggagtcatgaaggaatcagacttgacccatggtgggagtacggagaacaagaacaaagtatcagatgaattctgtatggagaagttagattatattatggaggagactatatttgttcaggagaggctatgctgcgcaaagaaaccacaaattgctatagcttaagacacaaagggtttatattttgcttacccaaaaagcgatatgggttgagtgttcctccagggcaacttggctccatgtggggacttaggcatccaagctgtttgcgtcttttttttcctttccttttcttttttcttttttttttttggagacagagtctagccgtgtcacccaggctagagtgcagtggcataatctcagctcactgcaacctctgccttccaggttcaagctattctcctgccccagactcctgaatagctgggattacaggcaactgccaccacacctggctaatttttgtatttttagtagagacgagttttcactacattacccaggctactctcgaactcctgacctcaagtgatctgcctgcctgggcctcccaaagtgctgggattacaggtgtgagccaccgcgctgggccaagctgcttgcatctcgttgcttctcctcttggcacaaggtctccttgtctgttccatgagaggagagagctggagtgccacagaaggccttttgtagccaggcctggaagtattgggcaccagctccacacacctcctgttggccaggatcagtcacatggccccaacctaactacagcagaggctgacaaagatggtcttccttccagttgtggaagatgcaagtgtggctttttcacaggtcaacagtcaggtacagagtgaaggtaggtcctgagcacagcccttcatccacttcatgcctccctccctgttttagttgtgaaggctgccagaacaaagtgccatacataggctggctggcttagcaacaacagagattaatttctcagttctggaggctggaagcccaagatcagagtaccagtagggttggattctggggaaccctcttctgggttgcagagagccaacttcttgccacatggcgggctttaatgttgttttttgacaycagcattcaccatatgctggttatagacaagtctggaaggagaatctatctccaacctgcaaatggctaactaatgttgtgggatggtaggctggtgattgtaccactgcactccagcctggtgacagagcgacaacctgtctcaacaacaacaacaacaaaaaagaaatggcaaccccaaggtgatggtattaagagatggggcctttgggaggtgttgagaccatgagggtggagccctctwgatttggattaatcccttataaaagaagcctcagagagctcactccaaggaatgcggtgaaggttgaagkgtagaatttatgcaaaatgccaagatgagcctggcaggtgacgttctcagcaaacgtgagcagagctattatcagtgtgtgtgtgtgagagagagagagttgaacatcatctaattcatgagtgtggataaaaataagaggggatgccaggcatgatagctcaatgcctgtaatcccagcactttgggaggctgaggggggtggatcacttgaggtcaggagttcgagaccagcctggccaacatggtaaaaccccatcagtactaaaaatacaaaaattagccgggcctggtggtggtgcgtgcctgtagtcccagatactccagaggctgagccaggggaatttcttgaaactgggaggcagaggttgcagtgagctgagattgccccattgcactccagcctgggcaacagagcaatactctgtctcaaataaataaataaataaataaataaataaataaataaataaataaatgggagmctttgcctccaaccctgaagaaaataagcgtgcaaaagatgagtagaggtggaggcagagatgaaggagctagaaaaaagaggccagaaagtcagagagagtgaggtaacatgggggtcagcagaaggcaaggggagagagggtcacctggagaaggaggtcacctcaggaggaaccgcagggcattgcagaagatgaggcagagcagggtctgtgatgttcttggtagggtacttggacagtgtctgagaccacctggatttcttgacgtagatgaaggcggtgagcctgaacacacctggctgactgagatgctcgagaaytggaccaggacctccctggaaaagcaggagcagccccatgaggaccccgaaaggaaaggtaccatgtgtagtgtgataagtgtcatcaacagtaagtgccaccaaccttctcccccctcttgctcttccccacccctgtgggccagtcctgcaggggacatgaccagatgtcccactggtacagtttggatatttgttcccttccacatctcatgttggaatgtaatcccccaatgtaaattagttcaaccattgtaggagacagtgtggaattcctcaaggatctagatccagaaatactatttggcccagcaatcccattactgggtatatgcccaaaggaatgtaaatcattctgttagaaagatacaggcacatgtatgttcactgcagcactattcacaatatcaaagacatggaatcaacccaaatgcccatcagtgatagactggataaagaaaatgtggyacatatacaccatggaatactatgcagccagaaaaaggaacaagatcatgtcctctgcagggatatgggtggagctggaagtcattatcctcagcaaactattgcaggaacagaaaaccaaacaccacatgttctcacttataagtgggagctgaatgatgagaacacatggacrcagggaggggaacaacacacactggggcctgttgggggcgggtggggagaagaagagcaccaggaaaaytagctaatgcatgtggggcttaatacctatgtgatgggttgataggtgcagcaaaccgccatggcacatgtttacctgtgtaacaaatctacacgtcctgcacatgtgtcccggaacttaaaattaaattaaattaaattaaattaaaagaaaaagaaatgtaatccccagtgttggaggtggggcctggtgggaggtgattggatcatgggggcggatccctcatgaatggcttagcgtcatccycttggtgattagtaagtgcttgctctgagttcatgtgagatacggttgtttagaagygtgtggcaccttccccctcrctctcttgctcctgctctcggcaagtgatgtgcctgctccccaytcactttccatcatgattggaagcttcctgaggccccaccagaagcagatgccagcaccacgcttcctgtacagcatccagaactgtgagacaattaaacctcttttctttataaattatccaacctcaggtacttctttatagtaatgcaagaatggactgatacgcccaccctctatccacccaaccggccatccatccatctaggatgtcttgagtcattagcatgaaataataactctcctactagcaggctgggggtaggggtgacaaaggggaaatgtcagaccaagtgcctgcctggaggactcatggtctagaggacgagatggagaatagacaggtaagccaaccacaggcaagtccatccccgactgggctaatttctatggagagggctgggtgcagtggctcacacctgtaatcccagcactttgggaggctgaggcaggaagatcacttgagcccaggagttcaaaaccagcttgggcaacatagcaagaccccatctctacaaaattttttgtaaaaaattagctggacatggtagtgcgttcccatggtcccagctactcaggaggctgaggcaggaggatcacttgagcccaagaggtcgaggctgtagtgaactatgattgtgccactgcattccagcstgggtgacagagcaagaccctgtctcgaaaaaataataaataagtaaattatatggagagacaaggagaggcgagagcaggtatccggtgaaaaattctgagagtgaagtagcgtggatgagggacaatgaagacagttggtcgctgaagccactgccttcctgagatgacccaggtacagccagtctcacccccagacatccaacctctcacctctgtgatgacccggtgtccaggcacagacacacccagagtcctcctgaccagctcatcagcagctcaccaaggaaaggaaatcaaggtgtactctcttcagactctagatttcccttcctcctccttttattcatgttacataaattcctgtttttatctctgttggatgaaatcagtctattctctggtttcctttgtctacaatttaaagagggagccgactattaacttgatgtctctgagctattgttggccaagctccccttagatgggattaatgaagaagcctccttttccaaggtgatagctcagaagcaacttgaagaatgagtgacaatgagcctaccaagtggaaatgtggggaaagtcagccagagttcatctactgacttcagtctggcagatgagaggcttgggtttacccctccggtgggtaatggagagagatggaatgtgccacacgaagcctcactatgactttctataatgcctggctcctgtgctgaaatgagaacatgcatcctagccggscatggtggtgcgtgcacctgtagtcccagctattcggggaggctgaggtgggaggattccttaagcccaggagttggaggctgcagtgagctatgaatgcaccactgcactcagagtgagacccccatcccttaaaaagttttcttttaaaraacgtacttttttttgttttgttttttgtttttgtttgtttgtttgagatggagtctcgctctgtcacccaagctggagtgcggtggtgcaatcttggctcactgcaacctctgcctcccgggttcaagcgattctcctgcctcagcctcccgagtagctgggaccacaggcatgcaccaccacacccggctaatttttgtaattttagtagagacagggtttcatcatattggccaggctggtcttgaactcctgaccttgtgatccgcccacctcaggctcccaaagtgctgggattacagatgtgagccactgtgcccggccaattcttaacttactataagatatacttgagcccaggtattcaagactagcctggaaaacactgtgagacctcatcttttttaaacaaaattaataaatagataaaacrtttaaaaaagccaggtgtgatggctcacgcctgtagtcccagctactcaggaggctgaggcgggagggtcgcttgaggccaggagttcaagaccagcaagcctgggcaacgtagtgagacctcctctctaaaataaataaataaaaatataagatagaatggccgggtgtggtggctcatggctktaatcccagcactttgagaggccraggtgggcggatcgcttgaggtcaggagcttgagaccagcctggccaacatggcaaactctgtctctactaaaaatgcaaaaatacaaaattcgccgggcgtggtggcacatgcctgtaatcctagctacttgggaggctgaggcaggagaatcgcttgaacccgggaggcggaggttgcagtgagctgagatcacgccattgcactccagcctgggcaacaagagtgaaactctgtctcaaaaaaaaagaagaagtatggagtcctcaggccacatttagttttctttaacatgttaaatattaaagggctatcaaagcaatgtaggtgtgatttgcttttctgctgctaaactcttgtagaagttaatatttattaagtgcctactatttgctggatgtgttaggtttcttcagagaaacagagccaataagatatctatctatctatatctacctatctatgtctctgtctgcccaaatctatgcatctatatctatgtatttatagctatctatctctatctatctaactagagatatttattttaacaaattggctcatgggattgtgaagatgacaagtccaaaatccatggggcaggccaacaggccggaaaccgagacaggattttttaaaatttaatttaatttaaagtttgaggatacatgtgcaggacatgcaggtttgttacccaggtaaacgtatgccatggtggtttgctgcacttatcaacccatcacctagatattaagccccacatgcattagctgtttaccctgatgttttccctcccaccgccccctcaacaggccccagtgtgtgttgttcccctccctgtgtccatatattctcatcattcagctgccacttataagtgagaacatgtggtgtttggttttctgttcctgcattagtttgctgaggataatggcttccagctccatccctgtccctgcaaaggacatgatcttgttcctttttctggctgcatagtattccatggtgtatatgtgccacattttccttatccagtctaccattgatgggtatatttggttgattccatgtctttgctattgtgaatagtgctgcaatgagcatacgcatgcatgaggcagaatttgacgctccagtctggaggtagaatttcttcttctctagaaactgttttgccctcaaagccttcaactgagtagatgagacccacccacattactgagaataatcttcttgaagtcaactgattttagctgtcaaccacatctacaaaataccttcacagccacatctaggctagtgtttgattaaataactggttactgtggcccagcctagttgacatgttaaaccatcctcccaacatcctaagtgctataggcaggctcttacttattcttcataaatctataagggataggtgttactctcttcctggttttacagatgagaacagagatgttaagtaacttgctcaggggcccggtgcagtggctcatgtttgtaatcctagcactttgggaggccgaggtgggaggatcacctgaggtcaggagttcgagaccagcctgaccaacatagcgaaaccccgtctctactacaaatacaaaaaaatatttagccgggcgtagtggtgggtgcctgtggtcctagctatttgggaggctgaggcaggagaatcacttgagcgcaggaggcggaggttgcagtgagccgagattgcaccactgcactacagcctgggtgacagagcaagactgtctcaagaaaaaataaataaataaaagtaacttgctcagggtcacacagctaatgagtgatgaagtcaaattcaaatcagcatctagctcaagcacccacctccctactagctttgctctcttgccactctgcccctgctgttcagagaaaggattggagctgaaaaaccaggaagagggaaatcagagggggaggcagtgttgcatcctggatggaaaagatgctgcataaggtactggcagatgagattgggaggagcagagacactgaagaggaggtggaattggcaggtcttggtgatagtccagggtgagggtgaggaagaggcaggcgtctgggataatgacctggtttatccctgactgacttggcagcctcttgggctggggaagggagcacgggaaagtgtgctgggcattttggaacagctcctggaacattctgcgtcgttctcccccatgaacctaaagagaacaagctcatttccccagatacacaggtgatcatacagtcattaaatcgccatcttttccttgccaactcccccaaccccaatggctcaaagtcatctcacctgtggctcaatgatagatgctggatctgacggccaggacccccaggcccctgtatgccaacctttcccagctcaccagatttgtcagctctgctgccctaacaaaagttgaagtggggtggcttcaactataggcttttatttcctcaccgtttttttttttttttttgagatggggtttcaccatgttgcccaggctggtctcgaacccctgacctcaagtgacccacccacctgggcctcccagagtgctggaattacagatgtgagtcactgtgcccagccttattttcttacaattctgcaggcaggaagtccaagatcaaggtgccagtggggtcagtttctcctgaggcctctctccatggcttgcagagggatggccrccttctcaccgcatcctctcagcccagcctttcctcagtgcacacgcattcttggtattcttggtgtcttcctttttttcttttttttttttttttagatacaaggtctcccttgtatctaaatgatctgagtgatacaagtgaggctggaatgcccaggctggagtgcagtggcacaatcatacatagttcacttcagccttgaactactgggttcaagtgatcctcctgcctcagccttctgaatagctgggaccacaggcatgcattaatatgcccagctaatttgtttattttattttatttttgtaaagatgcggtctcgctctcttgcccaagctggtctcaaacttctgggctcaagcaatcctcccacctcggcttccctaagtcctgggattactctggtgcctggcactctttctcttctcataaagaccccagtcctattgaattaggatcccactctcatgacctcagttatcctgaatgacccccccacttttttttttttttttttttgagatggagtctcgctccgtcatcaggctggagttcagtggcacgatctcggctcacttcagcctctgcctcccaggttcaagcgattctcctgcctcagcctccccagtagctgggactacaggcatgcgccaccaccacgcccagctaatttttgtatttttagtagagacagggtttcaccatgttggccaggatggtctcgatctcttgatatggtgatccttctgcctcggcctcccaaagtgctgggatgactggcgtgagccaacgcgccggccctgaatgacctctttaaaagtcctgtctccagatacaaccccatgggggatgagggcttccacatatgactttggtgggggcagaaaccactcagtctcctgaactcaccttggctgtctcggcttctttccctaggctcactcagtaacttgatggattttgtgaagaaaacaggcatttgcgcttcaaagtgggaatgggggaccmctcacaacttcctgtacaaacacggtgagaagaccctcttcccacygccctggtctgtccttgcgtgtgaatgggctggagtaggggaagggggtgggcctgaaacaatcccaggctggtccttccccagagctttggaggggggtggtgtcaaagkgcccagggatctgattaggggaactttcgctcagtggtgtggtccatactgaaaaatgtgtggcctcgctgcgagtcccagtcatcgtgaaaagcctcactgatggctttctctggttttgcaaaaatgcaaaaaaccctaatttcttgtcagctagtcctaggacctggtcttcaaaaacacttgtatgggctgggcgcagtggctcatgcctgtaatcccagcactttgggaggctgaggcgggcggatcacttgaggtcaggagttcaagactagcttggccaacatggtaaaaccctgtccctactaaaaatacaaaaattagccggacagggtggcgggtgcctgtagtcccagctactcaggaggctgaggcaggagaatcgtttgaacccaggaggcagaggttgcagtgagccgcgatcatcccactgcactccagcctggcaacagagcgagacaccatctaaaaaaaaaaaaaacaacacacatttgtatgggttttcccttcaggggactgaccctctcattcaggtggaattgatgtcagactcctgggaactcacactgaggccatttaatagtctccataagctccaatgttcatagctggtggagatcctctcctatgaccatgccaatccctgcaccactcatgtatgtgtatgtgtgtgtgtgtgtgtgtgtgtgtgtgtgtcttgctctgttgcccaggtgggaatgcagtggtgcaatcatggctcactgcagcctcagcctccccagctcaagcaatcctcccatttcagcctcccgaatagctgggaacacaggcacacagcaccatgcctggctaatttttctttttctttttcatagagatggggtctcactatgttgcccagactgatcttgaacccctgggctcaagcgatcctcccacctcagcctcccaaagtgctgggattacaggtgtgagccaccccacacctggccttccccactcttttgttacaagactatcgtgaacatctttatgtttgtggtcctgttgcccttgtgcaaatcgagaaaaggtgcatcttccaggggggtgaattccaaaatgtgcccccctggccagggctgtgtgtggcctgggaagggaaccctggctggatgtcagtcctgctcacctctcctggggtgcttcctacaaggcacacaggacttcagctgtgtctgmgcaccatgccatgcagctgccgggtcttatggcctcggaatacaccatcaagcatcaagtcactggatcatggcgatgagtgttttagcatcaaatttctccctgaaggggttggatgaagtcgctttctcagtagcaatatatgagagtgtaaaccaaaaataaaattctaagccccccaccacccaaccatctgaatagacctctcctgtcagccagggcactccaaagttaacctgaaaaatgggttcagtccctgatgggaagtgggggtcggacatgcctccttataccctcctcccttttggaattcaggaaaagctgactagcagtcatgtcaacacaaatttttttttttttttttgagatggagttttgctctttttgcccaggctggagtgcaatggcgcgatctcagctcaccgcaacctcggcctcctgggtttaagygattctcctgcctcccgagtagctgggattacaggcatgcgccaccacgcccggctaattttgtatttttagtagagacagggtttctccatgttggtcaggctggtctcaaactcctgacctcgtgatctacccaccttggcctcccaaagtgttgggattacaggcgtgagccacctcaacacagattttaagtctgataagaaacatttacattctgttctctctgaagcctgctacctggaggcatcatatacgtgataaaactttggtctccacaaccccttgtcataacccagacattcctttctattgctaataactctttaaaccaatagccaatcagatatttttattttattttccatatatttatttattaattatttttatttatttatttatttattttgcgatggagtctcgctctgtcacccaggctgcagtacagtggtacaatcttggctcactgcaaccaccacctcagcctcctgagtagctgggattacaggcacatgtcaccatgctcaactgatttttgtatttttagtagagacagggtttcaccacattggctaggctggtctcaaactcctaacctcaaatgatctgcccaccttggcctcccaaagtgctgggattataggtgcacaggtgtgagccactgtgcccaaccgtcaatcagaaaactttaaatctacctataacctggaagcccccccccgacccctcctcacccctcacctctacccctccatgacttcaagtcgtctcacctttctggaccgaaccaaggtatatcttagatatatttgattgatgtctcatatctccctaaaatgtataaacctaggctgtgccccaaccacctaggccacatgttctcaggatctcctgaggactgtgtcacgggccattggtcactcacatttggctcagaataaacctcttcaaatattttccagagtttgactcttttcatcagcaagaggaaccattcccagaggtactgtcttagtctgctcaggctgctgtgacaaaatcccacagactgggtgacttaaacgacagacatttattttctcacagttctcaaggctggaagtccaaaatcaagttgtctgtggggtgagttctttctgaggactctctctgcgatttgcagacagccaccttctcatatcctcgtatggtctttgctccatgtgtgtctctgttctaatcccctcttcttagaagagcactagtcattctattggaatgtttcaaagttttatcatgcagatgtgtgagaggcattggaaccagagtgactctatcttgaatgagggctaggaaaaatgaggctcagccttgctgggctgtatccccaggaagttaggcattcctagcctctagatggttatggttaagggaacagattcataatgtttactaaacagactcagacccaggaatgtcctgatatcctgatatcttgagaacagacgcattcctaattttgctttaaaaataataatataagttcttgtaaaatatagtaattatggtttttggtttttttttttttttgagacagagttttgctctttgttgcccaggctagagtgcagtggcacaatctcagattactgcaacctccgcctcccgggttcaagcgattctcctgcctcagcctcccgagtagctgagattacaggcaggtgccaccacgcctggctaatttttgtgtttttagtagagacaggatttcaccatgttggtcaggctggtcttgaactcctgacctcaggtgatccacccaccttggcctcccaaagtgctgggattacaggcrtgagccaccgtgcccggccaaaatagagtaattatgaaaattaatcctttatcacaaatacttgtagcagagcacatctccccatgtttttttgttgttgttgttttcctatatataacaaaaggaggaggtggttgcatttctcctcttactttccgtaacaccctactctgtggagtaacgattctttcacccytttgctttcttaacagacttgctttcgctttgcactgtggactcaccctgaattctttcttgtatgagatccaagaaccctttcttggggtctggatcgggacccctttccagtaactgatgaaggctccaggtagcaagcttcagagagaatagattgtaaatgattcttgtcagacttaagctctgggtggatattaaatgctggtcagctttccttaaatccccaaagggaggagggcatcgtgaggcatgtctgaccctcccttcctgtcacggccagaactaggttttcaggttaactctggggtgccctggccaagaggaagggttcattcagatggttggggtggtgttgtgggggggtaggagttggggagggtgttggcggggggacgggagggatgggggtgggggggaggggcttatcattttatttttggtttacgctgtgaaaggaaaataaatctcgggaccccaaaatcaccaagttaaagggaaaagtcaagctgggaactgcccagggcaaacctgcctcccattctattcaaagtcaccctctgctcactgagataaatgcgtatctgattgcctccagttggaaaggctaatggaaactctaaagaatgttggccggcccgtggctcacgcctgtaatcccagcactttgggaggcagaagcgggtagatcacgaggtcaggagttcaagaccagcctggccaagatggggaaaccctgtctctactagaaatacaaaaattagctcagcatggtggcgggtgcctgtaatcccagctacttgggaggctgaggcagagaatcacttgaagccaggaggtggaggttgcagtgagtggagattgcgccactgcactcccgcctgggcaacagaacgagactccttctcaaaaaaaaagaatgcaaccattcacttcttatctacctgtgacctggaagccccctccctgctttgagttgtcccacctttccagaccgaaccagtgttcatcttacatatattgacatctcaggtcttcctaaaatgtctaaaccaagctgtgccccaaccgccttgggcacatgtcatcatgacctcctgaggctgtgtcacggttgtgcatccttaaccttggcaaaataaactttctacactgaccgagacctgtctcagaaacattgggttaacaacrctctcacatattgctgctgagaaggcagcttcatttggaacttcacgccaaaaaccccattttaccttaattacctctttaaagaccctgtctccaaatacagtcacattctgaggtactggaggtaagagcttcaacatgtgtttgtctgtttatttgtttatttatttgagatagagtctcgctctgtcacccaggctggagtgcagtggcgcgatctcagctcactgcaacctccggctcatgggttcaagtgatcctcctgcctcagcctcccaagtagctgtgattacaggcacccgccaccacgcctggctaattttggtatttttagtagagacagggtttcactgtgttggccaggctgatcttgaactcctgacctcaagtgatccgcctgcctcagcccccaaagtgctgggatttcaggcgtgaggcaccgcacccagccagggcttcaacatatgaatctgggaagagagagaagtcagctcctagttggcaacctcacaactgctgtctacactgacaacgatcattttcccatccccctctctgccttccatttmcaagtcttgctttcagtccccagaagcagctgatcctctttcttcctgggcaccacaggtggcatccgggacaagataatgagcagccggaagcacctccacctggtggatgctggtttagccatcaacactcccttcccactcgtgctgcccccgacgcgggaggttcacctcatcctctccttcgacttcagtgccggagatcctttcgaggtaatcgagaagggctttggggccggtcctgggtgggaggtgggctgyggcgaagctgactttgcggaggaactgaggacgcgggctgggaagcgggcaatggggaggtgctggctgggaagtccagagagccaaatcaactcacccatcgctcccgaagcacccgcrgtcggccacatccaacgaacttctgatccaaagccatcccagaccttcccgggcccctcttcctggcagatgactctccccgcttctgcgtcctgcctgcccattcataccagtttgaactgcaacagcctagctcctcacctgtgcacctccttccccaggtgtgcacgtctccagccccgagcgcgtgtcttcctgctcatctgggtttcctgggcaaatagtggccctcaataaatgtttgctgagtgagaacatatgcaagtatatttgtcttagtacatattgcaccttcccagtggccactaggatccgttctccctgccttcatatcccagctctgccacttaccagctgtgtggcctgatccaatgtgcgtaacttctgtgcatgtcggtttcctcagctgtaaaattgggctaacgatggctccaccaggagttgttctgtggattaaattaatacttgttaatacatgtgaagtgcttagcacagtatctgccacttactgtggggtttataaacattttcctcccctcccytcccctcccctcatggcctcctttcgagactgggtcttatggtgtgatcatagctcactgcagcctcaacctcctgggctcaagcgatcctcccacctcaccctcccaagtagctgggactgcaggcacacaccaccacaccaggctagttttctaaattgttttagagacagggtcttgctatgttgcccaggctggtcttgaactcctggcctcaagcgattctcccaccacccaaggctaggattacaggcacaagccgccctgcccagctattttattaaaaaatatatacacctacataatatataactatatctattacatgrtacataccaatacatagtagtatatataaaataatcatggtaaaacatatcatctattatatttatgtgtaatgtaatatatatttatattcacacacttctatcagtttacattctgtaatatgaattaggaacatccatcctcctccccataccatratccagaaccaacttgtcaccatctttctagacccttggcccaggaatacccaggctttctggtcttaggatttctgctgaaataaatatcccaagacaatatgataaaggtggaatgagatatcaaggtcttgggagtccttttctgccaaatctctgctgcatgaccccgagcgataggcttaacctctgaacctcagttttctcatcctgaaaatgggaatcacatcatctggctcgcaggagatctgcagagtctctgcaccatgcctggtccatagctggtgttctggattaacaacaatgcttatctggtgatgatgagaatagcaagagtaataggaagaaaaccggcagcatttgttaaacttcaatcaaagacgacttcagagacctaagctgtccactacagtggttgccggccacatgtggcacttgagsacttgaaatgtgcctggcccaagttgaagtgtgctatgaagataaaatacacctcggattttaatgaccgagtatggaaaaygcatgtcaaagaccttattcgtaattggtatattgacatactwggcagggctctccagagggacagaaccaataggatctatgtctagatgaaagggagtttcaggatcacaaggtggagtcctacaataggccgtctgcgagctgaggaagaaacaaaccaatagtggctcagtccgagtccgaaagcctcaaaagtagggaagcccagccaggcctggtggctcacgcctgtaatctcagcattttgggaggccgaggcgggtggatcagaagatcaggagttcgagaccagcctggtcaacctggtgaaatcccgtctctactaaaaatacaaaaaaattagccgggcgtggtggcaggtgcctgtaatcccagctactcgggaggctgaggcaggagaatcacttgaacccaggaggcggaggttgcagtgaaccaagattgcgccattgcactccagcctggtgaacaagagcaaaattccatctcaaaaaaaaaaaaaaaaaaaaagtagggaagcccacagtgcagccttcagtctgtagccaaaggccgtagagcccctggcgagccactggtgtaagtctaagggtccaaaggccaaaaaacctggagtgtgatgttcaagggcaggaagtatccagcacaggagaaagatgaaagccagaggacccagcaagccagcttctcccaccttcttctgtctgctttgttctagtcacactggcagccaattggagggtgtccgcccacactgtgggtgagtcttcctctcctagtccactgactcaaatgttcatctcctctgacagcaccctcagagacacatccggaaacaataccagctttccaggcacccttcaatcaagtcgacacctaatattcaccatcacaattgattacacatcgaggcaatcacacttttgacatattgcatgagatgaaactttttcctacaaattgggtggttacaaagtaataaacagaattttttttttttttttttgagacagagtctcgctctatcacataggctggagtgcagtggcacaatctcggctcactgcaacctccacctcctgggttcaagcaattctcctgcctcagcctcccgagtagctgagattacaggcatgcgccaccacacccagctaatttttgtatttttagtagagacggggtttcaccatgttggccaggctggtctygaactcctgaccttgtgatcygcccgcctcggcctcccaaagtgcagggattacaggcgtgagccaccacgcccggccaataaacagaaatttaagcaagacatatctgtaacaatttaacagaacctgattgtctaagttttttttcatttttctcaaattcatctttaattctttccatgatggggcttataaggaaactaaccaacatgtagctactatagttgaatgtcaaatcttttttttttttttgagatggagtcttctgtgtcgcccaggctggtgtgctgtggtgcgatcttggctcactgcaacctccgcctcccgggttcaagtgattctcttgcctcagcctcctgagtagctgggattacaggcgcccgccaccatgcccggctaatttctgtatttttagtagagacggggttttgccattttggccaggctggtcttgaactcctgacctcaggtgatccgcccacctcagccttccaaagtgctgggattataggcatgagccactgtgcccagctgaatgtcaaatctttagaaggtacttatgacagtaaattcctctgtaatacaggtatgaagcaccttcatgatatttctgttttatgtgtagaaaagtggctgggtgcggtggctcactcctgtaatctcagtgctttgggaggccaaggtgggaggatcacttgagatcagcaatttgagaccagcctgggcaacatagcaagaccccatctccacacaaattttttttttttttgagacggagtttcgctcttgttgcccgggctggagtgcaatggcacgatatcggcttgccacaacctccaccttccaggttcaagcgattctcctgcctcagcctcacaagtagctaggattacaggcatgcgccaccacacccagctaatttttgtatttttagtagagatgggattgctccatgttggtcaggctggtcttgaactcccgacctcaggtgatctgcccacctcagcctcccaaagtgctgggattacaggcgtgagccaccacacccggccaaaaaaattttttttgattagctgggcatggtggctcacgcctgtagtcccagctacttaggaggttgagatgggataacctgagtctaggagcttgaggctgcagtgagccatgattgcaccactgcactccagcctgggcgacacagcaagatcctgtctctaaagataagtatatgtagaaaactgttagactcaaatattcaactcaatataaaataagaagaagccgggtgcggtggctcacacctgtaatcccagcactttgggaggtagaggcgggtggatcacctgaggtcaggtgtttgagaccagcctggccaacatggcgaaaccctgtctctactaaaaatacaaaaattagccaggcatggtggcacgtgcctgtaatcccagctgctagtggggctgaggcaggagaatcgcttgaatctgggaggcggaggttgcaatgagccaagatcccgccactgcactccagcctgggcaacagagcgagactctgtcaaaaaaaaaaaaaaaaaaaaaaaaaagaagaagaagaagaagaagaagaagaaacacttgttgagactgcatctccttttgctaatgagtggtttctagttgtaatatcactcctctgaataaagaagccacctttgagtacataaggaaaaataaccacatgttaaaaggataagacattactccgacatctctactgggccatctcttcctctaacacttcagaaacttagaaatttaaaatattcttacgttaactgcaagaacaagataaaggagaaatgccctttttcttgagatcacaactatgaagtcatatgcttatgcaacttctgcatttgtgtgcaaaacacaaacacactgatctttttttaacttttaagttcaggggttcaagtacaggtttgttccataggtaaacttgtgtcctggggatttgttgtaccgattatttcatcgccccagtattaagcctagtacccattagttatttctgctgaccctctccttcctcccgctctccacccaacactaggccccagtgtgtgttgttctcctctgtgtgtccatgtgttctcatcattcagctcccacttagaagtgagaacatgcagtatttggttttctgttcctggaaacacatttatacatttatcttttttttttttttttttttttgagacagagtctcgttcttgttgcccaggctggagtgcagtggtgctatctgggctcactgcaatctctgcctcccatgttcaagcgattctcctgtctcagcctcccaagtagctaggactacaggcatgtgccaccatgcccggctaattttttgtaattttagtagagatggggtttcactgtgttagccaggatggtctcgatctcctgacctcgtgatccacccacctcagcctcycaaagtgctgggattataggcatgagccatgagccaccatgcccagcctctttcttgctcttgtcacccaggttggagtgcaatggcgctatctgggctcactgcaacctctgcctcccgggttcaagcgattctcctgtctcagcctcccaagtagctgggattacaggcacctgctaacatgcctggctaatttttgtatttttagtagagacggggtttcaccatgttggccaggttggtctcaaactcctgacctcaggtgatctgcccgccttggcctcccaaagtgctgggattacagacatgagccaccacgcctggcccgcattgatcttaattctccttgcttagttttgtcagtcagcttgcaggacttaacagatgcctttctaagacacagagactgagatgtgttttatgtaagtttagtaacctcagtgctacagtaatgagacatgcagtgtccttttgctctggttcaggacagcacggaaggaggccacaggaaagagaataaatgaaacttgttacaactgagaaactacttctcattaagtttccccatggtgtcacctttatttaatatttatttttaaaattaatttctcctacttctttttactttcttcaagtgcagcaagtagacaattgaaaagtacctttacggccgggcgcggtggctcatgcctgtaatcccagcactttgggagactgagacgagcggatcacctgaggatcaccaacctgaccaacatggagaaaccctgtctctactaaatatatgaaattagccgggcgtggtggagcatgtctgtaatcccagctactcgggaggcaggagaatcgcttggaccagggaggcggaggttgcagtgagctgagatcatgccattgcactccagcctgggcaacaagagtgaaactctgcctcaaaaataagaaaagaaaagaaaagtaccttcacggtgacattatatttctgttacacagtgatgatggagaatatctcatttatcttccaaatacccctgtgaggtggctattacagagatcctttgcagaggtgatgagatgcacccataccacatatctcgttgggctcctgggctcaaatgatcttcccatctcagcttcctgagtagctagggctacaggtgcacgcccccatgcctggctaattgaaatatatatatatatatatatactgtagagatgaggtctccaacatctttctgtggcagagctgggattcaaagcctcatctaggcaccattttccttgccctctgagtcccgcagcccccagccccaaaggttactctctaacctcgcgaatgttgtctctaggtgggctggggagtgcgggtgatggcagaggcttactctttcccttacagaagatgttgtccctgtccaagctgacccttgctctgttgtgtgtctgggctgttagctgaggtcccrttgggtctccaggccccaggggtcttctggaggggtcttctggagaggtcttgcaaccatttcttattgcctccttctcagaccatccrggctaccactgaytactgccgccgccacaagatcccctttccccaagtagaagaggctgagctggatttgtggtccaaggcccccgccagctgctacatcctgaaaggagaaactggaccagtggtgatgcattttcccytgttcaacatagatgcctgtggaggtaggtgcaggggaggagcaggtgagaagccacctgtattagtccatgctcacactgctaataaaaacatacctgagactgggtaatttacaaaggaagaaggtttaattgactcacagttcagcatggatkgagaggcctcaggaaacttacagtcatggtggaaagcgaaggccaagcaagtcaccttcttcacaaggcggcaggaaggagaagtgagtgccagcagggcaattgccagatgcttataaaatcatcagatcagccgggcgcggtggctcatgcctgtaatcccagcactttgggaggctgaggcgggcggatcacaaggtcaggagattgagaccatcctggctaacacagtgaaaccccatctctactaaaaatacaaaaaaaaaaaaaaataaattgctgggcttggtggtgcgtgcctgtaatcccagctactcaggaggctgaggcaggagaatcgcttgaacctgggaggcggaggttgcagtgagctgagatcgcgctcctgcactccagcctggggacagagcaagactccttctcaaataaataaataaatacataccatcaggtctcgygagaactcaactcactgtcacgagaacagcatgagggtaaccacttccatgcttcaattacctcccacgacacttggggattatgggaactacaattcaagatgagatttgggtggggacacagccaaaccatatcaccaccaggccaggccgaatggagctgtgctgtgccctggggacatcttgttacgctccaacatctgatggttgagtgagtcatcctgtccacccttgggcctggaggatgccaggctgcctctctcggtcttgcatgtttatgcatgttgctgcctctctctgcagccttcttgtcctacctgaatatccaaccccttccacctgggcatcccacattcytcatccagtctcaggtgagcagctgcttggaaggcctagcatccaggatgggtggtcctccggggcctgattgtgccacttcccacagtgggctccttttagcttgtcaatcgtgtctcctgcgatgagactcccattagggataaattgtgtctgttttcttccttcatttaaygaacatttattggttacctatgctgcatcagccatggttccaggagaggcaggctagagtagtaaagaagacaggaagcagggggccaggygcggtggctcacgcctgtaatcccagcactttgggatgccaagccggggcagatcacctgagatcaggagtttaaggccagcttggccaacagggtgaaaccccgtctctattaaaaaatacaaaaaattagccargcgtggtgatgcacgcctgtaatcctagctacttgggaggctgaggcaggagaatcgcttgaatctaggaggtggaggttacagtcacccaagattgtgccattggactccagcstgggagacaagagcgagcctctgtctcaaaaaaaaaaaaaaaaaaaaaagaaaaaaggaccggaaggggcatggatcataaaaatatagataaatccataacctcatgtgtcaataaaactttatttataaagccaaagtagtgggccgactggatttggtccacaactgtagtttgccaagccctgatgtaaatagacaaaaatctgcagaattaattgtccaaactcatgatgccttttctttgttggtttggttatgcttcaggtgatattgaggcatggagtgacacatacgacacattcaagcttgctgacacctacactctagatgtggtggtgctactcttggcattagccaagaagaatgtcagggaaaacaagaagaagatccttagagagttgatgaacgtggccgggtaggtgggagaccatagtcgctctgatgcctatgctcgttcagtaagtatctgttggagaactttctctgcaacaggcaggagggttgcatgggtgaaaaaagataggcagtgtctcccctacttgagcttgcgtctcagcaggggacagaccatgaacagggtcaggagtgaatggttttctgaagagtgaagcaggctgtgttcgtttgctagggctgctgtaacaaaataccactagctgggtggcttcacagaaattgatggtctcatggtgctgggggctggaagtgtgaattcatggtatcagcagcgctggttccttctgggatctgtgagggagaatttgttccacgcttgtctccgtgtatattggtccgttttcacactgctgtaaagaactacctgagactgggtaattgatgaagaaaagaggtttaattgactcacagttccgaaggcttaacaggaagcatgggtgggaggcctcaggaaacttacaatcatggtggaaggtgaagggggagcaagcacatctttaccatggcagagaaggagagagagagagcaaagcgggaagtgctacacactttcaaacaaccggatttcatgagaactccgtcactatcacaagaacagcaagggggaagtacgctcccatcaatcacctctcaccaggcccctaccccaacacatgggaattacaatttgagatgagatttgggtggggacacagagccaaaccatatctctgtgaaaggaaaatgaaatctcaggaccccaattcactatgccaaaaggaaaaacttaagctgtggctgggcactgtggctcatgtctgtaatcccagcactttgggaagccaagacaggaggatcgcttgagcccaggagttcaagatctgcctgggcaacatagtgagaccaagtctctacaaataattttaaaaattagctgggtgtggtagcacaagcctatagtctcagctactcaggaggctgaggtgggaggattgccggagcccaggagtttgaggctgcagtgagctatgatggtaccaccccactccaggctgggcgacagagcaagaccttgcctctaaaaaaaaaaaaaaaaaaaaaaaaattaagctgaaagcttaattaagctgagtcatgcaagaaactgtctttccttttgttcctaagccacagataaaaggccacagatatctccacaggtaacttactctatcgatatggtttggctctgtgtccccacccaaatctcatctcgaattgtaatccccacatgtcaagagagggacctggtgggaggtgattggatcttgggggtggcttcccttatgctgttctcgtgagagtgagggagttctcacgagatctgatggtttttaagtggcagtttcccctgctctctctctctctcgatctctctctctcatctctcctgccaccctgtgaagaaggtgccctgcttccaccatgactgtattaggttggtgcaaaagtaattgcggttttgcaactaaaagtaatggcaaaaaccacaactacttttgcgccaacctgataagtttcctgaggcctccccagccacatggaactgtgagtcagttaaacttcttttgtttatacgttacccagtctcaggcagtgtctttatcgcagtgtgagaatggactcatacagttctagaagtcagaaatctgaaacgagtgttatggagcaaaacccaaagcgttagcagggccaactcctgcggaggctccaggggagaagctgttccttgcctttttcagcttctaggggccacccgcattccttggctcatggcccctccttcagcctcttgcttctatcatctcatctcctccttgctctgacctcccgccttgctcttataaggaaagatccatgggattccactgggcccacccagatacccaggatcctctcctcatctcaggatccttagattaatctcatctgcagagtcccttttgccatggaaagtcatgtactggccaggagccgtggctcacacctgtaatcccagcactttgggaggctaaggcaggcagatctcttgagctcaggagttcagaccagcctgggcaacatggcaagacaccatctctactaaaagtacaaaaaaatagcaaggcatggtggtgtatgcctgtggtcccagctccttaggaggctgaggtaggaggattgctgaaccctggggagcagaggttgcagtgagcccagatcacaccactgcactccagcttcgatgacagagcgagaccctgtctcaaaaaaaaaaaaaaaaaaaaaagtcacatactcacaggctcyagggattaggatagggacatcattaggagacattattcaacctgccacaaagacacagacacaaccagatgacagaagccaggggaagagttggaatattattctgaatatggtgggaagctgctgttaagttttgagcagggaagtagctttatctgagtcaccttttcaaaggcccaccctagctcctgtgcggttggtccctaggtgagataattagcaccctgaggagcagtttgggtcaatgacctcagggtcgcaaggtagagggaagagaaagccattctgggcctctggaccagtctatgttccccagagagtttccccaaaagccctgcctggcatggggcagggcggttatttgctgctcatctgtcttctaatgaggggttgtatattagtttgctggggctgccattaaaaagtaccacagaggccgggcatggtggttcacacctgtaatcccagcactttgggaggccgaggtgggcagatcatgaggtcaggagttcgagaccaacctggccaacatggtgaagccccatttctactaaaaatacaaaacttagatgggcatggtagtgcacacctgtagtcccagttacttgggaggctgaggcaggagaatcgcttgaacccagaaggtggaggttgcagtgagcccagatcatgccactgcactccagcctgctgacagagggagattccgtctcaaagaaaaaagtaccacagatcaggtggcttaaacaaccgacacttattgtctcacagttctggaggctggaagtccaagatcaaggtgtgaacaggggtggtttctcctgagacctctctccttggcttgcagatggtgcctccctgtgtctacacatgattttcctctgtgcctgtccactccccaccttctcacctgtagaactcagggcttatttatgcttatttgttgactctctctcctcataataaggtgtgcagcagtgtggggtcaggaaccacatcactttgctcaccatggtgttcattctttcattcattgattccacaaacatttcctggatgcctgctagatccagtccgcccaggtcctgcagccgtggctgcatacaggtcagatgaggctcttgctcttgtagaatgtacctcctcccgggggggcaacatgacataaacaggtaaacaaagaagtcaacaggatggccatggagagtaagtgccatggagacgaccgaacgtgcggtgtgctgaggagtgaagtgaaagctttttaggaaagggtctgggggtctgggaaggcatcctgagggagagacctttcacctggggctgaatactgagaaggggtggccatgaggaagtcttggggaacagaattctgtgcaaaggaaaagtaaatgcaaagtgtctggagtgggaaagaccttgatctgtgtcttacctatgtctataacattctgtactaatataaaggcatatctgaggctcggtaatttataaaggaaagaggtttatttggctcatggttctgtaggctgtgcaagaagcatggcgcctgtatctacttctggtgaaggcttcagagagcatccaatcctggtggaaggggaaggggggctggcgtgttacatggtgagagagagcaagagagagagaagggaggaaagcaccagtttccttttaacaaccagatctcaagtgaactaatagagcaagaactcactcattaccgcagggaaggcaccaacccattcatgaaggatccactcccatgatccaaacatctccctctgggccccacctccaacactggggatcacatttcaacatgagatttggagrggacgaatttccaaactatatcagtctattcgaggaacagaaggaaagctgttattgctggatcagggtaggggaagcacggaatgaaatgtgattggagagatggacagagatcagawcttgtgaattctggcaggtatcatgacattcgatgtaggccaaagagttacctcctagcccagctcctgatacatgcttaataagcgtagtgttggataaataaacgtttacgtggtaaaagtagatcacaagagctccacaggaggaggtggtggagctccaggtcttctcaatgaatgaaagaatggatgaatgtctttctcctaagtcatgtatgacctgtagaggcttccaggtcttctaatcttatccartgtgcaacactgcctacaaagcacagtggtaacttctaactttcctttctccccaggctctactacccgaaggatagtgcccgaagttgctgcttggcatagatgagcctcagcttccagggcactgtgggcctgttgrtctactagggccctgawgtccacctggccttcctgttcttcactcccttcagccacacgcttcatggccttgagttcaccttggctgtcctaacarggccaatcaccagtgaccagctagactgtgattttgatagcgtcattcagaagaaggcgtccaaggagctgaaggtggtgaaatttgtcctgcaggtcccycgggagatcctggagctggagcatgagtgtctgacaatcagaagcatcatgtycaatgtccagatggccagaatgaatgtgatagttcagaccaatgccttccactgctcctttatgactgcacttctagccagtagctctgcacaagttagctctgtagaagtaagaacttgggcttaaatcatgggctatctctccacagccaagtggagctctgagaatacaacaagtgctcaataaatgcttgctgattgactgatggattagctgtgtgtgtgtgtcttggtctgccaccacccctgctgcggcccttttcaccctctgtgtaccctttacttgttcctttcttcccttccccctttcctttccatcttcttccatctatatctcagcaattaagcatggtggttccacagctgggtttggatcttacttctgttatctgcttaccatgagaacatgggcaagagccttcgcctccatgccccagttccatcgtctgtagaatagaccatcacggagcctgtatcctagaaaggcttaaatgagttcatgagtctcaagaccttagaatagttagtctggcaccgacggagttccagagcaattattattcatacaggctttccagaattaaagcaggactgttatgggatgaattgtgtgtcccacccccaccaaaagatgtggccattgtaacccccagtgcctgtgaatgtgaccttgcatggaaataaggtctttaccaatgtcatcaagtgaagatgaggtcaytcgtgtggaccctaatccacaatgactagtgtccttatgaaaaggagagatttcgccgggcgcagtggctcacgcctgtaatcccagcactttgggaggccgaggcaggtggatcacaaagtcaagagattgataccatcctgaccaacatggtgaaacctcatctctactaaaaatacaaaaattagctgggcatggtggcacacacctatagtcccagctactcgggaggctgaggcaggagaaccgcttgaacccaggaggtggagcttgcagtgagccaaatcatgccactgcactccagcctggtgacagagtgaagactctgtctcaaaaaaaaaaaaaaaaaaaaaaaaaaaaggaaagaaaaggggggatttaggggagggagagcattatgacaaatacctaatgcatgcagggcttaatacctaggtgacgggttgattggtgcagcaaaccagcatggcacatgtatacctatgtaataaacctgcatgttcagcacatgtatcccagatttgaaataaaattcttttaaaaaagkgggggggwtttaaagacagagacaggcatgtatacagagaggaaaccatgtgaacatggaagcagggattggggtgaggctctactgaccaagggctgccaaactattgccagcaaaccaccagtcatccgaaagaagaccttgatagcagaaggatcctgttcagaattctgtgttgcattcagtcgtagcttttttttttttttttttttttttttggacagagttttgctcttgttgcccaggctggagtgcaatggcacgatcttgggctcactgcaacctccgcctcctgggtttaagcgattctgctgcctcagcctcccgagtagcagggattacaggcatgtgccaccatgccgggctaatttttttgtatttttagtagagacggggtttctccacgttggttaggctggtctcgaactcctgacctcaggtgatctgcccacctcagcctcccaaattgctgggattacaggtgtgagccatcgcgcccagcctcggccatgtcttcttagtctcctccaatctcgaacggttcctcaatctttccttgattttcatgaccttgacatttttgaagcttacaggccagttattttgtaaaccatccctccatgtgggttcgtctgacgtctgattatgatgagattcaggaatcttacagaagcgatgctgttctcgtgacatcctgtcaggtggtgtgaaattccaacttgtcacattactgatgatgtccactttcattgactaagatggtgtttgccacgtttctccactataaagtaactcctttgaaattggtattttgtagggaggtattttgagctctgtaaatatcaaacttctcacttagctttttatttatctgagtatggactcctggtttcttctgtggtcctgtataatttgttactatcattatttattttgactctcaaactgcccagtatggccaatggagcttcttcaagcagactcctgtgttctttccacatgttctcacaacactttgagcaatttcttgctttaagcataggacgtttgtaggctcatcttgttctttttttgctctagacatggaatcagccaaatttcctaggcactctggttccatttggtggagaatggtatatagaagtcaagatttggatgctagtggtgctcattcgtatgggccatcattgtttctatgttctcttagtggagagagctagagaatatgtgtacaaatgttcctatacacactgaaactatgtgtttatttttatctctctatgtataattgagatccatgaggacataccaacgcctccagttatagtccaacaccacagggctcattcgactttcctcctttctgtcttagtaactcccttttccaacagtaggagacctggcccccattccccttactcactgtgtgtagccaatttcccttttcctttgccatttcacccctgtggggatgtctttcccagcctagtctggcttcaacaccatacaccatgctattcccatgagtggacatttctctctctgcttgggttatgacaacccatgccagatcccctctatgtggcctccttcctaattgccttacagtgcaaacctccaccccagacaatgcctgcatataaatgcccccgccccactcagctcatgttccaacactgcacaccaagctgcccatctgtggatttatccccaccatctccagccccaacaccctgggtcatgctgcccctctatgtggacttctcctcaccccactaccccactggaatgctggctctccacgccagatggcccccagccccctcctcccctaaccctacctagtgtggagtcgcaaaacccctttgggctttgacaccaccataacttcacaccctccctgacacccccaccttgctttttccctctaaatcattcaggaaagacagaaggaaagagatgaacagaggaagagcaaatgccatgctcttagtcaccgtgtacgcccacttcctgaagtccatgcttgcatcctgctcactctcacacattcccgactcacccaggaaaactccctgaggccaggggtgctgagctctccatctcactgcccagaggccagtgttggagtgacccttcacatgcttgttggaacattgaataaatgatgccgtctgctctaatcctccattttcttttcttttttttctttttttttctttttttcgagacagggtctcactatgtcagccaggctggagtacaatggtgcaatcgtagttcactgcagcctggagtgcaatggtacaatcatagctcactgcagccttgaactcctgggctcaagcaatcctcccatctctgcctttggagcagctgggactacaggtgtgcgccaccatgcacggctaatttttttattttttgtaaagacagcctctccgtatgttgctcagctggtctcaaactcctgggctcaagcaatcctcccacctcagcctcccaaagcgctgggactacagacatgagcaccacatccagcctctaatccccatttataaaatgcactttccaattccactctggggataaaggcgtcacagaacctgactctgcatttccccacccatatcattcaagccagatggggaggcagggacagctctggtccctccccaacccgggtagagatttccagcccagctgtcacagctctaagacaccgggaccgaaggagaagccaagagaggcaggaagaggtggcaaaggagtgctggagaagataaggaggctgagctccgacagggagcagggaggaggggccatcttgagactggtgccctgcgagctccaccccacccctccatgcagttccccatgggccccgcctgcatcttcttgaggaaaggcattgctgagaaacascgggtgaggtggggagtgagggggaagggcggtgggcggggcaaagggagcaggggtgtgggacaaagaaggggacatgatggtgccacagaaccaggggaacaggtggatagagcaggagctgagaaggtataagaaattccaaggaccctggtggggtcatgtaagccagtgagataaatgggtgggggtaaaatcaaaagtcaggagcaaagagaaggagagaaaaggaagaaaaatgaaaagggaaagtgggatgatgtcattgttgagattaccatcattcttttctatggatgctcattgtgataatggtggtgatgatggtggtggtggtgatgataatgatgacgttaataacaatagctgccacttattaagtcattgttctgtgcccagccctgtgcaaagggatttgcacacctgatgttatttacacctcagaacaactcatgaggtcagtgactttcattcccattttacaggtgaggaaagtgaagctctgagtcatgaagtcatttgccttaagcttacacagttagtaagtggcagggtcggccaagtatagtggctcatgcctgaatcgcagcatcttgggaggcagaggcgggaggatcacttaagtccaggagtttgagaccagcctgggaaacacaagaccccatctctactaaaaatacaaaaaaatagctcagcatggtggcatgcatctgcagtcccagctactcaggtggctgaggcaggaggatcgcttgagcccaggaagtggaggctgcagtgagccctgattatgccactgcactccagcctgggcaacaaagtgagactttgtctcgttaaaaaaaagtaagtggcagggtcgggtttgcttgattcctgtgggcatgctttttaaaatttttttatttttccatatataccaacttgtccagatatgtgggcatacttttcattgttaggctttaagatcaccaaaaaaagagaataaaaaaggccaggcagtggctcacgcctgtgatcccagccctttgggaggccaaagcaggtggatcacgaggtcaggaggtcaagaccagcctggccaagatggtgaaaccctgtctctattagaaatacaaaaattagccgggtgcagtggcaggcgcctgtaatcccagctactcgggaggctgaggcaggagaatcgcttgaacccgggaggcagaggttgcagtgagccgagttcgtgccactgcactccagcttgggtgacagagcgagactgtgtctcaaaaaaaaaaaagagagagagaatgaaaaaaagggtgataagggaccgcaaggaggggatcagatgaaagagaagctgagggaaaggctccagggataaagggagatgggaaggctaaagagaccagaggtcagtagaatttccttgttaacatgccatgtatatgtaagcccaacccttcaggtatgtgcaggagtaggtggggcagcaataactggacattctcagagtgtttaggaactggtcatgctggcactgaccctcctgcctgaaagccattgaatgctgtttccatgcacagagattctaacctttggcaggaagattggaggcaggtgagaaaggagtgaatgggggctagtgtgaagaattctgacttgggagtcaggagccctgaattcaaatcccaatactgtgtctgacttgccccatgacctccagggagcaggtgaatgccttcctcccttgggaggggatctgctgcttgtgagctgtgtgaccttgtgcaggttccttaacctctctgttcctcagctttctcatgggtaagatggaaacgagatgtagatctgcatcacagagcagtactgaggtttaaatgaaatgattgtggaaactgcctggcacagagtcaccactctgaatgagttagctgtggttgtgaagtctcacttttttcatctggagattggactccccagtgtttaagaccccctttgacacaatgtgatgggtgtttgtctcagaaag

SEQ ID NO: 17557 - DNA, 14341 bp, Homo sapiens
tgatggaattaagtggctttatgtgttccaaaaggattggtccacgcaggccacaggaaaatgggaggtaagaagaaagggatcgaaatgctgcaaagtgtattacttcatggtaagcaaaggactcaagactctagaaaatgatgcccttccttccaagactatgttagtccaaatctttcaagatacagaacccaaggtggggtctggcatacaagaagtataatagaggaaatgtctgtgacatttgcaggactgcaaagggagccaggagaagctgggaaagccatgagatcacaagcaggtctgactccaagtgaaggagatggggaatgacgcaaggtttggctgaagcatgtgccaaaggcacccatcagaggagtccctctccaagggatgggcctatcatagtgtccctaatagtgtcatggagtgggagcagcccacggagggcacagccttggcatgaacgcagacatgggtctcagagtgcagcagctgggcccctcagtcaattaggctccctcagagctggggcaggaggtgcactagaccacacagtaatatttatttattattaatttaattaataatattaatttattaatttaattaataatatatttatttatttattattactagaccacacagtagtatttgtatgtctaaggaagcatttctcagaatatactcactgaacttttagcctataagtacctgtatgaaaattttaaaaggggtttcatgatcaaaacattttgggaaacactccataccctttcttcctcatgaaggatcataatgcctattagtatatgaagggctctgagaagtcctgtagtaaagaaacttgctttagttttttagtccagcaatttttcaaacttaaatgagcaatagcctcccatccttttttttacactttttagcatactgcggaataaactcaacatgcattgagaaagactgctttagggaatagtcaacactatttcactcccagtaagtacatataaaatctgtatttccagggtggattatcaacacagctgtattttagaaatattatctgccctcccaggtatcacagctactaawtattgggtactgaggtggaattttagggatcagccaattatgggaaagaaaatctgggggcaggataagatggtctccgaagccttaaaattatatgccattatttacctctttgatctactactcaatatcaaacaactaattcagaagaaaattgattgttttctaaaagtagtttttctacatttcccattaagaagcagtggtatttaaaacttataatggctattatgtgagattatcactatcatagtttttctctatacaaattttctgtaacattttatttgctaataaaaattagatagatggattgactaattgataatctaagaaagattatatttgaagaagccatagtaagggacagattaaattatcatcagtctaaacattctaatacctatttctctttttttgaaattttccaaatttgttattatgcatttaaacaataattttttgaacttttattttaggttctggggtacatgtgaaagcttgttacgtaggtaaccttttgtcatgagggtttgttgtacaaattatttcatcactcagctatcaagcccagtactcaataggtatcttttctgctcctctccctcctcccaccctccagtctcaagtagacctcggtgtctgttgttcccttctttgagttcatgtgttctcatcatttagctcccacttataagtgagaatacaaggtatttggttttctgttcctgtgttagtttgctaagggtaatagcctccagctccattcgtgtttccacaaaaaaacatgatctcgttcttttcatggctgcatagtattccatggtgtatatgtaccacactttctttatctaatctgtcattgatgggcatttaggtttattccatgtctttgctactgtgaatagtgctgcaatgaacattcacatgcgtgtgtcttcatggtagaatgatttatattcctctgggtgtatacccagtaatgggatttctgtttttagctctttgatctaatacctatttctcaagatcaagttagatctctaaaaaaggcatcatcctagcatttccccatcccttccctgaactaaatttaatgttgtgtgtatcaatcagcatacagtcaagacagaaaccacacatgaacattaaatataatgagttattaacttataaaagggtatgaactactaaagggggtaaggagaatgctgaagaatgcaggaatggcagatgtagagagcagccataacctctaagctaaggcacagcagccaaggaaggggcgaactcaaaaaatgccctccctccccagctgatccacccttgttggagggggtgtggctgcaacccaatggatgcccaagaagtttgcagagttgtggcaggttggggctgctgagcaggaaactgcccgaaggggtaccagtgagattcccaagaatgtgggcatgcctctggcgaggaagacgctcttggagtgccagcaaaatttactaggaagctacccagtagggtgccagcaaaagtcagcaggaagccactgtcgtggtgtcggcaaaattcactgaggagtgggcactgcagggtctccacccagcactggcaaatcagccaaaagaacaaaaacaaaataaaaacaaatcccagaaccagaaagaaaaaactctgcctcttactgcgaccctcttatgccttctacagcaactggcaaaggagaaatgtttatggggtccagctctagactcacaaagcagaacacagaagagtgaatgaagagctgaaaggcgataaatcagtaactggagcctcacatcctttgccttttttattgagggtcaatatattaagaagaatatgtctgcgtcttcggtaaaattattgctaaggttatcacccagtgtgtgttttcaacctccctgatataagaacttagtgacaagaaagaatgagacaatgatcatgaactattggacccaaccatttgtggctttagtgcccatcttctcagcaaggctttctctctctctctctctctctttttttttttttttttttttttaaagatggagtctcactctgtcacccaggccggagtgcagtggcacaatcttggctcacggcaacctccacctcctgggttcgagtgattctcctgcttcagcctcccgagtagctgggattacgggcacccatcgccacccctcctggctaatttttgtatttttagtagagatgaagttttgccatgtcggccaggctgttctcaaactcctgacctcaagtgatccacccacctcagcctcccaaagtgctgggattacaggcatgagccaccacagccagctctcagcaaggctttttctgactacactatttaaaatgtgatccctgagccaccttggcctctcttgctgtccttccctgcttcgccttctccatagcacttctctcctactaatctacaatttacttgagctctgtgaaggtcaggatttttgcctattttgtccattggtgcatccccagcacctggaacagagctaggcacaggctaggcactctagaaatacttgctgaataattgaattaagtaaatgagtgatctacacgtagtggggaatgagagtatacagtgatagttccttcgactaaaactggggtcaaattatagtgataaagaggaactcagaccttcagaggtaagctttgtggaccacttgccaaggctgcagaatgtgatgtcgtttcacaaacaaggaggccctattatggcttcagatatgagaataataaagagaactttcctttcgcctcaactgcagccttctaaactcttccttccttcctatgtagaagtttcaaggacctcatggcctgagtgtggataggcagaatgctgggaatcaggcaaaaataaaataatactgaaagtgaaggtcatgctaatattagtaagccagggtgatcctgaatttacaaaacatttttctttgggaaatttcacacctcacatgattctgtgtttttacttgggaaatttcacatctcacatgactctgtgacatgcggtacatgaggtgcctgactgctgtttttgtcctctactaatgaggaagagtgtgcgtactcccagcgttttgcaagtttcaaagtctgacttgactttccttccttttcctggaactgatccatgagtatcgagagtaaagctgcccgcacctactcattcaagatcctgagtgtcctgcccagctgcaggaggtggagagacccaggaggaggggccactgctgatcccaggctgtagggggtgggaagagtgtcccagggcaccatgacccccactcactcactcacaggagacccacacaagagaggagagggcacttacagcttaggttcccaccagcaccaactcctctgccatcaaacatcattgtgtttctctttctgccttgtctgtcggcacacgtggagttaaatttaatgctcaatcacatatttgtctgggctctttctgtgtttatttttctcttaatagttctctctcctcccttcctctccccgcccctcctcctccttcttcttttttttttccagagacagtgtctcgctctgccacccaggccagagtgcagagtggcatgatcatggctcaccgcagcctccaactcctgggctcacgtgaacatcccaccttggcctctggaatgtctgggattacaggcacttgccactgcatctggctaatttttatattgtttatagatccgggatctcactatgttgcccaggctggcctcaaactcctgggctcaagcgaccctcccacctcatacttctgagtagctggggctgtaggaatgcgcctcagtgccaggctagtttcttaattttctatttctattttgacaggtacaaattttgtattcaatcctacctcagacacatctttggtgggaaaaggatgtcatttaatcaatatataaattctaagcaaataggtctgatccccaaattaggttagtcacagctgctgagtcgttgacccaagagaagctcatctagattttttcattattttcaagttcctcttctcggttcgtccttcttccagaccatgccctccccgtcccactctcttcccacagcctcccctccccacagcctcctcccaccattccaaatctgggctgttctctcaatttccttctctctggactcaaacctaccctagcccccagcctcagtttggggttaaacttgtcctcctcacattctctcccacccaacttgatgtcgcctctgtgtcatcaccacgggattttcctcctctgggttctccttttccgagtggggtcagctcccccatgagtcacagcaccaatcacttctggctgcttgcaaacccctttgctttcctcagtgttgacacccagggcagccctatgctcactgccgctgagaccccacctctgcccctggccttttcccagctgacatcaccctgtggcttccattttcctaaaattctcttttgaggcctcagtcttaaccaaagcacacagtgcccctcaaaaatgacaataaaaacccaaacacaccgtgactgtcatggcaggttcctggtccccgtattgaatcagcgggtgggtttctgcgaacactggtgagaggccgcattagagggtcaggaccctcaggtctggactcgtggtcaccacataccttcctccctgctgacagtagctggtacctgttacctactcagagtgtcacatgccacaagccagagcgtcttggcagttctcagcaccttgacatcacttccttgctaccactcagagcggcagtgacacagttcccttatctcagaaggccagaagacggctgtcaaaggtcacagggaaatcaaaggcggggtacagggccagagggaggaggaaacaacttcccggttgctttcagacgcttcagagatcctctggaggcctgggggagcttttgagtactttatttcagttggtccctgagctcggtgagtggggcgggtagagccaccaggggaatcaacagtggtttctcgtgcccctcagggtcaggagcagtctgatcaaaaggagggcatccactgtccggggccattcccacagctcccggatgctgggtctggaggctgcgcccttcscctgcaggagctcagcccagtggtaagtcatctgtgtgtcatctatgtatttaaccccttatggccatgttgatgctgagcatggtttcacttttgcaaacatttatttatacccttcgagagaaaaacgtctcagctgtcacaggaagctgcttcggggggtgagcaaactttttaaaatgcagaaattatratctacacccrtttcttaaaagtaagccatcgtacttggttctctttaattatatattttcttacatattgtgttcatgtaggcaagtcctgtttctgctaaaagaaggtaagttctaccaaggyggtgtcatgccagctttatttcccgtggcacctggcacactgctaagcacttacatgcttaacaactagattgggaatggtgctgctctggggaagtgggcrcacrttaaagaaatgtttatttcagtcttctgaaatagggaattactctggctaaaatgtagctccagaaagggaaagtggggctgtatgaatccaggtccagtttgttgtttcctccaggataaggcagctgtcggaggggaaaatcatctcccatttctccacagggcagtctgaagatggccaattrcacgctggcaccagaggatgaatatgatgtcctcatagaaggtgaactggagagcgatgaggcagagcaatgtgacaagtatgacgcccaggcactctcagcccagctggtgccatcactctgctctgctgtgtttgtgatcggtgtcctggacaatctcctggttgtgcttatcctggtaaaatataaaggactcaaacgcgtggaaaatatctatcttctaaacttggcagtttctaacttgtgtttcttgcttaccctgcccttctgggctcatgctgrkggcgatcccatgtgtaaaattctcattggactgtacttcgtgggcctgtacagtgagacatttttcaattgccttctgactgtgcaaaggtacctagtgtttttgcacaagggmaactttttctcagccaggaggagggtgccctgtggcatcattacaagtgtcctggcatgggtaacagccattctggccactttgcctgaatwcrtggtttataaacctcagatggaagaccagaaatacaagtgtgcatttagcagaactcccttcctgccagctgatgagacattctggaagcattttctgactttaaaaatgaacatttcggttcttgtcctccccctatttatttttacatttctctatgtgcaaatgagaaaaacactaaggttcagggagcagaggtatagccttttcaagcttgtttttgccrtaatggtagtcttccttctgatgtgggcgccctacaatattgcatttttcctgtccactttcaaagaacacttctccctgagtgactgcaagagcagctacaatctggacaaaagtgttcacatcactaaactcatcgccaccacccactgctgcatcaaccctctcctgtatgcgtttcttgatgggacatttagcaaatacctctgccgctgtttccatctgcgtagtaacaccccacttcaacccagggggcagtctgcacaaggcacatcgagggaagaacctgaccattccaccgaagtgtaaactagcatccaccaaatgcaagaagaataaacatggattttcatctttctgcattatttcatgtaaattttctacacatttgtatacaaaatcggatacagsaagaaaagggagaggtgagctaacatttgctaagcactgaatttgtctcaggcaccgtgcaaggctctttacaaacgtgagctccttcgcctcctaccacttgtccatagtgtggatagkactagtctcatttctctgagaagaaaactaaggcgcggaaatttgtctaagatcacwtaactaggaagtggcagaactgattctccagccctggtagcatttgctcagagcctacgcttggtccagaacatcaaactccaaaccctggggacaaacgacatgaaataaatgtattttaaaacatctatttaatgtattttaaaataatttgtaagttgattttaaaaccaatttaactacattccaaattatagacagcccatttatatgggagtaacttttcaggctcattgcctcgccggtgatgagaagaactagctagctggaagctgtgggaaaaagaggtaaggtaacttgttctgtcgaagttctctaaattctcttgcttacttgccacacccctaggcccccagcttcccctaacccaaggtttctggtattttctcgtactttatcaagactatggaatcttaggagacttaacaaaagcaaatgagaaattatgtttagaaatgtctaacaaaatgaatgctttgtccttttaagtataacacatacctcaggcctcaccagcacataactacaaaaggttgtcccacttcctttctgtggctgagttagtagaacacaggctcccacctgccacatcagcagaaggtcacctcaacatgtgagctacctccccggagaccccccagatccgtaaggatgatgcatccttgatcctaaaaacattttcctgttcctggtgttcagaattggactccacactcactggtctctttataatcttgcttctggccctttgaggcctcaaagctaccagggccttgctgccaggggacaatcaccgctcccggctgagtcctgcagacatagggcctgggctggctgcctcctcctgctggcccagcatcttgcttgcactaaagagagctggaggcttggcactgatgcttgctaaaaacctacccaggccgcccactgctgccgcactgcagggcaccagcccacactcctcccctcctggcatcaggcacacgttcacggcactaaaccttacaggaaagcagtggaaccctgtctttccttcacaggaggcactttccttcctaggcaaaaacgatgatacccatgggcacagcatctcacatagggacacatagagatgtctgactcattaaaacccaagtctctggccaattaaaaggggtccttaatgtcctactcaacagtggtggaaggaaatttgctctatattgatgaaatgaggtggagaaaatctgattttccaaacatgagaattctccatatgccaccccataaccaaagaccccttatttgtgttagatgaaacattcaaagagcctattaggatagcggatgagacccccaagggacatgcttatacaacaataactggctccaaaccacactccatggcagtggctctcaaatgccagctcacatcacaagccctgtgctaaaacacagagttctgggccccatcccggagtttgtggttcaggaggtctggagtgtgacctcagaatatgcatttctaacaaattccccaggggatgcagatactgctgacccaaggccctccttctgagaaccactgttccagggagaagaaactcagctaagtaagggtttggctttgtgctgaagacaatgtggaatttagagttggggtgaattattcaggaaagtagagaggtttggagatgtgagggtgggaagcgcagtggagggaggcagagaggaaatatgaagcagcgtcagttggagagaaattaggaagaggaataaaatgatatatgccagggatttcagttttgctgagcccatgatgacagactcttctctggcaccttatgccactcattgagggcttgtagctggctctgctctttcagagtcataatagggctatgggtctgacctcaaggtgagctggaatgggcacaagtaatagataaaactgcaagaagtcactcaagggtccttcctagaacaaaggatccctacattccaaaggcgaatgccggtcactatcataaaagaaaagaaagaaagaaactgatggtgacattttaaatggcaatttttctagcttctaaaaggttgtggagcaactggaactttcataccctgctggtgggaatgtaaaatggtataatcactttggaaaaattggcagtgtcaccaaaagcaaagcctatacctactatccatttcactcctcagtatttacccaagagaaatgagcatgtatgtccatacaaagatttggacccaaatgttcatgacagccttatttatatagcctcaaactagaaaaagtctgtctatcaacaggtgaatggataaacaaatactggcctgtgtatctaatggaatactgctcatccacaaaaagaaacgagctattgatacacacaggagcatgcacgaaatctcaaaatgctgaatgaaggaggccagattttaattttatttttaattatttatttatttatttatttttgagacagagtctcgctctgtcacccagcctggaatgcaatggtgtgatcttggctgactgcaacctctgcctcctgagttcaagcaattctcatgcctcagcctcccaagtagctgtgactacagtcatgcacaagagcaactgactaatttttgtaattttagtagagacggggttttgccatgttggccagctgctctcacactcctgacctcaggtgatccacctgcctcggcctcctaaagtgctgggattacaggcatgagtcaccgtgcccagccggaagccagatattttttaaaagtacttattttgtgattctatttatataaaattctagaaaatgcaaacaaatccatagcgacagcaaatcagtggttgctggagatgttggaggggagaggagaggaatagattgcaaaggggaacaaggaaattcggggggacagtggatatgtctgctattttgactgtggtgatggtttcattggtatatacatatgtcaaaaacgtaacaagttgtatacgtgatttattatgtgttgactatacctcaaaaaggctattttttaaaatccccctcaggctccaggcactccattacgttggtgtgacttgtcttggaaatatactttgagcatttgccggaggagatccagtgcctgggcctctgtttcttctcccaagtagaattggcagctaaaacgggatgcccatgggcacaacttgtcacccccatcaccgaacagggagcagaaggaggctgctgggggtgcccccacagggagcacagtctcatcgggaatgacctgccatggcaaataaaatcaccagggcaagtcaagggagagaccagggaagagagtgatccagtctatattaaaaaaggatgagaaaggttgaagaaaaagagaagaagggacagaaattctcttcacacatttgcagaagtaggtccggactctccatccacttctcctcctccgataggtaggacaggaatctcagaggaaatggcatcatcttcccatgtttacagacacagcaatgaactcaaagaacaatcttatcaggattttccaaatgaaaacatggagcatatagagaataaagatccataaactcgtatggtggctgagactgaaatggttaatgaaaagcaaaagtgtgtgctgaatgacaccagccacaatggcctgaacacttaagtagtgtaatatacttggaacattgacagctaacaaggtcttcctcccatgtcagaccaagaacacagtttcctaaagataaaaatagcacatgcttttccacttttccataagtgactgcattagaaaactaacaaaccatgaaaagcaaaatatggctagtctcttcaagaaaaactggtgtttctattttgtctgtaaattactttctaatacaaaaaacaattcctgttacattgaggtaattctaactagggacatatgagagagagattgaaatctcatgagctgtctccttttcatctcaattctgtgtactcgtgggtacaaatggaactagtttttgtttgtttgtttgttttttgagatggagtcttgcgctgttgcccaggctggagtgcaaaggtgtgatctcggctcactgcaacctctgcctcctgggttcaagcaattctcctgcctcagcctcctgaatagctgagattacaggcgcctgccaccatgcctgactaattttttttttgtttgtattttttagtagagacagggtttcaccatgttggtcaggctggtctcaaactcctgacctcaggtgatccacccacctcggcctcccaaagtgctgggattacaggcgtgagccactgcacctggcccggaactagttttaaaacaggaaacagttgatatactgaatggaaaaacaatacaatttgaagttgaaaaaacaaaataagatgcccagttaaatttaaatttcagttaagcagctaatagttatttagtataagtacaacccatatacgacaattgcagtatttgttatttatctgaaattcagacttacctgggcatcctagtatcctgttttttgttttgttttgtttttccctttgttttcttttttttccccgaaatctgaccaccttaactttaaggtatttattcatttttaaaaactaaatatttttcggcagtcagaactagagcaaagataaatgatcccaggactctgtttagcaggcagtcaggaagtgtgacagtgtggtgggtggcagccccggccaggcctttcctcttccctaaactgccacagcaggactgccacacttgggaatcccagtttccatctgagcagcccctccagagtttggaaggagtcagtgctttagcctgaggagccgtggatggctctaacactttgcttgtcggttgaataaaaatcaacccaaaggtggcctacactcattgaagtaggaatgccagaacttcagtggtgtcacatagaagaaaatatctaagtgcttagggagatggcagtgctagtggatctactggatcattaagactcactcacccacccagcgcaggtctagaggacacacccttgccacactgggaagtgtaaatgagctccagcatctttatttttttttattttttatttgttttattatactttaagttttagggtacacgtgcacaaagtgcaggtttgttacatatgtatacatgtgccatgttggtgtgctgcacccattaactcgtcatttaacattaggtatatctcctaatgctatccctccccccgcccccggtgtgtgatgtcccccttcctgtgtccatgtgttcttattgttcaattcccacctatgagtgagaacatggggtgtttggttttttgtccttgtgatagtttgctgagaatgatggtttccagcttcatccatgtcccgcatctttaaaaaaaaaaaaaaatctctaagtggtggctcttctctgtagatcaggagctgtagtgagcaatgctacaaaactggagtttctaaatacaggggggatggtgggattctgaggaaggacaggccacgtggtaacacttacaaaagaccaagtgggtgtggttgccactgtggacggtggagccaaagcagtcctcagaatagtctgacccccagaggtctttggcattggctggttgatcatggtgtccctggaattgaaatagaaggacggtctactaaatttttacctgatctgtataagcagaagagttctatctctagtgaacagaagtctaactttagtcaccagaactgagagtcaattcaatcaattcccagatttgacatagtttatagacctagaaccccttgaatgaaaggtaagctggctccccttgaggaaggaccctgttacatttccggcattttattctgataatcttttttcccagccttccccaaagcaacttagggccatttaccagggaaagccatggaggaaaaggaaataattaggctatttggagattccaggacactggctctacgctgacaccagttctaagagacccaaaatatctttgtggtctaccagccaaagtagggcttcatagaggtcaggggtcactagagtttgagctcaggtctgtttcactgtgagtctagag

SEQ ID NO: 17558 - DNA, 49513 bp, Homo sapiens
  misc_feature (1)...(49513): n = A,T,C or G, or insertion/deletion polymorphism (see Tables 1-2)
tcaaattcgaaaatctggggtcacaagaatgaggcatgaatttaataaaacaattagtttttcaccactaaccccagggaccaggaaaattatcctctgtagtagtaagaaattcaaaggtatagttaagaaatataaaccttatttttctccactgtaattcaattatcaaactctaaggatgtttctagtatagctctaattttgcaatagtgcactgggagaaagccaatctgtaaagcaagtttctatgtcattggaacagatcaaggtccaaagtgtctctctctctctctttctctctaatgttcttgtttaatggaatgcactttcaaatgtaatttatgccttgctttatggatcacaaagatattttgttaaatatgccagatgataaatacttacaaattgtttatcaactcttataccatcaccccaagaagaaaatgagctaagattttctttagcagcaaaggtgattatctcatccagaagtagctgggtgaaaattcacaaagcaaatgttattgactgcctatcagtctctgagtatgaaaactatttccctctgagtaatcaaagaaaatccctgagatttcttgctgctcttttctgtcttccagataggcctagtggtgggggttgggaggaggtgggatttgccctcaatctgtagactccacccaatctgaggcatggattgaggcaaccagccagcagagtccaggaagctggcataaccaggcctaaccaggaaggatgcagtgtctcttctggcttctgcaatctttggatctgacctcttttatgaagtttgccctgggatggcaggactaaccctcgcatcacagcaggagctcccaagagatattttttaccaatccttctcttttcatgctcgtacccagtaccaaagtctctcatgttttctttccttcttttgctcttaagaatcccaaaatccctggggccaggaaggccttgggcttggatcttcaggcagaagtgggctgttttcacaataacctgtcacaaaacaatgaagtctttctcacccactcaatatttccaagctccagctccaatcccagaccatgtgttctgaaaattccatcttgaaagagaggtagttgatgcatacaaggttttatccacctaaaatataagaaggaaaaaaatattaaggataatagtgtttgttatgagtggggtgttttacaaacatttcttttatccttacaacaatcttgtgaggtattgccatttctcagttgagaaatctgagatctgagataagcaacttgttcaggattatactaatattatctggttgattgagcccatttactctccccacctccacccccaccccaaaattcccttcctcactctctctctgtcttttcctccgtgtttccaactctcattttctagatcaaagttcaaaataatgaaaacagtgggtaattagcttgtgaatagatacaggcttagctccattgcactctaagcacctgatttatatttatgtgcttttgtccgtctccacagacaagttccacaggtttaaaaaatatgctgtgtttgagaccagcctggccaacatggtgaaactccgtctctacttaaaaaaatacaaaaattagccaggtgtggtggcaggcacctacaaccccagctacttgggaggctgaggcaatggagaatcgcttcaaccgggagggtggtggttgcagtgagccaagatggtgccacttcactccagcctgagcgaaagagcgaaactccgtctagaaaaaagggggggctttgttcatttctgtttataatatctggaagatcgcctggcatgtaggcatgtataaggctttcaataaatacttgttgaatgaattaacggacaagcagatgagtgaaatagaaaagtctacaaatagacctaaatacataagggaatgcaaatgatagagttcatattttaaatcagcagaaaacatggattattgcaatgaactgaatgtttatgtccccctgaaaattcatatgttgagaaaccctaactcccaatgatacagaagggctggactcctgggtaaaccccacccttaagcttgaaacctcaaccctaagtgaagacaactgaccctgtttttctgcccaaatgttgcctttttggcttgcccctgcctctatcttatgcccatgaaagacttcagctggcatggcaacacaagcagctgagcatcagtgatataagtggctgagcgtcaataatacaagtggctgaggagcaaatagagaaacaactgagtgtcagagactacaggtagacatgactaacttcagaccttgtggcttcagagaggggaccagctgaagatggctgggcttcagggagtgatcatctttccatcccctttccagtttccctttccactgagagccggcaccgctcaataaagtcttccatattcatcacctttcaaacagttcatgtgacctgattcttcctggatgctgggcaagaacccaggtgccgagagggcaggggctgccaccctgaccctccamtaagctggttggcacttggccatcctggatgcagagctgaaagagcattggttgaatacacttgaacaccactacagggttcgcacggagcctgctcccaccagagaggaatgcccagcggattccagcattcagttcactcaagtttccacacttggttgcttgcatactctctcccacaaggagtggccagcgatgggttgaatgaaacgagccactccagttcctgcctgcaaagggggtcaagagcactgtcccgtctcatcaagggtattaaaaggtggagttggccaggcgcagtggctcacaccagcaatcccagcactttgggagacctaggtgggcggatcacccgaggtcgggagttcaagaccagcctgaccaacatggagaaacccagtgtctactaaaaatacaaaattagctgggcgtggtggtgcatgcctgtaatcccagctacgccagaggttgtggcagaagaatctcttgaacccaggaggtggaggttgcgcagagcagatgcttctttctcttgattgaaagaaaggaaggatgggcatgtagatatatttgagagaggagatgggaagttgaagaagtttgcagcaaattgagataagcacaggatggctagttttgaaagaaaataaataaagctcttgaattaaaaatgtgattcatggcccacatagttttagttcataagctgacactcaacaatattaacattaaattatagattaatttgactaaatattttccctttgataaagacacctatcacccaaggaatgtactttacagaagtaataactttcagtttcatgtggagtttaagcaaatacattcaggtttctatggaaataatgttaaacctatgtactcaaataaagctaaaagtgttgtgttttgtttttttctgtttgtttgtttctgagacagggtctcactctgtcacccaggctggactgcaatggcgcaatctcggctcacagcagccttgacctcctgggctcaggtgatctttgcacctcagcctcctgagtagcggggactgcaggcataggccaccaagcctggctaatttttggtagatatagggttttgccatgtttcccagagcctggcctagaacttctggactcaagcaatccacctgctttggcctcccaaagtattgggattacaggagtgagccaccgtgtctggccttaaaagattgttaaatggagaccaggtggaattactatggcaaagggcatgtattgccagcaaaatcttcccatgaaggcttatcttaccctaaatacaaatcagctatgaagaggaataattctgtattatgcaagcaaaatggtttagcaatcatccttgtgacattgtccaagatctatattacagaattacagatgcttagatttctttagtctaagactgtaatgcactaaaacttatgcaacacttctatatttgattagataagttttgctttgcaccaggggaaataaataaatactttttctaatgagctctgtatacaatgactataaaaaaaaaaaaaaggagagccctagaagataaattttataacttttcttttactttgagcagtttttccttataaatgtgtatgattaatattttggtcatattatattataggtatggctcatagagaagcaatttagaagcagattagggtttgaagttggaagcttaaacaaatccattcttaatcctgacaataaagtttactgtcaaaattgttggttacagatacttaaattgctatttatttttttaaagaaaatgttccaaaacataaaacagtaactagttttgagaccattgtcctctataagggaaaagaaaatatttcagacacatttaacagatgccaatttcagtttctcaattatgtcatcaaggtattcttcaaaccaaatataaaaatatatatataatttctaatcactcactttttatacatttataaacaggcagatacagatacagatacagacacaggcagttatttgggttaaagaagctggcattttcatggggtttagaaaggaccgtgtagtccatgacatttactaccaggtatcagaggaaaagcataagcagttccttttcttgaacatttgccttctaattgaataggcattggaatacacaaagtagagggtttttttaaaggatttgttctttcttttatctactacaaaatatgagtatttctcaatgatgacaataataattaccatttatcgaatgtttattgtattcctgtctttgtgccaaccacctgacctccgttatctgaaaaatctttccaacaaccctatgacatagatattgttattcttcatttacaggtgagtaaatggaggtttacatttgtatggaacatgttctgctacttgagataatgggaataggagcctaggagggctaaaagcaaggagccagcaagtctagacacattccagaggacattatgtcagtcatgcaagccctgcctcagctttcttcccaaccctcagccttttttcccaacagtatataaataatgtggtgttcctttcaatacaggtgtctctaatgctagtttgttccattcttggtgaagttaatttgaatcacatttggttagcatgtttatcagtttttttctactgagtttccttttgtgaagtaagaacaaatatgtttatgaatgtagagttagctgtgctaaaattaaatgaaaagtcaagcaaactacccagatagtttaagccaatcacccaggatttcatgaaccctttgagccatttatgtttcccttgagggatatttcacatcttttacctgagagttctacagggcatgcttttattagttgaaatgtcactgagggcgagagtaattgttcaacggatgtacttgaacttggacatttaagaattaacagaacgggctgggcgcagtggctcacgcctgtaatcccagcactttgggaggccgaggcgggaggatcacgaggtcaggagaccgagacctttctggctaacacggtgaaatcctgtctctactaaatcctgtgtcggattaattcgttctacttgctattaccaataaatagcatgggctcccagagctatgcctggctaactctatcaccttcaagggtttgctcaaactattcagcctactttaagtaaatcaatttccaaggttacaaaataaacttcacgtacatttttatggttaggtatttgcgcgtatttgggggctccatagctttcatccgttactcaaagcgcttcaggacgctaaaaaggctcagagctgcttcgataaacaagaaagaatgctgcaagcaaaggcagcagtttcgctgtaaaatcctattgctgacagccaagacgggcgtattccctcgcgaccagcctgtggcgtggttggggctccggaagggcgcgcgcgagcgcttttttgggaggacaccacaggtggacgcctcagctgatcgtcctccctcccggggaccctgccccgagtcgccgagtagccgcagagtcgcctccgtcsccccgccgcccctgtgtttcggacatggccgcacgccttctccgagggtccctacgcgtcctgggcggccaccgtgcgccgcgccagctgcccgccgcgcggtgagtgccagccgggacttccgcggctgcaggccgggaggctgtggggtggggcagcgagtcactcctgtcgctggcttgaagcagggcggtgcgcgcgcggctgggagtgctccccaactccggcgccgggctagagctggcctcctttcctggatcccgcggactgggtgcaaccagcatctgggcggaggaaaaaggggtgtcagccgtgcmgccccgagaacagaccgccgagcccacgtcggggaaagccgaaagatttctccagaagttcattccggagccccaatccaacccgtctagttcagcggcctgcagtgggacccgggagcctgcgttttgggaggaggtggtcaccccctgggccsggctgcaggagcgcgggctgcgatctgtgtcccagttcgagctgtgaacccggcgttccccacggcttagactcgccgcgcggtagtgaacttgggacccggactcagtgcccgggctgcggcgcggaccagaattgtccaggacaaactgggctagaaatgacctggcgagggttccatcaaacaaggaaattagctttagatatatcaacaaatctaactaaatacagaggattaatgaagacagagtctaagtagttcagtgactactaaggtggtgtttataatatgatcaaaagtttcagatactgtctgatgcataaaatctattcactgggtaaacaaattggaagcatggagaattcattatttaataagggtgaaggaactggcaaatttgcgaatgacagcattggtgtaagctactctaattttatttgagagctatgaaacaaaatgcctacttttcctggggagatttgggaagacgtcactgagaaggtgacttttctttaggatacatacttaactcttccttggaacattataagacagtgatcctcaaacttttttttttttttttttttttttgaracagagtctcactctgtcgcccaggctggagtgcagtggcgcgatcttggctcactgmtgcaacctccgcctcccgtgttcaagcaattctcctgcctcagctttcctgagtagctgggactacaggcaygcaccaccacacccggctgatctttttagtagagacgggggtttcaccatattgaccaggctgggctcaaactcctgacctcgtgatctgcccgcctcggtctcccaaagtgctgcctcaaaactttttgataacagggctcccttatgctcttaaacaggacctcaaaggacttttgtttatgtaggttatatctatccgtctgtcgttatcgaaaggtatctacataactgagaaactttacagatatttagtttatttaaaagttacaataagaagctcattacatgttaacataaataacagtttttatgaaaaataacttttcctaaacagaaaaaaagtgaaaagagtgacattgttttacatttttacaactcccttaatgtctggcataatagaagataaccagataactatatctgcttctgttttatccattggcgtaagttagtttgattgaagcatggcaagaaaatctaccctcaaatagagaacactggaaaaagggagacctgagagaccctctgaatgggctggggggctacagttttgttgtaacagcttttttacctttaatgtgcaaaggaatcacctgggaatcttgttaaaatacagcttctgattcagtgggtctgggatggggcctgagattgtgtatttataaccagcttctaggtgtgtggaaggtgctggtggagattgtctcccttttaaaatgtaggagactttaaaaaaacaataatagcctagccaataagattagttgcagtttattgccttagagaaaaaaatgccaatttttccattacagatttcttcatctttagactgagaaatacatgttgcaataaacttgctgccaagtgttttgattttcttccctctgcatattctctcttgaccacctttgactgacctgaaagtctttattcgtttggcatttcttttgctttcctatgtctttatatattttacttaaaaatattgcagagatttccttaacacagtacaggctattcaattttaagatccagtaagactcgattttaaattctggctctattgtttactcattatgttgacaaatgattcggtgtcttacagccccagtttcctaatctcagcatatttttttcctgagggaaactctcaagtatggaaaatctatatggacaaatacgtgctttataattttatctctactagcaagaaaaaggagccgatcatttccattatagggataaagtagatgttagtttatttgatgcaacaggacaatggtcaaggtcccctgcatgtcctggtcccctgttatctcttcttcctagaatctctggcctcatctactcttctcagcccactctggctacaattgcctccttgctctttctagaacacatcagacaccattcagacatacagcctttgctctagttgttcttttgtcctaaaattcttttattctagaggtatgcctggctaactctatcaccttcaagggtttgctcaaatctcacctttctggtttaacctaccctgactgcagcacttttttttcttttccttttttttttttttttgtttgtttgtttgtttttagtgacaaggctcactatgttgcccagactggtttcaaactcctcagctcaagcaatcctcaggcctcggcctcccaaagtgctgggattacaggtgtgagccaccaagccccgcctactacattatttcatacggcaacctctgtctctgcctccccccaggcacatactcctgatcccttctctacttttctttctccataatacttaccaccttctaaggtattatacaatttgcatatttatagtttattgtttattcagtttccctttgttagaatgtaagcttaaaagccaagatctttgtcctcatcttagtcctttgttcgttattgtatcccaagttactagaacagtgcctggcacagaattggcactcagtaaatatttgctaactaaatgaatgaataagccacaaaaaaaatgatacttagggaaaacttagaaataggttgtaatagcgactgggcacaatagctcatgcctgtagtctcagccctttggaagctgagatgggtgtatcacttgaggtcaggagttcaaaaccaacctggtcaacatggtgaaaccccgtctctactaaaaatacaaaacttagctgggtatgtgtggcaggcgcctgcaatctcagctactacagaggctgaggcagaagaatggcttgaaccgggaaggcgaaggttgcagtgagccaagattgcatcactgcattccagcctgggcgacagagccagactccatctcaaacaaaaaaaaaaaaaaaggaaagaaacatgtaatagtaaaaagttatttttttaaaaaccctttaagtctactttgattaattacatgaaatagatcttttctggataaggactagaaaagaaaaggcagagtccaactaaggaagaaatacactaaattagaatttaatgcaaaatagaaaaagcatcctttggcaagatttgaatatatgataagttttttagatgtgaacttgaaaatgtacaaaatgatgcatagattttcaaaatttctttcaggggtacttcaagggtaaaaaaggctgaagaccactgaactaaaggagctacaaaactgtctcatttgaagcttggtgtgggagggatgggagtaggtcttaaataattccattttacagaatctttatcagagattgatgggtatttttatctccacccagattggctttgtaatgtggcgattacatcaacatggtttgcatcttatacacctgcaatttgaaattgtgtgattctggttaaaatactaattttggaggctttgcattattttaaacattgtatatgatatgaaaatttatcagtattactctaccgtactatttgaattttacataatgtgatccatatgtcacctgacaatactacatttcacctcaagtcagacctgtggttagttctaggcatcatcttctttaaggatttggagatggagaccgagttgaataatgataaggtacttcttaattccagctacatgaggtagatcccatcaaaagtggtggcgcccaaatttgaacccagctttgtcataattcaaactctttctacttgcctctcaagtttctctgtgaaagaaatccatgttgttcagtggcactaatttggatatgaagagtaacaattcacttacttttcctattgcatatatatatttttaagatgttctcattccggaggggaagaacgtctagaaaytccttctgctaaaaaattaacagatataggaattcgaagaatcttttctccagagcatgacattttccggaaaagtgtaaggaagtttttccaagaagaagtgattcctcatcactcagagtaagtggcacattttcctctaatgtaatgtatactaggggtattataggaccatttcctagaatgccatatattgctatacagaaaacatagtatgttcagggctttattaacatttttactgctcttcactgtagtactataagatcccaggattcttagagctttttaaatgaattttaaaatgtactatacacaaataagaaaatttgaaaatttacaacttagtctaagagtagtgtttttgaaaaccatgggtaagtggtaacaaaatactagtcaatttcatagtctttctttttctgcttcatgaattaattaaactgtaaaaacccaaaaagtcagcacaatgcaaaccttggtaagcaattggttacctctggatagttcttgattaactaattattattattttattgaccagaaacttatctatttctattacaataagattttgcttcatttccaaaattcactcaatgctagtacagatgctcctcaatttagtatggggttacaagttgaaaatatcataagtcaaaaatgcattgttattatgttaacactgttactatgttattataaaaacaaaaaaattctcggcaccgttattatgttagaagcagaaattagaagattagtaaaatgaagagagaaatggttcaggaacatcataggtttgtgaggttttacacacctagcctactaaaccccatagtttaggccagcctacattaaacatgctcaaaacaattacataagcctacagttaggcaaaatcatctaacacaatgtctactttgtagtaaagtattaaataactcatgtaatatattaaatatatttaatatatgttaaagtgaaaaacaaaatggttatatggatacttgaagtaagcatgttttcgactgaatgtgtattgcttttgcaccatcataagtaaaaaaattgtaagttgaactgtcataaagtacagagacatccgtactttaaaacatttagaatggtttttaaatagcattaaaagtaacttccattaggtttttactaataccttcttggtaagaatgaccaaaataagctaaactcagaagccagaagccatgactagtcttcggtgaaaagcaactagcttctgttttttgaggacttgtttgtttgtttgtgtgtttgtgtgttttttaagacatggtctcactctgttgccaaggctggagtgcaggggcatgatcatagctcactgcagccttgaacttctgggctcaagcgatcctcctgccttagcctcccaaagtgctgggattacaggtgtgaaccaccacatcgggcttcaactagcttcttaaagacaaaagagacattgtacactttgctctggtaggatctcttgtttatttctcactgcttttaaattttattccagaaaaaatgttaagaaggctttgaaataaaataataggagctgacaaattttaagtcaataataaaaatatttccaaagctactttaagcaagaactgtattcaaaacacacatgataatccaagtcttaaaaatttttgtagtgtcagtatcttcaaataccccatatctcactataatccacttaaaaatacaaaaattctcagatattttttcactatctccaactagccatctgtttcctcattctgccattctcatttttaaagaagaaaagctgaggttgcctaccttacacaaatatctaattttttcagaagttaatttgatatagagccatggtgtaaggtgcttctgctctcctgttcttcctatttaaactgtaatgaggttccctactttgtcagcttttgtatgcttgtaccataagttcagcactttaaggaaatatgccaaggagaattgccttttacaatacaggttaggcaaattcccatgacaacatgccataactaagcttgtatgtaagagtacctgctgagcaaaactacatcaatgaatatcagtgggtataattttcaagtccaataaatagtcaagatgggggaagacaatggcaaatataaataagaggagagggctgggtgcagtggctcatacctgtaatcctagcgctttgggaggctaaggtttgaggactgcttgaggccaagagttcacgaccagcatgggcaacataataagaccccgtctctacaaaaaaaaatttttttttaattagcctggccttgtggcaggtacctgaagtcttagctgctcaagaggctgaggtgggaggattgcttgaacccaggattttgaggctgcagtgatccatgattgtgccactgcacaccagcctgggtgacagtcctgtctcaaaaaaaaaaaaaaaaaaaagcagaaaaaaggaggaacagaagtgataaaagagtcagaggcaaatagaagcatatggctaatgtaaataactacctttaagaatgcatttctacacaaaatcattcataagttcaaagttgtggccatttaaataatatttaaaaattatctgaatttaaaatatttgttatttgcagatgggagaaagctggagaagtaagtagggaggtttgggaaaaagctggaaaacaaggactgcttggtgtcaatattgcagagcatcttggtggaattggaggggatctgtactccgcagctattgtctgggaggagcagtaagtatggagacttttaaggttgagtcttgttttgtaaacacaccactcacctttctgaaatgaccaaacaaacaaacaaacaaacaaatgttttctaatcttggaagattgaaaattcagtgtaaaatgtaaaagattataccgctcatgcactcttgcacattttttgaatgtgggataataagaaaatccttttaagttgctgaaataggtgctattgaaaattaaagagatagtttttttttcctgtcaatgcttatggttacttttcccccttagaaaagatatttgaaagagaacagcagagtagaaatatacttccatcaaatatattagaaatttaatatacaagaacaaataaagattgcagttgaaaaatgggcaaagaatttgaagcaataattcatcaaaaaagaaatgcaaatatgtttttttaaatgagaaaagttcatccttagtaacaatcaaatgcaaattaaactgatctggaagtatcattttgagcatctataaaattagtgaaaatgaaaaatcctaatacccagtgctgacaagattgcagtgaaagtgacatacactattggtggcattataaattagaacaataaattttggggggattaaaaaggtgaaaacatattttaaaaaatatgttcctgctctttgacatagaatgccactttggggaatttatcctaaggaaataatttaataggaaaaatagatgctgtgttcagaaatcattgtcatgttaggtcacagttctccaaatgctgaagcaatctaaatgtccagcagtgggagaatggataagtaaattatggtacataaacaacttggaatattttgcagctatttaagattaaaatatatgtaaaaaaataggattttgttgtgtcatataatttatttttaaattttaaatttttatttgtgtgtgtgtatgtgtgtcataattttaaaagaaaatagcaaagtacaaaattcactccatgactccatgttttgttttgttttgttttttggtccttttttttctttttttctattttttgcttttttattttttatttttgttcttttgtttctttgttttaccaagactccgtcttattagaatatatccttatggcaaaggtaattagaggaatacagttattattccactgtgttagaggaatacaactgcaggtgattcatattttaaaatattttatctctcaattaaataagtgttcattgaactctggtagaccactgttattgtgttggaaccagaaattttaaaattagtaaaaacaaaaagagaaaacactcaggaatgtcataggtttgtgatgagataggccactaccaaacaatttgataggaccttaatacattgttgttataatagtcgttttttattgctattttatgctctaatttttcttcttttttcattctaagagcttattcaaattgttcaggcccaggttttagtattcattcaggtattgtcatgtcctatattacaaaccatggctcagaagaacagattaagcactttattccccagatgactgcaggcaaatgtattggtgcaatagcaatgacagagcctggagctggaaggtaagttaatatttagttggytttggattcttggaagcagtgccttaacattttcttagtacttggttaatacatagactgagctatatgctaggaggaaggcaaagatgaacacgggataattcatgacctcaagtcggaaaataacaataaagcggattataatgtaagctatgtttgagatattaacatagttttatgcaaagaaaatggtagtgtgtaagttgaattttcaccataatgaattttaggtgtaggatgagattcacatgtaaatgccaagcagtttgttacagaggtatatttggaattctggagacaaggatggagtagcaataggttttaaaagtctttcatttataagagttgatacaataggaatgaataagatcacatattcagttatttgctggttatttcataagtgtcttcagtgtgccaggtatacagtagtgaacaaaacagatgtggcctctgtgcttattgaggagaagggcaagggcaagaaataagcaagtatatatatttgtagctataaattatgataagtactgtgaaggaaatgaagtactgtgaaggaaacaaagtagtgtgctgtagactaatggtatgtttgtgtttggtgggatagggaaaaacgaatttagatgtgaatgctaacaaaggcctataaaaagtggttgtatttaaactgagatttgacaaatgagaagaaaccagttttataagaatgggagaaagagcttccacagagtgggacctgatcctcaagaggaaaaatgaaacacaaaaaagggaccaaggaggaaaatctgggcattatatttcatttggaactgtacaaaagaagatggagcaagagagacagaaggattgagagttttaaagaaatctagacatgagtaggaagagaagtcagttggaaaggctgtaggaaaggagaaagwagttagtaatgtcaaggccaccgtgatgttgagaatggagaagaggttttggcaggcctgatgatcctttgtgatttcagtggggtggaggggcagaagttaccttttatgggagtgaggtggttgttgagaaaacagaggcagagaacacaaagtaatctttctcagagctgagtggtaaaaggaaatgtagagagggggcagtggtttgaggctaactggtaagggaaattatttatgttaaagacagcagcaacttgtgggtcaacagaaagcaaatagtgcaaagaaagaacttaaagatgccaaagaagtgtaagtgaaaatccaggaattgtttttgcggaggtcaggccctccttttttattgtaagattttcttttctgacagtgttatttatttttaaatctcttaatattctatagcatgacttgcaatatgtttacattgtatttatctttttaagatataaatccctaattataggtcaatactaacaattttgtcaaagattaaaggtttctgttcacttctgttgcctacaagtgtgatctaaacaagtagaaatttaaccttgttccttaaaatttgcttttaatttcattctctaagataactacctgactgactgccaatattcagattgagttgtattagctctgtggttagcatgttccacttccagctcattgcatattagctctcaaaaagaggctatagaataaatgaaatcttgatttatctctaatttatacatgcaaacaaaggttcatgtgatttttgtttaaagtctctggccttatctgtggttaagtgtawataattaagaaggaaacctgagaatgaagatggagaaaataagcagatttctttctttctttctttctttttytttctttctttctttctttctttctttctttctttctttctttctttctttctttcttttttggaaggtcattgaaagtcatgaraggatatagtaaataagtcaggtatttagagagatgagcaaagagcccatgtgggtaagagaatataagaacagagaaaagccacagatgaagaagagtaatagagtgttgaggaattacggaattatggcatgaaattggcatgaaatagggaaaaacacgtgggaagaaaagaagatagaagatggaatatggttcattttgcctgccctcagagatggattgagcactgtctatatttttggtttgatttggcctccacagaaaaaaatgttgcaattgttgaaaaacatccagagtttcactggccctttccccttccatggaggaaagcttcattatatataattatgtatctttgtatgttgtattactttagcattttataaatgctttcatgtttattttattattttttaaagaaatagagatggggtctcgctatatttcccaggctggtctgaaactcatggactcaagcattcctcctgcctcagcctctcaacatgctaagattataggtgtgagccactgcacctgatctcatgttgattttattatatggctattataataagatatatggaatatagagatatgatttctgtataagaaggaaacagaaaataataaatgaagtattttgaccaagttcatagagcaaattgttgacatctttggagccagagtgttctgacaccagctgtgtgatcttgggtaaaaatctctgagcttcaatgtctcttatcaatgaaattgagaaaatgatactgaagaagattattgtgagggtctaacttgttggctttactaagtagtatactttttcatttttaatatttcatatataacattcaaaaatttaggaaaaatttacaaactgagctatgtcattacctttatttcctttgatatgtccctgtatagaagaattttttttttttaaacagtctcgctcttgtcacccaggctggagtgcaatggcgcgatctcggctcactgcaacctccacctcctaggctcaagctattctcctgcctcagcctcccaagtaactgggattacaggcgcccgccaccatgcccagctaatttttgtatttgtagtagagacagggattcagcaggttggccaggctggtcttggactcctgacctcaggtgatccgcctgtcttggcctcccaaagtgctgggattacaggcatgagccaccacacccagctatagaagaattgttttaataaactatgtacagacattagttaccgatactttatacatacttatgatgaaaaatatgatgttagaatacaatagcattcaggctgggcacagtctcttgtttatagtggaggtcggtcatataggcaccctctgcctggcatgtaccaaaagttcagatccctaaaaggaaagcaggtattcagcataagccaaattgtttgcgcaaacagttcagacagtaagccactcttatgagtactgggaatggtgggaactctcctgaaatccagattctcagatgttagccacggacaatgttgtaacaggcctttctaaggatagcagtctcaggcctgctatattaattcttttctgtatacttggcattttaataatataatttaacaaatgtttattgagtgcccgttatgtacaaagcagcatgctaggcaccaagcatataaatatgatcttgatacaccacatgttctcaaaaaacttgagtcagataagtgtggtaggtgggaaagataattcctttttattataattgaaattcaaagtaaatggctctaagagagtatatttgttgctttatggcgtctgtgacaaattagcagagacttggtggcttgagacacagaaatttattctcttacagttctgaaggctaaaagtccagaatcagtattgttgggcccaaatcaaggtatcaggagggccacactttctacagaggttataggggaggatccactcctttcctcttctatttcttggtggctgttggcgttccttgccttgttgcctcgtcactgcagtctttgcctttgtggtcacattgccttctcttctgtctatgaaatctctctttacctctcttttataaggacattcatgtttgcatttagggctcatccagataattcatgatagtctctctatcacaacatccttaaattaatcacatctgcaagattctttttccatgtaaggtacaacagcctctagggtataggacctgatatctttagggtcattattcagcctaatacagagagtgatttaaaaaaaaaaaaaatgcaaccaggtgcggtggctcacgcctgtaatcccaacactttcggaggccaaggtgtgcagatcaactgaggtcaggagttcaagaccagcctggccaacatggtgaaaccatgtctctactaataatacaaaaaacttagccaggcatggtggcatacgcctgtaatcccagatactggggaggctgaggcaggagaatcacttgaactggggaggcagaggttgcaatgaaccaagattgtgccattgcactccagcctgggcaacaagagaaaaactcggtctcaaaaaaaaaaaaaaaaatgctgaggggcataaaataaaaacaccactgtatttattactcagtttttgcattgctataaaaaatacctgaaactgggtaatttataaagaaaagaggtttaagtggttcacagttccaccagctgtataggaagcatggcttgggaggcctcaggaaacttacagtcatggcagaaggcagaggggaagcagtcatgtcctacatggccagagaaggaggaagagagagaagggagatgtgctacatacacacttttaaacaaccaaatctcatgataagtaactcactgtcacaagaacagcaaggggaaagtccttccccatgatccaatcagcccaccaggccccctcctccaacactgaagatcataattgaacatgagatttgggtagggacacagagccaaaccatatcacccacataaagaagacaaattggaaaaattacacaagtaatgtggactgtttatacactctgctgtttattataggatattaataaaaattgggacctaagtgttttaacaataggggattatttcttaaaattatggtaaatccatgatgatgctctattcagctaataagaagtcattagatattgttaacagatcaaaatcatattatatggttccagttttataaaaatgcatatatatgtatagttatgtccatagaaaaatattggaaagatatacctttaaaatgttcattccaggagataaaattatttttaaaattatttttctcctttggactgctgtgttcttaatattttatttactaatatttgtttctcttatatttagaaaaataatctattctacacttagagcaggtttgttagaaaaaaatggcatttgagacatactcttttttttttagacaaattctcactgtgttacccagactagagtgcagtggcctgatcatgcctcactgcagcttcaacctctcaggcccaagtgatcctctcacttctgcctcccaagtagctgagaccacaggcgtgtgccaccacacccaactaattttttaactttttgtagagatagagtctagctttgttgcccaggctggtctcaaactcccgggctcaagcagtcctccagcctcagtatcccaaggtgctgggattataggcatgagccaccatgccctgcctaatagctaaatttttgatcaatagagacaggggaaggaaccaaggtgtttaaaggcagcaaagtacatggtgacacgtaatctcagggatacagtgaggtttgaaatgttatgtgagtcccactggggtctcgaatgttagttgggctttgttatactactgtataaaacctggctaatttatanaataaatcttaatcatatatttatttgtataagtgctttagaatataatagatcagcatggtttttcagtgcaattgtgtgaacattcttaatactcagcaattttataatggtgtagccagtttgaataatctaatttacatacatacttatatcatttgtataatttaatttttatcatttgatgaattttttatcttttctttcaattacagtgacttacagggaataaaaacaaatgctaaaaaggatggaagtgactggattctcaatggaagcaaggtgtgtaaaaaaggacttctatagcccttcttttcagagtcatgccatgggtaacaatgtctcaaagacaactcattaattctattaaatctagggactcaggcaggaattgaatttatctaagttgttttggagacagtaaatttacaacatatattacttaagatctgtggtagcttcttctatatttcattttgcatgccccctcactaatatggcaaaggttgttttagcttccaaacagcccttattaaaccagaaaaagacaaggtgaggctcacattgcccaaatgtgggacaaatattaataatacttaaactttatgttgataaaagattgggggaaaagctttctcatatagatcaagaagaatttcaaaagattctaggagaaggccaggcacagtggctcacacctgtaatcgcagcactttgggaggctgaagcaagagattgcttgagcccagaagtttgagaccaacctaggcaacaaagtgagaccctgtctctataaaagtaaaaactaaaaaaattagctgggcatggtggtgtgccctttggtcccagctactcactcaggaggctgaagagggagaatcacttgagccaaggaggttgagacagagtaagaccccctctcaaagaaaaaaaaaaaagatcctaggagaaaaagatatcagtgatacagtgatagaatttgagagccatttgagaaccattcagttctactaaattaatcaactcactggtagaattggagagcgcttccaattaaggttacaaatgggctcaggatctctgatatcaatgagggcaaatgcatttgatatcactgagggcaagtgatattgcccacctgaaatggtatctggtatatactcagtaaatatttgttgttgactgagtgttacgtgaaggaaagatgttcattttatttactgttctaaaacaatctttctgaaaatatgtgccaaggtctgttgaagaattagtttttataagtttgggctattatctctgtatttacaaaattgaatcactggtgttcttcaaatatactttaataaatatttgtttaaataatttctcctaagaattataattaaacggatgatagctccaacatataatcagttaactcctcacatatagaaggcttgttttgaaaggggagtgggatatttggtcagaagtgaaatgggaaccacattctcttatgcctctagctctctaagcagacctcgtctgctcagccatagggttttgtgggaaccacacaggaaaagtaccactgactctgtttcaaaaactctattagaaatagcaaaaaactgaaagcaagtaaaagtaaaggaatgggtaagcaaatacrgtgcatctgaacgaatgtgcagccattaacactagcaacacaaagtttttaacagtacaggaaataattatacattaagtgaaaaaacaggatatagaatgcaagtataggaacatttttactatattaaaatttaaaaatatgagaaaggaaattatcaatgatagttgtattatgtacttatggagaattatattttcctttttcttthgaactttacattctctatacaatatctgcaatgattttctgttattttataagcatttaatatcctcctaccacccaaaaatgttggccctcattagggataatttcagccctattcaaactttggagtgtcataattaggaaacaaactgagaaagtccacttgcaaggaaaattctcatataactctattagaaagggggatccaccatggtgtttaaactcactttaggtcgcactgttgtagaaatggttcagattttattaatcctttgctataattacttccaataagaacttctggagaactccacttgatttaccaaattgagctcagcatattaaaatgaatagtttttgcccaatgaatttctcctcccttcctttctattccattgtttatttattatctgtagttaaaacatgtatgagaccatttgagagcatactgtagatactaattcctggatgctgtgtgatgcaaaacaaacaaaaaagcactcatagcatttcaactgtggcagctatacagacattaggaactagacagaaaggtaggagcttggtagacttataaggtttttgagcaagggagtcgtgtaatggagcaatactgttgaaaaaatatttttgccaagttgtatagaatttttttgaggaacatctttttcaaaatatatttttaaaacatcctttggcctcctctgtgccaaaaagaattctaagcacttaagatagatatatgaataggaaatggctatgagctcctagtaaggaggcacgttgatgatcttttattattgtgtcacctataaccatactgccaccactatattcatttgctgttgtgtagacaacactaacattatttgcccatttttcattatttgtatgtatcagtgctgtgcattttaggtgatgggagtaaccaacatcattttatacccctactatttcaaagagagagagataaaaacagatcattttggtaaatttgaggtgttgtaggaccgcttaacccagcctggagaatttgagaccttttggccaatctgatgtctaaaccacccaggatgagtacaattcattgcagcagagttgggaaagggcctttcccaagtagcagaaacaagattttcaaagactcataggtcaggaagacctcgcaacgtgatggacagcaagtagtttagtagagctgactgaagaagaggaaattggggaaagtgggacaagcaataagccaggtaaggagaggtaagctagtgccagtttgtgataagttttctatttcctgctaaaggttttgaatttatcctgaagcctattaggagctattcaaaaatttttaagtgtgaaggtgatatgatcagattgcatttagaaaaatctctttgacatcatgatgaatgatacagctgtagagagatcagttgtaggaacttaagaaatgatgagggctggaaataaggtaattacaatagacttgaaaggaagtgaataaattccaaaagtattaagatgggttagaaaaaactagatgctgaattgaatatgaagcaggatgataatgtaatttattgaagcattcattgagatagggaaataggttgataatcaggattggataggagtaggggtgggaaggaatatgtcctgcccatgagtcatcaggtggaactatccagaagcaagtacttattcaggtccaggtcctatcaagaaatgtggcttaccaggagtttgaggctgcaaagagctatggtcacaccactgcactccagcctgggtgagagagaccctgtctctaaaaaaaagaaaagaaacatggcttaaataaagatttggagacatcagcatgtagagggtgactcaagccgtgaaaatgattgagatgaaccaggaaagatgcagaatgagaagataattattaatatttgctctgagtatactgttttctgtatcaatatcatctgataatccctctcatttggcttgtcatttttccctccttaatcatagtttcctatttagaccattttaaaggaagcaggatatcaattacaaaaatcaaaaatagtccttttcaaaaactgataaatctgagaataaataatatagtgccatttacagcagattttctttctttttatttttcttttattttcttttctttttttctagagacagggtctcactctgtcacccaggttggggtgcagtggtacaatcataactcactgtaacctcaaactcctggactcaagcgatcctcctgcctcagcttcctgagtagcttggactatatataggtgcacactaccacatcagctaatttttaatttttttgtctctactattttggcaaggctggtcttgaactcctgagctcaaatgatcctcttgcctcggcctcccaaagtgctggggttacaggtgtgagccaccgggcccggccagattttcttttcttatcagtggcttccttctaaaatacaatttatcatcataatagacaatttggtttcatttttaaagaacataataatctctgtttattattattatgtataatattaatagtgaaaagaaaatctataggtttcattctttgaagcattaagtaatttttcccctgatccttgataacatcatgtgtgaataatcaactttgcagatatttgggtagggtacagagagaggtatcaagcatgtcttgtctgttttagttttctgtaatatactttctcccaatcataacttgcacatagaattgaattatcatggtgcattaataatgtacttggggttttgcaggtgttcatcagtaatgggtcattaagtgatgttgtgattgtagttgcggtcacaaatcatgaagctccctcccctgcccatggtattagcctttttctggtggaaaatggaatgaaaggatttatcaagggacgaaagctacataaaatgggattaaaagcccaggtgagtgataatgtaaatcatattcagatactaattgagtttactgttaatcagataggagacttacatagaggattacatgtggcacaattttatttcctatgctgaattcctaaaatatgcttttctgatgtggtaatgagatttattctcatttataccactctatctttctgatggtcagcaatagaaatgaatcaaggtattttgaatatctgttttagaaatggcaaaattaactgcatggtaacaagccatctatttgtaaaatgcattaaagaaaaatatgaaataaaaataaagtgtggccaggcacagtggctcacacctgtaatcccagcactttgggaggctgaggccagcggatcacctgaggtcaggagttcaagaccagcctggtcaatatggtgaaaccccatctctactaataataaaaaattagctgggtgtggtggcaggcacctgtagtctcagctactcgggaggctgaggcaggagaatcacttgaacccaggaggcagaggttgcagtgagccaagatcacgccactgcactccagcctgggcaacagaatgagactctgtctcaaaaaaaataaaacaaacaaacaaaaaaaacccagaaaatgttctttctatacattaccaaaaatgcatgttttgcttaatatgtattagaaatccttagttccaagtaccttgagaactggacagtattagagctggaatgatagtgtattgcagtaggaaagccacaaggtttagaatcagatggctgtgggttcaaatccctggtttaccacttactagttatgttcattaactactccaacttggcttccaatttgtgttttgtttttttggaaaaaataatattcacttcaatattcactgggttattggaagatttaaatgagaycattctctacattttttgtatggtctcttaggataccgcagaactattctttgaagatatacggttgccagctagtgccctacttggagaagagaataaaggcttctattacatcatgaaagagcttccacaggtcagaagtgtttaaagattccatcttttgactgaataatgaattggaatagaataatatagaaacatgttatttctatattatgcattcaaatttatacatgcaaaacttgtgaaatagctaatcatttgagtattaaagttgtaataaaagtatgagttttatagggtagttaagtaaataactgaactcagtaatatccaatcaaagcttataaagtaagtaggaaaaacagatatttcagttctgtgattccttcttagaatgattttagcttcttaactacaattcaaraacttttagctctttgtaaggaaatgtcttgcaaaacatttgatagtttgccagtttttaaataataactgtgaatcaaagggaaaagtataaaattcagactgaaaagttttagccacatagggtcagtccctaaacagctatggttttaaagtatggttgacaagtgattattgagcctcagatgccagtgtaagggggtactcctgcctagtgactgccatgaaaaacaccagcatgatggaatcaaactgactaaggctacttttacattaataggtagaatttaacttatgtgctttaagatgtttatttccacagatatattgagtcatacagtgtgcagagattaataaattgaaataagcaactggggattgtttttaactcacatgtgagtaaagagaagaaaaattaaattgcatatatataatgaagacagtcattcatgggcatggtgttatgtgactgttgtcccagctactcggaaggctgaggtgggaggatcacttgagccctggaattccaggatgtaatgaactatgattgtgcaactgtactccatttttggcaacagagtgagactttgtctcttaaaaatttaaaaagattataaaaaaataaaggtagtcattcataaaaataaaggatttgctttagaaagtgattagagatatgtcaaaagaatctcataaatctgttttcttataaggagttaagatataaattaatctttatgagtttattataaagataatttataggatttatcgtaattgaaattgtgtgaaaatcacttgcataattagagtaatgtttaagacctaatttttgtgttataggaaaggctgttaattgctgatgtggcaatttcagctastgaattcatgtttgaagaaaccaggaactatgttaaacaaagaaaagcttttggcaaaacagttgctcacctacaggtaagcttgtcactgtggtttagtattagatggtatcagtttactaatctgaaatggcctggggtaaatagaagtttggagttattttcatgtaaggtgatattagaaaccatggaagtggatyagatcactaaggagagatagtagagagtaagacaggagtggtcttaggacacagtccttgaggaagactacaagatttaaaggtagaattcatatttggaattcatattgtctgaaaaggaggagcctgtaagatgactgagaatgaataaacagaaaggagaaagcaaatcaggagagctttgtcacagaagctggaaggaaagagggcttcatggagtagggagtgggatcaattgctgcttaggggaaaaataagacgaagggcaaagagtgttcattgaatacaatgatatggagattatttagtaagagccattaatggaggyggagggtgacacacccgatgagtagatagaaatgaggacgtaaaacaatactgatggtaggcaactctttcctgagtttggctgtgaatggtagttgararaaagggtggtaagsgaagaggggaggggaaggagatttgagattcaagggagatatttgggagttattaattttttgtcgttatttttaggatgggaatgygggtgcatattttaatacctgtatataaagaaaggatttaataaagagggaaaggttgtagataggaaggaaataatcaactgcgtaaggtctttgagaaaggstgagtttgtggatgctgacacatggaaagataggccttcccatcaacaggagagggattccttcatttgcacaggaagaaaggagcaaaggacatctatgagttcagacagatacatcactctgttggtagaaaactacaaaagttctttatagaagacttctatttctttaaataacgtggccaggcacactgactcacgcctgtaatctcagcactttgggaagttgaggcaggcagatcacttgaggtcaggagttcgagactagcgtggccaacatggtgaaaccctgtctctactaaaaatacaaaaattagccaggcatggtggtgcacacctctaatcccagctactcgggaggctgaggcaggagaatcacttgaacccaggaggtagaggttgcagtgagccaagatcgcaccactgcactccatccagcctgggctacagaacaagactccatctcaaaaataaacaaataaataaataaataacaatagagaaagtccttgaaagacaggtgagtgaaggaggcatggaggtgttgcagaagggtgaggsaggtatgaaatatcttcttcagaatgagaaactaaactactttctgctttttgtgtatcaatcagctttatgataagagtttagcttcccaggtacaaacatagagaaaagacagatgattgtgtttacctaggattgagttttcccaggaacttgagggtttttgcaaaagaactcagtatatagtggccgcagtcactaaatatgctaattaaattttagaccctatagtttctttttaaatgaaggaatagtttataattccttcatgtggtcatcaaattggcaaaacatctcaccagcaaaaaacctggagttgggatttgacttaaaaatttttaagtagaatgactggctgaaaggctttgtgaagggaaaggtagaaatgaaacaacttggtggcttttcagaaccagcattctagaaattatgttcaagtgtggtttatgtcctaacacagctacttgaatctccgtagtctagtcgtgttctctctctcaaaaatagtttcctatttgtaaatatataaaatgtatttgatttgcaaaattgtaaaattttgactataaatctttaaaatttataacgtttgtaaatatttataaaatattttcctacttgtgaatatcagagactgcctcatagcgttgttgtgaggattatgttgtagaaaaaactgggttcttgtcacaggaccaggataatttgggcacgcagacacattgtagattgagtagggcagggtttattaaatgaaaaggagaaaggaactctcagcaaagtgaaagaaagtcctgcgagcagttctcctgcctcacagattgaatcctaggtcatcacacaggaacaggagaggctaggctcctctcctctgcaaacagtgtgaacttcccgaggctccaccccgtcctcccagtgcacaggtgggcattattcagaaaggatcagttgggaaagggcaggcttcatctgggaccagcagtcgggtttttcagcctttaggctgtttaggcttgaaggcagggtttcaccagagaccctcggctgtctcctgtctctatcaattagatggggtaatatacataaagcgcttggaatattgcctggcaaagtaagcccacattaaaattagctgttatccttattttattccttacataatgccttgctccattttgtttcaatatgggagamctttttaccatctacttcctcttgctcttgatctagaccctctctttgtcgttttgggaactgtttgctaccggtattgtcatcaaattaactttttccatcctgaaaaaaagtctttacatcctaacttttcttattgacataacaaacctaaaacagttgttctgaatctctaaaaatgaggtacactcaatcaagaaaacatttaacaaaacagtatgacttgacttgattaaattctgatttccttaagagcaaggatgttatactttatattccctttcatttatggatcactgatttacacgtatcagaggttctcagtgaatgccctttcactcaggtgtttagaaatgtcaggaatgaggtggaggtgggtgtgcacagttgactggaggtataacttgtatagtgccctggaggacagtgttgttaaatgtcctgtaattcacatttggattacaactaattgtgtcactcaaaatatcaataatttcccattgagaaaaactgacatatatgattttttcctttttggttcactgaacaaatatatattgattgcctcctaagggtaatgtgttcaactgtaatttgatgggtgtaactctagaaacacatactacgctcctggcaatatgaaggaagtgttaccacttgawatcactctgattttctcaactgtacccaaagtggaatgagtatcatttgcttctgaaatccaaccaccaccacttaaacatcaaaaatgtttactaaaacacttataccaaggccaggcatagtggctcacacctgtaatcccagcacgttgggaggcctaggcaggcagattgcttgagcccaggactttgasaccaacctggacaacgtggcaaaacctcatctctacaaaaaatacaaaaattagccaggtgtggtggtgtgtgtctgtagtctcagctactcaagaggctaaggtgggaggatcgcttgagccctggaggcagatgttgcagtgagctgagatctcactattgtactctagcctgagtgacatagcaagaccctgtctccctgctccccacaaaaatgaatacaaaaacaaaaatatacctttagccttattttggctaaaggtataacagttgaaccaaaagacatgtttccattcctttggaaatctacatttcctgtgtttatgaacttaatactagattacaacaaggatgactatattattacccagattgcctgaatggctcagaaggcatgtaatttgacatttaaccatgaaggaaataggaaagtggtccatattgttttctcataggggaaaaatattcttttaaaatatatatttattgtattttaatagcaaaaaataaataactttaatcattcctttttaaagaagtatcattttattgttgccttctttcaaagttagttccctaaactttcagtaggtggcagtagcattctacttccacaggtcacattattgatagctagtagtattgttttccaagtaagtttatatgttctgagatttctgagatatgtcttctgatcttcctattttatctaaataaatatatttgaataatattttcatatttcaagctaggagtatattcagagatgatgaataaccgatactgtacatacctataccttgtattcaagagctgggtacactatggatctagttattcaattgaaatagaagagctttaaatgttacaatatacttggccacatgtcattttataactatataactattcagtttccattctctttgttatccttgaattttggacattttggggctttctgaccagttgaaatgcatgtcacaaaatttattttctttttagaatagaaacctacgtatggatgtagcaataattattaggatttttaaaatctatgctctccatagtttatgtcgatcttatggttttttgcggaatagacaataaaacagtaaaatccagatgttaaataataatggatattattgcttgactgctccctatctgccagacactgctaagtgaatggtctcattctttttcttcacaaatctatataagtattttaattatttttattttacagttaaggaaattaaggtatagagaggttaagtaacttgccccaaattacacatatattctaattccagaacctacactctttacstatatactgttattactgcccagaagtgcaaagcagatgggccttttttcttttcctatttccttcactcagtgggcaacgaagtgaaaatggaatgttttttctaatctaatgagagctcttggttagtcatttcctgtgtggtatgtgttcttaattctaagggcataaagaattagggagaggaatagagaggaaaaaaataatacttcttcttgacatgtgtctaaaatgggaatatccagtttttaagaccttgagcatgggactaattaactatcaaatagcaaacctagtgtgtttcattttatattttaaccataatatgtgagagcaactgatgctgttgtttaaatgaatactgggctagataacctctccaaggtgttctccatttccataattctaagaattctgtcattcagaactctgaaaaagactccatccagcccacttagtaacttcagaataatttttaatgctagctgcagtattatttattaacaaatataaatgacttaaaaatactgctatgaccttgtcgatcattcactaagagcacttgactagtaatgtgtggtctaatttttagttgcctttgattagaggatgatttcagaaagcataatgcagtgtctgcagtgaaaagcaaagaccaaatctgtttagtaacgctcaacccaatggcaagaatatgtaaatatttaatctttttatcctcagagagtaaattatgtactcttggagacattattctctcagacctctggacttcactgaatgcactgatgcaagaattctaaatcattccattctggtttgaagttttacttcagcttctagaagtttccagcatttacaaaggaatgactcttgtatgagagaatcaggcttagatatctttactctttcatattgtaaagacagtgcataaattcccaaatgtggcatcatgtaggcaaaaaaatatcttgagacttgttggatccacccttattttccaaatraagtgtcatacatagtgtcattgaactaaactaggagtaggcttagaaaccatcttcagggattttcatggaatactcatctgttttcgatatatagattatttgcctatttttttctttttttgttccatctttatattgtctaagagtaaacttcaatgtgtgggttgggagtgggaaactttgtgctgattaaagggtagatatttgacctaaktaaatatatgatgaatagaaatggagatagaaaaaattaagggaaacaataagcggggaagaaagttttgatgtgacccagcatgttcagaactagaggccagaatacagagatggaaggagtggggtgccaaccttctcattgcttagttttggaatcattcgatgccagttacattctctgtttctagaacagggtgaaataaaaccaggggaaagacagtcagttggagttttcatcagcacagtagttatgttgatatacctgtaaggaatctgcccctcagagctttactccacctgatacaccctggtcttgcttggtcctgggtctttttacactcccattctactcttttccagaaatggtaagtatcaaaactgtcccaaccaacaatgacagtgaaagaatcagttttataacttgagaattgctgtagccagcattaaaagcagaccatgtatcttctgagaatgtgtcccaccaccctcctttgagaacacagctgtggctttggacttggtagtacctaggtgggatgtgtttaatttctagtttgagtttcactgcaccacctttgcctgtaactttccatgtatatgctattagccacagtgaagttcttactcatttcacagcagaatgatcagaactgtttctatctgaattttcacaaagaagataggccagctgaccatatctgggccttggacctaagaaatcaactagaatggagtatacttttggagctacccaaagtgggaacccagtatttcaagttcaagccaatttcctgagggaggctcaagagtcagtgccaaagagaacagatatacactccaagttcagagtgtgagagcctagagtcaggaatgaaataaagcttgattgaagcaaggacagtcagcaacaattgagaatggtctaaatagaatgatttccaaaaatgctaatgggttgtccatggccagtaggaggaggtaggtacatagctatattaacattgataatcccagaccattcagtccaagctagagactgctaaacaagctattgagaggtacgggaggtgtattcatccattttcatactgctatgaagaaatacctgagactgggtaatttattaaaaaaaaaaaagaggtttaatggactcacagttccacatggctggggaggcctcataatcatggcggaaggtgaaggaggaacaacagcacatcttacatggtagcaggcaaaacagcgtgtgcaggggaaccactctttataaaaccatcagatctcatgagacttactcactatcacaagaacatcatgggacaaacccacccccatgattcaattatctcccaccacgtccctcccacaacatgtggggattatgggagctacaattcaagataagatttgggtagggacagagccaaaccatatcagaagggataatgtgaagggatgaaagaggatgagggtactggattttgatctctttagtactctgattttattctattgctttctacagatctagattaaatactgtgcaatattaaataataccttatattttgatgtttatgaacatatatagaaaccccttgtccctccagatgttagaagcagagtagcaaaatctgtatacttaatttcattaataaagaaaaaaatcttcaaggatttaatctctggaggaaaaagcaacaggtgttttcaacggctgtacctaaataactgtaccacaagatggtgctcacacattaaagtcatgctgtttttcaagaattttgcctcgtctaaattttacaatctgaaacaagacattgtttatgttttaaactatttttgcatcttttagtacaaatttccttagcactgaaatatagtgagttttaaatttaagctgatttggtaacaaatgccatttttatggaggaaaaaaccaacaattccacttttgtttgccctaaagatcttttattgtataatttctgatatgttaagtgggttgaagtttatatttctaccatgctcacttttttcttttatttcctttaaattcaagacagtgcaacatmaattagcagaattaaaaacacatatatgtgtaacccgagcatttgtggacaactgtctccagctgcatgaagcgaaacgtttggactccgccactgcttgcatggcgaaatattggtatgcatgctacagtaattagagtgcggtgtgtgctcagactgatatggaattctgccaattttaagctcagccttgagggtcttaaaggaagaaatctgtgaaatgaaaaataaaagtgagactccactttaaaaaaaaaatgctaaaaagttccattaagcatatgtataatgtgctaaaaatgtttcaagttggtatttaatttttttatcctaataggcaagcaaagttagtatttaattcttaacttgctattgaaaataaaatattaagagtgggaaaatgaagagtgatattgataggatgactgattcattcattcaagtaatagtttaatttcaaattatctgaagagtggcagtatagtgaggctgaaagggaacagtaaaacttaggagtcttgagatagagtccraattcttttattaaataastataattaaacttaattccatccaggaaaatgtttttgttatctgtgaaatgactaagttggacaggatttttctatttaaggtgctttccaattttaagaaaaaattcaggaagaactggctgtccaatcaaagtttcacaggctctattaagtgaaaggagaataaaaatcctattaagtttagaaagacttcgatttgaattaaagattattagcaatggtgttaaagatgagttgaatgaaaaaacatccctgtatgtcagacttttgtatattttaagattttagaatatacagtctaaatcagattctggaagtagatttggtttcctctttttaaaaacaaacattctcccatatcattagcccaagagtaacttagaataaattcctgtcattattcattaacttgtgttcagttcaatcacaggtagaacaggggaaatattttgtgctttatataatgatcccataataacaaaattgccaggttgaaaaataatgtggaattacttttcagaaacttgcacttttgaggagactttttatatttacatttacaagaagttctttgactagtggcaaaaagtgtaaaaaaaatttacatatttttggaaaaagagaagtttggatagccattgaccttgttatttgaaaacctcaggtttatacacatgctcatatttcacactgaaacacaggaggcaactagttatagcccagtaaatatttcactaaaatacttgccaaatataaaaaattagagaaatccaaatattattgtccccaaagtcttgtctattaataattatattgttaatatattgcttagaaatatcctcacctgtcgtatggtctgagttttaaattattttaaataaaaagaagtatctacccttatttttgctttatgcttcccactattgaaaaataagtagtggggtgctgtagcttgccactgtagtaactcctacttgagaagctgaggtgagaggatcctttgagccctggagttcaagactgtaatgagctatgattgtgccactgtatcccaacctaggccctagagtgggtgagactccatcactaaaacagactcacaaacaaaaagaaagaaagaaaagaaaaataagtagaaaagaattttgaactaatgtatttttatgttaaggtgaataaaatctctatcatgaattttaatgatagaattgtgatattatcagaaaagaatttttctcaagcactgcatgtttatgtatacaaacattatatataatactaatacatacacttcaggaataataatctctatataattttctaatgtttcctatatgatagcatatactttgttagtctgccctcttaggttttcacttttatcttcaatttatttctgaaaagtcagaaccctaaaaaattgcttttttatactgaaattcagaatcgtgatcttcaagtagaaagtgacatcattggagaaaaaatgcatattacaagggcaaaaagaactaggtggctgagtaatttagatcatatagagaatccaaataaattagaacatattcaagtctttactgcatgtttttctagcctcaaatagccaaaatctaatcatctgagttttctaccttttgtttctagcctaacaaaaacctagcaagaaatataattaatgaaaaaggtactcttatatgaaaattctcttgaaatatatttcatatgtaatttttatcttctttgcttagctaatatgccgttctaattgcttaataaatgtgcacatttaaacaattgtaaataattagttttctggttttgaagcacctcatgaaaatccatttcaaacatttcttttctgccttttattttggtcatttagggcatctgagttacaaaatagtgtagcttacgactgtgtacagctccatggaggttggggatacatgtgggagtacccaattgcaaagtaagtatagttttctgatacactcttctttatgatgtgaagaaaaaggaaaatttctttactttgtacatcaaatgtagagggaaaggaggtgtgcaatcttttgaatttttcagctgaatacagacaaaatgtattcaagcaaatggaaacagctttttttttatcaactccctactaggattttatttttcttaaataaagtaaagagaccaataaacaaaagcttgatccttggctttatttgaatccttatgtagaaggacaaatagtattttcaaaaattttttaatttttttattttttattttattttgagacagtctcgctctgtcacccaggttggagtacagtggcatgatctgggttcactgcaacctccaccttccaggttcaaataattcttgtgcctcagtctccagagtagstggaattaacaggtgcgtgccatgacacctggctaatttttttgtatttttagtagaggtgtggttttgccatgttggccaggctggtctcaaacccctggcctcaagtgatctgcctgccttggcatcccaaagtactgggattacaggcgtgagccactgcatccggccaaatactactttttttttaaaaccaaaaaaaaaaaaaagcaatacagaaaaattaactggcatatgaaaaggatctaagttgtcacatatcttaaatatctgattatttgttttgttctaaaaaaattaaaaatcttctttctaaatagatttatttccttcaaattgaaagaaatcaaatatatctttttatcatatatgaatattcttatcagtttgaagcagtactaatttgtaaataggcagtgtccccattcatatttcttcctcaatctccagaatttccttttctcctaacagtcttttgcctcagaagtctccccatagctttttttcctcatcaccctagaaaatatatttttctgattatttagcaatgattttggtttagaaaattttcccaaggaaattttttatttatacagaaaagttcagtttgttctgaatctgagagtaagaatgctataggcttctaaaaatgttttaagattatcttaatataaagtatctaaagggaaaaattatgaaacctacattcaaactggcagcctaatgatttcaaatttatctttttggtaagtataattggaaacatttaatatgcttatagtccttagaaaaaatattttactaaaattacattaagaacagaagctatgtagtggctcaatgtttgtgtggtttagttcacatttaagaaaggcctattaggtggggagaaggcaatcatctaaatggcttaagattagagcgtggcataagccttggtctctgttttctcggagtcaactccttcaagttggtaccaagcaaacaatgtagattgatggcttatttgaaatctctggtttcagtttgagagacttatattctctttaagaaacaataatcacctttcttggccagtttgttagttcaaagattgtatcaatttttaaactagactgctatttctcttcccatatatcgcctaatatcaaaaaagccactgaggccacgtgcggtggctcactcctgtaatcccagcactttgggatgccaaagcgggtggatcacctgaggtcaagagttcaagaccagcctgggcaaaatggcgaaacaccatttctactaaaaatacaaaaaaattagctaggcgtggttgcaggtgcctgtagtcccagctactccagaggcatgagaatcgctctaacccgagaggcggaggttgcagtgagtcgagattgcgccactgcactccagcctgggcgacagagtgagactgtctcaaaaaaaaaaaaacaaacaacaacaacaacaacaaaaaagccacatagacacattggcaatatgtggatgtaatgtatagattttgatttgataaaaaaagaaaaatcttctaattgtgtttcttatatcccccagactaaactacattagtttatatatatgttgctgagggttggtttcatagataagaggtgttttctctgcttttttattttgtttttttgtttttgtcttctttaataactggtcttcagcatgtgggtttatttaataagtcttactcattaggctcgagcccgtgaggagtgagatttaagccttgtcattttaagatttctctgccatgctgggaagagctgccttagatgtagaacttcactgcagtgtggttaaacatttctgctgccgcctttcactgttaattttagttgatgactaaatttaattagtaacatataaaaggtctactaatctctgctttactccattggaacttctttaatgtaaaaagaagcctagcccatttacaaatatatatatatatatctaaacgcattgggactgctgaagtaggcttacagtaggtaagtgctcaaaatgcaggtgctagattttgtagagaatagcaaaatccgttcagaaaaaaatgtttgaaaacataaatatctcaagcttttaaagctttcagcagaaagttctgagattgtaaatttcctttgtaacaccgtaaatcatatcagtaaatatttactgagtgtccatttctttgtaaggaaccctgatgaatatggagaagaataagtccaaaagtggtatgttcctagagagctggcacatttaatttgtcttaaaaatcaaatttaaacaaaacaaaacaccaagattatacttgagaaaaaaaaaagaaaagcctttgagtgtgtctaccaggaaagtccaaagttcaataactagctctaagtgctttggccaatgaaagtgttgcaatatacaaaaaagatatttgaaaaagaggcagaatacctacatcctcattccagtctgccaatgatgtgttgttrgtgaccattaaatagcaaccattaattaggaaatatattaacttctctctactttagttcctttaccagggaaacagtattaacatttatccctccccaatcccagagctgagaggataaaatgagatgagaaaagataaaaacaactgtacagtggtacggttgttatcatgactatcaaaagtgaacttatgatatttgggttttttttttctttggtgtgggtatagcaatggactcagccacttagtattttaactccacacattgctgaagtgactattaaccatttccaaaaaacaagttacttgttaactttctgggaaataatatttgctaaagcattagtttatattcctgatagtgatagtggttgtgggaatgctagaaaatatgtatcttttttcttttgttttctataaaaccagtggatttcaactttttaggaaacattaaagataaaaagaaactaagacatcctgtgcatttcctaatctaaaacagactttttaagagtgttatcatatgtgctgaattttacaaaattaaatcagatgaaacatactcattatttttattttgaatttgtaatctctttaatcaaattaatacaaagctatacagattattaacatcttaatagttttttttactattattccaatttaggatgaatgccatattgaaaaaataagtaatttatgaaggacttttattgtttgtacttcactaattgaatagtttatgagttacctggtaagacaaaatttacagtttctaatatattttatttattcattcaatcatctgatttatccagagcttatgtggatgccagagttcagccaatctatggtggtacaaatgaaataatgaaggagctgattgcaagagagattgtctttgacaagtagacatctgcccacatcctggagtcctattacagctaatctcgttttaaatctgctcaagataaaatgtaacttggaaagcgaggaaacactaaacatgtttttacctgctctctctatagagaaggaaataaaatataaatataagattaacacagtggaaggacaaatctttgaagccaaaattctagttttccaatataaggtttaacttacagttttttatgtagccaaaggtaaacggttttctgaatcttgcctaggtgtttcatttatctctaaaattctaaaaagcataaatcattcaaatcttcaaaccaaggcagaaataattttatgtcgctmtagtataaaaacattaataagatagcacattgacttttaaagggaaaagtaaatataacttagcatgtaaactcatttcggctaccatttgctccaaattccctagaacagtggtttttaccactgtactccaaccccgtttttaagcaatggaactctttcttcaaacaaaagcttatgcagaacatctctgtgaaacgctgctgagtgagaactgctttcattgaagctggaagccatcataccttactgccttgaaacccctaggactcagctaagtatttgcctaaccctgaccagggaatgccttggttctgtcaattgctgacatctgagaacacagaataatccatcatttttaatttcaagatattggtacattttataggtatcaaagcaatggcttttcttttgcaacagttaatgtatttattaacttaataattactttatgtcttctataaaccaggctgttaatacaatgatgacaaacaaaactggcaagatcactaaaaaataagtgaataaacaaataagtagtaaaataaggtaagaagtaaatatgtaaaagagataatttcaagcataagtgcaatgtaaataataaagtaagcatttaaaattcaaaagtgaggaaatgacatttgatttaagacttaaaagtaattacaaaaaataaaccattaatttaaagtagctttaacatggaaacagatgtattcttactcaacttagaacacaaacattttatttggtattgttgatattaaacattgttttttaatacaaccattacaactggagagaggagagggaagaaaaaatattttgataccagtctttttaaaattttttttattgtactttattttttaagatggagtctcgctctgtcattcaaggagtgcaatggcgtgatctctgctcacagcaacctccgcctcccaggttcaagcaattctcctgtctcagcctcctgagtagctgggattacaggcacgcaccaccacacctggctaatttttgtatttttagtagagatggggtttcgccatgttggtcaggctggtctcgaactcttggcctcgtgttctgcccacctcggcctcccaaagtgctgtgattacaggtgtgagccactgcacccggcctttttattatactttaagctctgggatatatgtgcagaacatgcaggtttgttacataggtatacacatgccatggtggtttgctgcacccatcaacccgtcatctacattgggtattttctcctaatgctatccctcccctacccccctaccctccacaggccctggtgtgtgatgttcccttccccgtatccatgtgttctcatttttcaactctcacttatgaatgagaacatgcagtgtttggttttctgttcctgtgttagtttgctgagaatgatggtttccagcttcatccatatccccacaaagaacatgaacgcatcctttttatggctgcatagtattccatggtgtatatgtgccacattttctttatccagtctatcattaatgggcatttgtgttggttccaagtctttgctattgtgaacagtgctgcaataaacatacgtgtgcatgtgtctttatagtagagtgatttataatcctttgggtatatacccagtaatgagattgctgggtcaaatggtatttctggttctagatccttgaggaatcgccacactgtcttccacaatggttgaactaatttacacccccaccaacagtgtaaaagcgttcctatttctcaacatcttctccagcatctgttgttttctgacgttttaatgattggtattctaactggcgtgagatggtatcttattgtggtttagatttgcatttctctaatgaccagtgatgatgagctttttttcatatgtttgttggccacataaatgtcttcttttgagaagtgtctgttcatctccctcacccactttttgttggagttgttttttatcttctaaatttgtttaaattccttgtatactctggatattagcccttcatcagatggatagattgcaaaaatattctcccattctgttggttgcctgttcacgctgatgatagtttcttttgatgtgcagaagctctttagcttaattagatcccatttgtcaattttggctttgttgcagttgcttttggtgttttagtcatgaagtcttggcccatgcctatgtcctgaatggtattgcctaggttttcttctagggtttttatggtttttagatcttacatttacatctttaatccatcttgagttaatttttgtataagtcataaggaaggggtgcagtttcaattttctgcatatggctagccagttttcccaacactattaaatagggaatcatttccccattgcttgtttttgtcaggtttgtcaaagatcatatggtagtagatgtgtggggtaatttctgaggcctctgttctgttccattggtctatatatctgttttggtaccagtatcatgctgttttggttactgtagccttgtagtatagtttgaagtcaggtagcatgatgcctctagctttgctcttttagcttaagatttaattggctatattgtctcttttgtggttccatatgaaatttaaagtagttttttctaattctgtgaagaaagtcaatggtagcttaatggggatagcactgaatctataaattactttgggcattatggccattttcacgatattgattcttcctatccatgagcatggaatgtttttccatttgtttgtgtcctctctgatttccttgagcagcggtttgtagttttccttgaagaggtccttcacatcccttgtgagttggactcctaggtattttattctctttgtagcaattgtgaacgggagtttattcatgatttggctgtttgtctactattggtgtataagaatgcttgtagtttttgcacattgattttgtatcctcagactttgttgaagttacttatcagcttaaggagatttttttggctgagatgatggggttttctaaatatacaaccatgccatctgcagagaaaatctgacttcctctcttcttatttgaatacctttatttctttctcttgcctgactgcccaggccagaacttccaatactatgtggaataggagtggtgagacagggcatccttatcttgtgccagttttcaaagggagtgcttccagtttttgcccattcagtatgatattggctgtgggtttgtcataaatagctcttattattttgagatacattccatcaatacctagtttattgagagtttttaccatgaaggggtgctgatttttatcggaggccttttctgcatctattgagataatcatgtggtttttgtcattggttctgtttatgtgatggattaagtgtattcatttgtgtatgttgaaccagccttgcattccagggatgaagccaacttgatcgtggtggataagcttttcgaggtgctgctggatatgctttgccagtattttattgaggatttttgcatcgattttcatcagggatattggcctgaatgtttttgtgtgtgtgtgtgtgtgtgtgtgtgtgtgtgtgtgtgtgtgtgtctgccaggttttggtatcaggatgatgctggcctcatgaaatgagttagggaggattccctctttttttattgtttggaatagtttcagaaggaatggtaccagctcctctttgtacctgcaacagaagatggctatgaatctgtgtggtcctgggctttttttgcttggtaggctattaattcctgcctcaatttcagagcctgttattggtctgttcagggattggacctcttccttgtttagtcttgggagggtgtatttgtccaggaatttatccatttcttctagattttctagtttatttgcatagagatgtttacagtattctctggtggtagtttgtatttttgtgggatcagtggtgatatccactttatcagttttttatcatgtctatttgattcttctctcatttcttctttattagactggctatcagtctatctattttgttaatcttttcaaaaaaacagcctctggattcattgattttttgaaggctttttcatgtttctaactccttcagttctgctctgatcttagatatttcttgtcttctgctagcttttgaatttgtttgctcttgctgttctagttattttaattgtgatgttagggtgctgattttagatctttcctgctttctcctgtgggcatttagtgctattaatttccctctaaatactgctttagctgagtcccagagattctggtacattgtctctttgctctcattcatttcaaagaacatcttgatttctgccttaatttcattatttagccagtagtcattcaggagcaggtggtgttcagtttccatgtagttgtgcggttttgagtgagtttcttaatcctgagttctaatttgattgtactgtggtctgagagactgtttgttgtggtttctgttcttttgcatttgctgaggagtgctttacttccaattatgtggtcaattttagaataagtgcaatgtggtgctgagaagaatgtatattctgttgatttggggtggagagttctgtagatgtctattaggctcacttggtccagagctgagttcaaatcctgaatatcttcttaattttctgtctcattgatctaatattcacagtggggtgttaaagtctcccactattattgtgtgggagtctaattctctttgtaggcctctaagaactttctttatgaatctgggtgctcctgtattgggtgcatatatatttaggatagttagtgtttcttgttgcattgatccctgtaatgcccttctttgtcttttttgatctttgttggtttaaagtctgtttttagagagactaggattgaaacccctgcttttttttggttctccatttgcttggtagatattcttccatccctttattttgagcctatgtgtgttttgcacaagagataggtctcctgaatatagcacaccaatgggtcttgactctttatccaatttgccagtctgtgtcttttaattggggcatttagcccatttacatttaaggttaatattgttatgtctgaatttgatcctgtcattatgaggctagctggttattttacccgttagttgatgcattttcttcatagtatcagtggcctttacaatttagtacgtctttgcagtggctggtactggttgttcctttccatatttagtgcttccttcaggagctcttgtaatgcaggcctggtgatgacaaaatctctcagcatttgcttgtctgtaaaggattttatttctcctttgcttatgaagcttagtttgactggatatgaaattctgggttgaaaattcttttctttaagaatgttgaatattggcccccattctcttctggcttgtagggtttctgcagggagatctgctgttaatctgataggcttccctttgtgggtaaaccgacctttctctctggctgcccttaacattttttccttcatttcaaccttggtgattctgatgattatgtgtcttggggttgctcttcttgaggagtatctttgtggtgttctctgtattttctgaatttgaatgttgacctatcttgctaggttggggaagttctcctggataataccctgaagagtattttccaacttggttccattctccccatcactttcaggtacaccaatcaaatgtagatttggtcctttcacatagtcccatatctcttggaggctttattcattccttttcattactttttctctaatcttgtcttcatgctttatttcattaagttgatctttaatctctgatatcctttcttctgcttgattgattcggctattgatacttgtgtatgcttcactaagttctggtgctgtatttttcagctccatcaggctatttatgttcttctctaaactggttattctagttagcaatgcttctaacctttttttcaagattcttagcttccttgcattgggttagaacatgctcctttagcttggagaaatttgttattacccaccttctgaagtctagttctgtcaattcctcaaacccattctctgtccagttttgttcccttgctggcaaggagttgtgatcctttggaggagaattgacgttctggtgtttggaattttcagcctttttgtgctggtttttccttatcttcatggatttatctacctttggtctttgatgttgttgaactttgattggggtttctgtgtggacgtcctttttgttgatgttgatgctattcctttctgtttgttagttttccttctaacagacccctctgctgcaggtctcctggagtttgctggaggtccactccagaccctgtttgcctgggtatcaccatcgaaggctgcagcatagcaaagattgctgcctgttccttcctgtggaagctttgtcccagaggggcacctgccagatgctagccagagctctcctgtatgaggtgtttgtcgacccctgctggggggtgtctcccagtcaggaggcagcggggtcaggtacccacttgaggaggcggtctgtcccttagcagagcttgagcac

SEQ ID NO: 17559 - DNA, 20146 bp, Homo sapiens
gagagaagctttgaagtgcatttgcatcctgtgagcccatttcacagcgtgagtaagcagtggtggtaaagatgtcacgtggtgagtgtcaggtggaataagccgtgcggcctctgccagtaaggagcggcccctcccctgccccatcaggcatgcccaggcaccatgcctgcctctgcatccacccagcccccctatctgggggtggggtctcaaggacaatgggccatgcacccacctgccagcccccaggctggagaaccaagagagaaacatgaggaaaggctgaagcgtccttgaggtcagcaggtgggcaccccccacggcagccttggggcccaaggaggcgcatgcaccgctcacccctgccacccaccaactgcacttgtcttattgattttaattatataaatcactttattgattttaattctgatcattcaccgaacgcacgtcccttgtcagaatgtccaaaaggtgcaggaagaaaggcaggctcttcctccagagcctgaagccctgcactaggcgtgcggtgcctcaggagcaggagcctcacggcccccaacagaaattctgatgcccagggagacccctgtgagtgcccctgacgtctagggggcacctctggcccacccttcgaaggaggcgtgtgatgggaaaggcagctggtgtggatgccctgggacaccgcacgtgctcagaaacgcggcgggaaggtcaaagtctcagagcaagcggctgggctgctgacctaggagtgtgctcccctggcttgaggttgggcgatcctcaccggtcactctaggggcctgaccaggtctgaggaagcccctcccagctacttactgaagtagaagccgcggtccccacagacgaactggagggtgtccaccagctccccgccgcacagggtctcactggggcggtaagcagcaatgcagcacgaggcgaaggccaagaaggtgagaagcaccagcatcgacttccccattgggattcccattggtgtctgggggcgggagagaagtggcgtgagcggggcagccaggccaagccccaggccagaggtgcccctcccaaaccaaatttgccaacctacaaattcagttgaaaattgaaagcacggctttcctataaacattatttttattacaaaagtaacacacaggtcataatgccgaggtgagggcgcagggccatgtgcagaatgaagcgtccagaagcacacagaaaaggcccagttccttccatttgcaagaagcactagtaattttacacgaggggtgaccatctgcacggtcattattgcaggagctcagcggcatccacagctgcaggggcccaggctggacacccgacctggcctccgtcctatgacaccatgggggcagggccagcccagcgtcacatcgccacttctcaggcctccagcgccagccaagatggcagacagccccacccctacagagcatgtgcatccaggaggaccagtcccttcctccccacaacccccagctgagcagggggggtccaggaggaccatcgccctcaaagcagcaggccagtcctgctgggccagccccgcccctccccctggcttttccacctttccagtctgcagctgagccaggcctgggtcaaggactccaatggttaacacaaccacgccacccatgctctagaaaccttgttttcccagtcacccagttctccaactccagtctgccttgggtacccccaaacacacacacacacgcccagagcctcctttccaggcctcaaatcgaaccagtaaggccaggggcctccagaacatctccctatttgcgctaccaaactctccccgtgggagctggagagaccagctcaggccacctgggaagtccgacaccaggttccccagactacaatctggaaggggaggccagtcttaggacacaccccctccacaggctgcagggccacagggccgggttaacccactcgggggtgggaggccgggagccaccacagcaagttggccctgcccctgcagaaggtggaaccctccaggcgggcagccccagccttcgctccgcagacccaggggagtttttgatgcaataaattatgtgagcgactgagcaggcagtgggacagaagcacaactttgcatgccctctctaaagactagtgggcagctgcgccgaggatctgaaagcctccttggtcatctccttgactggaccctggccagtcctctcaccgccccctctgccacccccttccaaattctaagagcacactccgccagctggccactctagccctcgccgcgcttccgcaacaagccccaccactctgaacttggaggtccgggtcaggggaccggcagaaagcaggacaggaagcatgcagcggtgcggagcaggtgagggcccaggaaaagccctgagctgggcaaggagggggccgaagggaaggaacagaaagggaaggagcaggtgagggagcagagaccaggtgggggcaggggcagaggaaaagaggggaggggggtgctgtccgagaggcagcgggctggcggctgcagggcccgaggcccaggcgtgggccgtgccccctgctgccctgcctcaggctggagtgggatggcagcgggggtcctcactccacagccctggttacctacagctcagcagaaggctcgctggggcaggaggaggaggaggaagaggaggaggaggaagctggaagtctctttcacaggagaagctaatgtccagtttgcaggctggtcagtgcctcagcttttatgtgtgagccgactcctcccagcccgggctccaccctaccccccacccctctccctgctgaccactcccccgcgcctttgctcccgccctctccctcctcccagccagtctcttctctcctgcacccccaaccgggagccctggaccatcccgtagcgaagtgccatgggctcccatcctgcacccccggctcatctctgcacagggcagtgaagggggggggggtctccttcccacctccttgtatggaaacttccacgctgcccactgggcaggggccgcggcctctctccgggtcgaaggctctgcccttcttagcctcagaccagcagcccctctccccctctcccgggactcctgtttggaaatgttgcggacagagccagagggggtgtgggggagatgtcgcgaatgtggcgtctgccatgactcctgccaactcggcccctctccatcctggccccgcccacccccgtcttcctctcgcggtctcgctggcaccgcgtcaacataccagggtgggcttctgcggctccgcgcccctcctcgttacccagcaccccggaggccagggcccgcaaggcacgaatcacacatgtgaggcggcaccccctgcacccacagaccgaccgggaagtcgcccctgcagacacctcacacctccctcggcccttcccgacgcccccaccccacccccagctcagccgccagggtgagcgcggggctccgcgcagggaacgggacccgcagccgtccgtcctcctcctcctcctcctcctcccccccgggctcagccgccccgccgagccccgcaggccccgggccgggagcgggcggaggaagggccgggcgtccggcgcaagcccgcgccgccccagccccggccccggcccggcccgcacacgccgcttacctggaagccggcgacgctgccgcccacctccctgctgcgtgtcgcaaaccgaacagcgggcgttggccctcctgccggacactcctctgccagcgccgctctggccgagtcgcgggggccgaatgtgcgacggggcagagcggggggatggcttttttttggggggggggggagaattcgtctgattgtccagggaggacgggctgtcttcgggctggggcgggccagatgttgtacttttcgggggggaaaaggtatcgggaaatgaggtcagctgttgtatcaaggatagaggggggcagagatagtgggagagacagagtgaacgtgaaaggggggggccgaagagagggcgagggggagagaggacagcgagaggcgggcaggcgcacagcgggagagaacagcacggagagaaacagaaagcgtgtaattaatccactttggttcggcgaaggcgagagggcgggcgtgagggggggagggagtcggaggctaggagctgggggggacgggagggagcgaagggaaggttgcgggagaaagagcgggggccggggccagacgccaagaggggcgcggggagcacagagaagcggagggaagggcgccacgtcgaggggccgggggaggcggtgactggggggcggagtggaggctgcacccggaccgcgggcgcccagctcggtttgggccgacggagccctctgccgtcgcgagcccgggcctcgggagggggacaggcggtggcggcaccggggccgctccgggacgcagcgcggaaaggggagcggcccgaggctgcgcgccggggggagggctggagggggagcgcggggggggtgacaacgccggcggcctgcgagccggactgcctgcggggggaaccgcctcctcgggcgaagcggggatggggggagttgaggtagatgaagaggaggcggcggggaatccgcaggcccggcggagcgcgaccccgcggacggcgcccgggacgggagtcagcagcgaggcagcgggcggcgtcgacgcggggccgccttgcccgatggaggcgctggtgggcagagcgcgggcaggcgtgggccaggaggcgggggcggccggaaggggggggccggggccggccgggcctcacgcagctccgccggagagcaggcgaactgcgggcgcccacgcccggctcttatagtcgcgccagcccgcggcccagggcccgcgcgggcctcgctggcctcgcgcccgcgccaatgggcgcccgcggagccctcgccccgcccccggcccgcccccgcaacccgagccaagagcggggcggggggtgcgggctgggggccctggggccccgggggggggggcggcggtcgcaggggctggggggtgcgcgggggcgaggctgggtggggggcagggagccgcagagcgccaaggccatgctgaatgcccgttctagagaattcaggggccccatcccgggtttctggggtgcccgggcggcctgtgctcgtgagctggggtctccgggcaggcaggggcaggcgggctcccagcgccccaccaggaggctgcactgcgggtgcgccccgtctgagtgcagatgcaggtggcttggggctgagtcggggggtccttgctggttgttgcggctgagggggcccctgggctcgggcggggcgcgcagccgccacctgccccagcaggaggagccggccacgcggcgcttggagcctcagccagatcccgagcgccccccggtgccgcgccggagccccggagcccccgccaggtgcgggacgcgcggaaggccggctgcgccgggccgaatctgggccaggcttggagcctacggaggctccggccgccagaggagagaggatcagggcgggaaacacagctcaaatcctacctgcatggccgagctcaccggggtgcgtctaagtagctcgcctttgcggcccacccaaaatatctggataatggttaccccgtcctcagtgcgttggacttgcatagacgcgagttcggtctcgggggccaccacgataatttgggggtctggggaaaccatctcctggagagtttgaacgatgtaagaaagcactgtgatttttaccaagtcaaaaaccacgcacaaaatcccgcaccccgccagccccccgccgcctaagcctagccaaggggaaggggccgccggcggaatctcgcgcccccctggcccccctcgcccccctcgctccgccatcaatcacttcgcccgcgctccgcgcgcgcctcccggcggagtcctaggcccgcgggctagaggcactttaccgcccggcgggagcgcctctcctccgcgtccctcgccccagccccctgcccgccccactttgggaccctccagccgctttccccacgaatgagatctttgcaatgagcaaacgaaagtggcgcggatttcggggcgcccagcaggagcgagcgcagccgccagccgcaagtccgcagccgtgtyccgcgccccacgccggcctccccggcggcagccggagacgagcgccagcaccggcgggacagcagcagatgcgggccgagagccggtcaggggcgcagaggcggaggggatcggcgcggcggggagctcaccgcgaagctggaggctgcgtccgcgggcgcaccaggagctcaggcagcgagcgatcgaacgctctgtggcaggcggtggacgctgctgaaggtgagcgagaccccggggccagtcctcagtgtccgggagcaacgcccagtccgttggaagacccggggacaatgcccaaatttgggggagactgggggcaatgcccggtcgctttcctggacacggggaagccctccctgtccacgtcctgagggcgcgcggccgacccaagtgtgtttgggcaacgctagagagaaatttcccaaatccgagttgctctggggacttcgtaggagacagagaggcccgaaaccagtgcccgctgtgcgcggggttggggaagctgcagtgggtggccggcgagccgggaacaatgcccaaattttggggaacgcaaggcagagttctttctgccttgcgggcttagcgaatgggtgtcctggaggaggggaccccggggactccgttaatgtgggaaccgtgattaatgactaaactcgagactccagaaaaatagattacaggtttgggggatgagagaagttgctccatgcaattgggaacatagagaaagaggtctcaaataggggccagctagcttgggggaccaatttgtgaggaggggtagttaaagaaaattctccatatgaaattgggaattttgccgtagagccatattacgtaaaattggcagatgaaagcaaggaacacattttggggatccaaacacattcttggtgtgttagggggaagctgagattaattttcacatcttaagaatataagttagtggcctggacgctggcagcagccggggaaaaaataaccttcataattactgtggcttcagggaaaggttttaacacccttcagagatggaagaaagcactgtctagattttgggggagcctggagtgtgatcagtacatttggggaaagcaaaataaaaaataaaaaaataaaaaatcagtattatttttctatgctaatttktaaatgatttccattagcttatttttggtaaataagaaaaagactatatattttcctggatgtcgtctgcatttgggggagccccagtgaaacacatttcaagtttttgggacacatggaaattacccaatggagatttgatatctaaatttctggaaacctagttagtagctaggaaacttataggtcgcaggtttttccatgcctgggatttcttgggacccagggacattttttagtgtgctttgggggtccatggaacattttctaaatgtagggggacccagggcagggaccataaagtcaggagactcataaatcagtattaaaaaaaaaaaaacctcaattgttttgtgaagggaaaaaaatctcaatttgctttggaaggctgggagacaataccgcaatttgggggctccaggaaaatcgtttttgaatctaaagatctagggaagttgctcagagtccttggaggacttgggggtccatatgtacattttaaagaaaggggattcagaattcctaggtcttaggacttaggaattttcagattttgtgatagggagtgtgcagtgtgtttgaaggaaatattgcttaactttgagatgactcagtgggttgtttggagcccaagaaatcagtgctgtcctgtgatccgagggcaatgctgaatgttcctagagggcctggagggcagcgtccagaacatccaagtatgggggaccaggaaaagggtccagtgtgatcctggccgttggggtttcagaccaatgcctgaattttagaaaagcaagattcttgttatgaagctcctgggacccwgagaattgtttaatagtcaatatgttgtgatgcagagaaagtgctcggaatgtttgggaactggggccgttagcaacacctggcataacagaaataaaagtaggctctgcccaaggggtccttttgtgcttggtgtagcccagagggacccgggagaccctgtgtgatttggggggacctggagaatcctgggtcacacttgagcacctcctggtaactgctcagtgtgctccagggacctgggtggcactgtctacatcttaagggacctgattcstggccaggcagcatatagagccatagacgttaatgccccaaagctttgtgactcacacacccacaacattctcaatagctttggggaatcactggggaaatccctccattttatgaaactcaggcaatcagagggcaggtcgtttatgattcagaaaaggattcaacatgctctgggtgtaatgaccgaatttgggggaaggtatgggaagcaattttcatactctgagggttccaaccttccagccctgctgagtgtcatgagggacttgggattcaacgtgtaaagtttagggaacccaggttagtgtgaatagatttgcgggacccaacagcaaatgtcccatgctgaggtgaacgggaaggggcgcgggggtggggtgggggggcgcggaatggggcggacgtgtgcgggaaacagtaagcttaggagaccctggagttaatattcaaaattatgcgggaaagttccacttgttttggaaacaatgcctaaatgtggaaaaggcactgtccacatcctggggagccaggcaaattggtcagcgcgaccaccacggaccaagggcttcgtctttaaaattagggaasccgggttagtggcctgtaaatctgtgggacctggagggggtgtataaaactgtccagagcctgggagaaagcacatctggggccccaggccacatagtgtaagtctggaaaagcccgccgggactgatgtgttttgacgtccccggaaattaacgtccaagaaaattattgtgacccgtcgaaatggtgartatatttagaagacttgggaagcaatgcttaaatttagaggatcccagaaaaagtaaaatgtccgagttcggggaaagcagggaagttgttccgtggattggaatcccccgaggatcaagggctaattgttgagctcaagcttcccgggcagcggaaggaaggcgctgccggggattcacctkggctggggcgcgcgcggagcactggcgccctccccgggaacccgagcgcgggcggcgcgggcaggtagcgcggagcgccctggcgcgcacggccggctgaaattctgcttttcgttctttggggtttttcttccttttgcttttattttttttttctttgccttctccacacggagagcgcgtttgtggcggcagcccgagcttagcgggcgtccgggtgtaaggaagaaacccaagggccgcgagggagcgaccaggacgctgcttcccgggcgctcccgggactcccagatacctgctcggtccccgcgtgggaggtccgcaggctccccctcgccactgcgccccactcgcctccgcgctgcgagcctaggcgaagccgcggccgagccgccaccgggggcaggctagtccccggcttggcttgggggcccggagcaccccggtggccacctccggcctgccccggagctttgcgcgcgccgttcgggccttcgccagcaccaaacaagggtgaaaccagttttgtttgggtaacactgaagagcagaggaagtggggaggaaaatgagaaacacggggcccgggaggaggggggtgcagggctgcacgccgctggggtgccaggggtctcttttcgttctctccaagcgaattttcagggaaagtctgtccactccggctggggaaagcccagttccttataggcaaatattaaacccgcatgcaggcgcccaacggccctgtcggcaggaacaaggtcaccccttggcgttgggcaatgtcgggcgatggggcagtggccctaaggggacctgtggggtgggtgggggtactgccagagagggggcaccgctggggaccagcagaatggtgggggatcctggggcaactacagtgggcattgcttgtccccattgtcaccccataggaggaccccggctagaaggggggcatctcaaagcctgacactggggaggcagaagttaatggccttggacaggtgtggggagctgggcaggatgaggcatctctttcacattagcttggcaagacagggagaacccgcccccaccatgaaaaacagcccattttccacccacagaacaagacacgtgggaatgtccccttcaaatttctgtctgcatcaatcacccccatgtcccattccaagaacatctggcccatctctccccacccatcactgccccccttcccaccagccttytgcagcctccccgtgtccccagctctctggcctctccggctgtgcctatagaagggggagcctccagcagagaacccctggctgtgttgatgttttcctctgcagggtgacttgtaaatttgggggtgaggagcatttgaaaggtgcctgtctgcaaacctggtccccgggagagcggactaggttgccgaggctcccgtcatggacaaaaccagggcccccagggccagctctaggctccccccaccttctcctccacgcctgcttcccaggctggggacaggttgggcatcgggggtgagccccagttccgagttgtgggttctcctcctctttgggggtgctggggacaattacaccagtgacctgtttgggggtcccttccctttgttctgccctgccgaggtgccttcccccagggggccaccgctcatgcttgaaaacgcatgcctggactttttaaggtaggaagaaggctgagggtcaccttggggtgcccacagcagggtgtagtggccctgtagggagggaggagcaggtgggggagtgggggtgcacacatgttccccctccctcgtggggctgcctgctgagtgctctccttatttagtcagaagtgaccagggcaggctggaggctggggcagacgcgggtcaccctgaggctcgaaaagcacaccggctcccctctagtcaagaccagcatcggggttcttcctcaagactggctcctcccccactacttccagcccccggaggtaggaagggtcccgccagcagtccargggtgttgggagggggccagggtctcctcccacccagagcttggccggcaggaactttagccccaagcagcgtccgccccccagccctgaaccagcacctcaccagggcaacgctggtctcctctccactggcaaacccacattccacagaggatgaacatcccctcaaggactcagactcaccccatggagcctggcccatgccccagcctcggcctgtggctgctccccatcccctcgctcaccagccctgaagtgggcctttctcattcccatttcctccccagctctggctctgagctcaccgctccgccgtccgtgggaccaagcccagcattttacaaacccagctcctktctccaagggtcctcagagcgcccctccgtcaccccctgcagggcgccgcagacgaggcgctgaccttgcgctcrctcccctcgctggggaaggacacactcgctggcgtcagcccggccggcctgggaagtaggactaaggacccgaactgcaaccctccacaccagacagcacagaccaccccaaggctgctcaatctgcccaaagccaaaagtacgtgggggatatgggtccaggttggggtgcttgggagagggccctgggagaggggttcagacggtgcacactccaaaggactgaggcggcgccactgtgttaccattttattgagtgtctaaggtaaagacacctttgaaagaacactcccggcttctatctgggatgggcaaatcagcctgaagagtcacctgctggatccctccctgcaggccctgtcrtggggcaggtacagggactccaatccatgtgcctccagctccaacgctccccaagtcctggagcctcccctgtcaccccagtgcctgaccagtgaatgggtgctgcccccactacagagctccctctggctgaggcagaggccactggctgggcctttctagccacctttcacccctcttgcacacgggaagccccgcaggctcctgaccacaatgggatcctgacgccggagccccttaggccctttgctcagaaggcctctggttattacctcaattctgaacagccaggaggcctgagactgtcacccactttgataaatacagaccgacagaaaggtcaggccattggtgcaagaccccatggccagcagcctggggcggggagaacccgggggtctcacagcccccagcagagcccagctttccttgggtttttaggttcttccccaatgatattttccctttttccctctctacccactttctgccccccatcttctcccctttggctgcccgctctctccctgcccctctccccttctttgccctctttcgtctcccaggagctcccctgccaggacctcggtgccgtggagactgcggggaacctgctctgcccacacctgctctggcccctagacggaagcacctggagccaaccacggaactccagatcccagctgtgtgactgaatccacgccagcctctctgagccaaagctgcttgcagaagggggagatcccagttcgaagactcccgcgcagagcctgtggccctctctgccaggcctcagggtgcctgagacactcacctctctgcctcgcagttggggctgaggctggggctggctgccagcctcagttctgggagcgctggggtcgcctgggccacaggccacagcagctcacctcaggactgggctctctggcctgctggggctcaggctgtggggcaggctgggcagggggctgagctggcagcgattcagagccctggggctgggggctggaatccacctcctcccacacargctcggtggtgactcttcggcccctggggaaaaacaaaaagatattgctgagatgacctcttttaaaagcaaagcccccctccccatacaccccaagcctgagccctgtcccatccccctccccgggttccttcaggtcaccttgtcaggatctgggcagcggcttccccctctagcccctcccctgcctagagctccctctttcaaagtataagggagggaagaagtggtgagaagtttgcctagaaagggcttcccggtgctgatggagaggccgagacccttctgttggacaggctgccctgttcctgggtgaggatgggcttctgcctggcactgggggtggagggtgcacacgaatggcccgccttgaggggtcatggcacggaatatgaaagcctcctccacctccaaacacccccaccttggaaggagataaggagggggccccagcaaaagccactggacacacagctctgcttgacgaggccagtgagggacggcgtggctgtgcttcctggggaagtgaaccccctccccacagacaccaccctgggtggattgaggagtctgggtccagggtgcaacagagaaaaacttcatgcatgaatgagcattcccagggaaactgccttggccccagggcgcctctctgtgccagggaggctgggagagcagcaagggggaccaggtgcgccatcaggaggagagaagctaaacctaggggggacatggagggcggttgttgcctctcccggcrtttctcctcagtctcctgtccaatttcttgctggtggtcagcaggcatagggaggcaggagggaaggaagctttacctgtaaaatggtgtatatatgtataaataaaatatctgcgccagaatctcgggcccccggctcctctgcaaagtctcctgtttgtctctgggaatgggatgggggatgcaacgggaggaaacttttcacacagaaagactcttcctttcacacttgtgaagacagctgtgtgttcccgctgggaagagcggcctagccctcctcccctacccctcccattttgcttggtgaattagtcaaggaaaacctattttccttgcaaaagcctcagtggctttgtgcagccctaaaggagaaccctctccacaatggcctttcctgcacaccccatccctgaagttgaggctgctctcaggaggcttccctgcaccctccagcagcagaagttcttcccctccttcagaaaccaggatcctggcagctgccccaagctcccggcccacccacgcctgaacacttaaagtgcagcttttctctcacactcaagggatgggagcccagttacctgtactctagtccctgcgcagtccccgcagctcctggacagtggataaagaggaccggggagtcactggtgcccaaggctctctgccgaaactgcctggacgatgatccgccggcctggccaatattagcagtcaccaccaaagcagggggtgccctggctgtggcgtccagaccctctggccaggttgacgtggaggaggagagggacaaagctgaggctggagaaacgaagggcacttttagagtgtgcatgttaatacggcccctacagatgggagagcctcatctccgctgagcatggcacctgctcaaatgccaactgaaatgatgggtttacccctcacctcctcatcccctccactcgtttccctgagcccctccgaatttggggagctttgtgccaacttggtagtgccgaggccgctggggcagctggctcaggcactttccagcaccagggcatggtacattagcgggtggaggtttggcccacccctgacctggcagaaaggcgcctgtgggcgtgggcataagccagaagctccctgccagctaggaggtgggggctatgtggaggtggtggggagtgggtgtagctttacttagagtgacacttggcagttacttgacaccctggaatgttggtggacgtggcactggtaaaatggcggggggggggggggaataagggggacaaagcagggttcaagaatcagcagaaaaattggattttaggtgctcccggtacagttatgtactgtgcagttatgtccttccatcttccatgagcaaggtactcagctggggggtttttcacttcactggtcacgtctgatctgacctcagacactccctgtgtggtactaagctctaatgacactgctgcagggggcacttgcaggcatttctggattgggcgattggacaggttcgcagcctttctaattaaagcacagactcaaagctgacagcagctgggtgagggttcatatagaagcatccaccagattggactaaatcacactggaaatttctaacctcttccccaagctagcaaagactcaggaagaggcaaagacgtgtactttccagagagccaccagtccccccctccaacacccacgcaccccaaccaccttcagtgtgattagttttactagcctgtgttgggatttaattgtcccctctccctttttctttcaagccctcgtcttaaatcccttcattagctggaggaataggacatctagtggggacaacaaggatttcagcagggaagagagttagacttgaaggggattcaaatctggcatgtgttgggggatgtctcaaataagacgtagatgccccagagccatgccctcccatgggaggagggaaaatgggatttttcactcggcttttgggtggggagggatgttaatggccctgtcaggtccagagcactgaatgggttcacagtctttccagctaaagcacagactcagagctggcagcagctcagggagggctcagatagaatcacccattggattagatcaagtcttactgggaatttgacacctcctcctcaagcctgcaggaagagaaggcacaaaacaaagactcagggaaagaaacaaaacaaagatacaaggaggtcagcatgaagcagcccttgctccggggctctatggcttagagaccccgtagcatgtgctggtcccagtgtctgctgcaagatgcccaaatgttgcaaacagcgactgccagagccctctggagacacttggctgggactttccaagctgcagatggacctagagagagtgacgggctgacacccagccagatgaagtgattccatgggatgcccccccaaatgaacagtccccaggttgaggaggtgggcagctatggggctgaaagggaagcagcccacaggtcaaactcctggaaacctggagcctcccaggcccacaatggtgtcttgaatccaaactctgccctggactggaattccatctctggatgggcccaggaggagctcactctagtctccaaggctattttatcccatcaggatcttggaacccagggtgtgtaaacaggagaaggagagcagggagaagcggtcaggatagaaagggcccccggggagcagctaagccatggtgccaccgaggcaggactagaggcattggggatcagtgagttggggtgtgagggctgtggccccacagcactacattccacagattttccacgcaagggtctgggggacacatgctttatggagacaggtgagagggaccgcaaaatggacaaaaactggggtgcaggattgagggacacgacatagaaaaacctccttgctccactgcctcttaggcctgggagaggctcagcccacccctgttcatgcatgagagtcttgggaacccccagaaatctgctacaccaagctttcgccatttagcttcttaagtggccttctgctgacacctggcggccatttctagaattacagtggcataacccaaaggtcttgggcgccgcaatttggggcactctggagggggactctgggggcaaagtcaggacgcctccctacagtgtcagggtgccatgggtcctgcacctttgtgtttggaaccggggctcttatctgcttctgtcccggcattacaggactgagagggggcgctgagggaattcctcccttcgggtgtctcctaacccgagggggctgtggcctggtgagcatcctaaagcttagggcctaagccacaggataggtctggaacacctttctgaagcatccgttttgttctaagagaggaaaccaccacattagcatgaacataaaatgagatctattactgagaggcccggggcagaacgttgagaccccctttcagagacagcgtccctaggatgagcccagatgggctgaatttcgttcttaactcgcttccccagccccacccggctccacctgtaaagcggagatttcctaatctggcccgagcctgacaccatgtggccacttgtgagaattgcatccacagcttcagaaagcaccgccagtaaatccatattgccatgaccggagctacagggccgcttaacaaaccttgggaattgagagaagaggaggaagtaacccacaacctagtcctgaaaacaccagactgtggccccagagccctacaccatcgaggtactggaaggccaggctgcctctgctggggaagtgaggccgtccttcaaaggctatagggccacagcccgaggggctggcagggccaaggggaccactgtgccactcgcacatcagtgcttggaggacggatgggcaggaggggcctgggggctaacccagttcacagccgcgctctgccaacgaccttggacaaaccagttcatgcctcccctctcccttccaacctcacggctacagtggatgggtctgggtagccacctctggcacaaaatcaatgttaataaacgttcgattttatcctccccctgacgtaaagtgacatttgcccctgcctcccctacccacaggtccacaggtgccgaaaccttttttggtggtcatgtgctcagcaactcttcggcaggcctaggcagctcgggagctcgctgcaaagactcctccacctgctccagcaaaacttgctggctggcaggggttgcagtgagctgagatcgcaccattggactccagcctggatgacagagcaagactctcaaaaaacaaacaagcaaacaaacaaaaaacaaaacaaaacttgctgcctgggaggactctggggttttcacagcctgtggcccatgaacaggagggaggctccaggagcacagatttcagcagtgggccggatctgcatccctggcagtgggggcccagtatggacccatcctcaaggcctcagtgccagcaaggcgggagacacgtcttccaggaagcctccccagccccactccctgctaatttctgccttctctgttctgagctctgatggtgcagctgaggtttctccctgccctgggcttccttggatgctgggctgggggttgaaagagctgcaaagaccccttccctgtgatgggcctcagggccacggattgtacctgggtgttgcaggcacctcagagcccctcctgcttgtttttttgattgttttgatttttttgtttttgtttttttgagacggagtttcgctctcgttgcccaggctggagtgcaatggtgccatctcggctcagcgcaacctctgcttcccaggttcaagcgattctcctgcctcagcctcccgaatatctgggattacaggcatgtgccaccacacccagctaattttgtagttttagtaaagatggggtttctccctgttggtcaggctggtcttgaactcccgacctcaggtgatctgcccgcctcagcctcctaaagtgctgggattataggcatgagccaccgcacccagcctctcctgcttgttttactctaagatgtgcagaggcctccgtaccccagccccgggctcctccctcgaggagctgctcctccctccaaggtcccttccacacgccctgtgcatgcccggtagccatggggactgccacttcccacggaggacatgtcagcttccccttgcctgtggtgcccagacctgaaccacacccacggggctgtccccgtgatttgaaggcctgggcacagaaagcagctcacgggtgtactgaagccagaggcgcggctgccgaagggcctgcctctcacagacaacactgagctacaccatccagcagctgaggcaggcagggccttctttggttcccttctgatggatgaggaaaccaaggcccagagatgctaagtgactttcccaaggccacacagccactggcagcagagccaggatgtcagccccgcctctcagctctcacccttcagccccacactggcccaggtggacactcactggccctgaggatgctgagggcccatgacttcttggcacccacagatcacaacctgttgtagaccttgaggccacagctaccccttctttgttgtcgagaccagcccatgcccagccagggggagggacccaggtgctagctctgtaagggtccctggcaagggcagcatgggcagtgctgggctgggtctgcggccctggaagcaggagcccagcgtggcctcgtgctcaaggctgcagtgctggcaggggcctgggacacctcctccaggaagcctcccagcctgctggctcctgcctcctctgctctgagctctggtgctgcagctggagctggcatggggtgccccagccctccctctctccctgagttctcaggcaactcttccccctgcctggagcccagccgcctgctccctccttccccacagctgggcctaggttgggaagtgctctcacggagcatctgtcctgggcccgccccccaggtggcaagggaggaagcccaccttccactcacccctgcccctgaaagcttttcttgcaccttgaaggtcagggc

SEQ ID NO: 17560 - DNA, 209822 bp, Homo sapiens
acatccaacatttaatgatttaaaaagaaaagcctggtaactagagtggaaggaagcttccttaatcagagcagctgtgaaaaatatatgggaaaaaatcttatttagtggtaaaacttttcaaacattcacattaaaatttagaagtaagttaaaagatgtctagcccctaccttctgtatcgtattagagggcctaaccattgcagtaaaacaaggggctaaacagtttaagacgtaggaaaaaaatctgaactcactaataaatctcgacatctctaaaagtgggacagtatgtatatgccttctgctatgatgcaaggaagtacctatgaagtattcttgcaaaagcaaacaaaaaaccaaaaactaatcaagcctctagatgtcactggcagtttctggaacaaattaagcatcaccatgaagatgtaatcagcagaatcatgaagtgggaaattctataggaccaatgacttagattcttcaacaaatggcaggggggaagaaatggagagggaattgtcatgtgaactaaatgcaatgtgacaatcttgttggatcctgattttaactaactgtggaaggaagggcatttttgagacagaaaactgaacatggaacaggtatcagatgatattaaggaattattaattttgttgggtatgataatgggattatcagtatgttttttaaaaataagaaaaggcaggctaggtgcagtggctcatgcctgtaatcccagcattttgggaggctgaaacggatggatcacaaggtcaagagatcgagaccatcctggccaacatggtgaaaccccatctctactaaaaaaatacaaaaagtagctgggcgtggtggcgcgcgcctgtagtcccagctactcgggaggctgaggcagaagaatcgcttgaacccaggaggcagaggttgcagtgatcacgccactgcactccagcctggcgacagagcaagactccatctcaaaaaaaaaaaaaaggccttgtctcttagagatatacattgaagtatttatgggtgaaataatatatctagatatgctttaaaatactccaggaaggctgggcaaggtggctcacgcctgtaatcccagcactttgggaggccgaggcaggtggatcaccttaggtcaggagttcaagactagcctggccagcttggtgaaaccctatctctactaaaaatacaaaaattagctgggcatggtggcaggcacctgtaattccagctacttgggaggctgaggcaggagaatcgcttgattgtgggaggcagaagttgcagtgagccgagctcacgccattgcactccagcctgggtgacagagagagactccgtctcaaaaaaaaaaaaaaattctgggaaaaacacagaacaaaatgaaaaaagttgtggagaggagaggtaggatagataaaacaagaatggcaaattgtttaagctgaagctggatgataggaacacagggatttattatatcatctcttgtatttgtttgaaaattttcatactaagtttattttacaaattaaaacattaaataaaatagaatttaaaaggttggtgtttgcataatgttctgctaaataaaaaatcctaaagaactttagacaaatttttttaaagtcatttttattttatcacatactagtttccatctaccataatatgatttttttttttagagacagaatcttgctatattgcccaggctagccttgaacacctgggttcaagcaatcctcctgcctcagcctctcaagaagctgggattacaggtgtgtaccactgttcctggcacagacaaaatactagaataacagaattcaacaaggtttttggtacaagattgctgtacaaaaatccacagtgttgctataccccaataatagccaaatagaaaaaaaaagatgtgaaaaacaaaactataaaactatgaaaatgaaaatgaaaatcttagtgacctcaggagagggaaggatttcttaagaaagctacaagtcagctatcataacaacagattgataaatttgactacattgaaattaaaatctagagaacaaatcaccgtaaacaaagacgacaagtgtcaacctgggagaaggtatttataacatataccaagcgttaacttaaaaaagcccaacaatgggctgggtgcggtggctcatgcctgtaatcccagcactttgggaggctgaggcagaaggatagcttgagcctaggagtttgagaccagcccgggcaacaaagcgagactctgtctctctctctcttttaaaaatgtatatattaaaaagccccacaatgaataaatttagaaaagaaggggagactttatggcctgcaaggtggccatcctgcaggctgggaagcgtgcctccagaaacaggcgctttgaaggaggagggcttggagtgtagttcaggctgaacaggttggctaaacctacattttcaccaggttacaggaagagctatgaatattcatgaaagtggtcctgacacatgcgtattgaacaaaaactcatgtaacatatgacccatattcactttgggatggagacttaacttttttgttgttgttgttcagacggagtcttgctctgtcacccaggctggactgcaacgatgtgatctcagctcactgtaacctccacttcccggtttcaagcgatactcctgcctcagcctcctgagtagctgggattacaggaacctgcccccacgcctggctaattttcgtatttttagtagagatggggtttccccatgttggccaggctggtctcaagctcctgacctcgtgatcttcccacctgggcctcccaaagtgctgggattacaggcgtgagccaccacacccagccaagacttaacatttaaatgtattacgagccctatacgtcaaaaggtctttcaggacatgaagccatgcaaatgtgcgacctctgtagaccagccagaaccagtccatggccagtggtcttcttacctggagaaagttactgaaatcaacaaaaagttgtccaatgaaagctgtagctatggctggtggaacggggactgggggtcagtaagtcagcatctcgtggagctgcacattattttaatattgtttatctttaggccagtacttgtttagctgctagagaagaatcttgtggcagttagaacacagtttattctttaagtataggggtgtgggactaaaaccttgcctggaatggctttaggtcttttttataatttggcatcttattgccagagtctgttctgtcagtcttatcatctctgttttaacattaatgctggccagttgttgtgttaaactacaaaagggagggagtataacaaggtgtgtctaacctgtcccatcgtggtctagaactcagttttaaggttttctaggatccccttggccacaagggggcctattctgttggtggcggacttaggagtttagttttactttatacaggtgaatgaatagagcaggctatctaatgacgtacacatcatttgtgaaagaaaactccatagcaaactttataaaaggtaagagtggacagttcacagaagaggaaataaggtttcataagtatggaagaatgcaccactttgttagggaaatgtaaattgcaattttcacagcggtaaaaatggtaagagtctgaccatatcttgtgttggagagaatgtggaacaaagagaactcatcaatgctagtgagggtgtaaactgataaaatagtacatacattatttaagacattcttgaggctgggtgcggtggctcacgcctgtaatctcaacagtttgggaggcagaggcgggcggactgcttgaattcagaagttttgagaccagcctgggcaacatggtgaaatcctgtctctacaaaaaatacaaaaattagtcgggtgtggtggtgggttcccgtagtctcagctattgtggggagaggcatgaggatcgcttaaacctgggaggtcaagctgcagtgagctgagatggctccactgcaatccagcctaggggacaaagtgagcccctgtctcaaaaaaaaaaaaaaaaaaaaaaagagggagagagagagagaaattgagattcattcaaggaaataccatgggtagatccttaatatccaataagaaaaatgatttggagaacattaaagtttacatacattaaaaaaacccaaatgacactaaatgcatgtgtctataaacatgtttaagcaccgtaaaactaaaaataaaagtggactagaattacacttttatttttataaaataaaattttatacccataaaattcatggtagaagtggcctacgccaagggaggaaaatgaagcagggaggaaagaggaattcaattctgtagtatttaatttcttatgaaaaatctgggacaaaaatgaaaaatgttaaatttttaaattcttggtgataggtcacaaatgtttgtttcataattacttgcactttttgaataaaaataaaatcttttggaaattaaaaaaattggcgatttgtcatggtgattttcttaaaagactaaggtgtctagtgggatacagaagactcgatgattttattttattttaggttttttttttttttttttttttgagacgcagtctcgcaatgtcgaccaggctggtgtgcagtggtgcgatctccgctcgctgcaacctctgcctcccgcgttcatgcgattctcctgcctcagcctcccgagtagctgggattacagctacttgcccgccaccacgcctggctaactttttgtatttttagtggagacagggtttcactatgttggccaggctggtctcgaactcctgacctcgtgatccgcccgcctcggcctcccaaagtgctgggattacaggcgtgagccaccgcgcccggccttattttagttttttatgtcaatttttgaatttgtaattgggtgagaattaaagtgttataaatttcaccttaagtgaaaatttattagttttctaatgacaaaagtagttacatctgacgtaaggggatttaattatctttttctgggcttgcgtcccggaacgctgctgcattatgtaatctgtagtaatatacccacgagcagtttggagggttctgggaagcacatttgttttgcttacctaccatgggaaagattccacgtggtcctagaagcatacgtattcgtcggttacagtattttaaatattcactggccgctgaaatttaaaatggatgaaaaagaaattctcttaagtagcgttcttgaaactgctttatcaaactcagttcatattttcagttggagttcgtgatgtatgtgaatttcctttaaataaaacccgaatctttagtaatacaaatattgggaacttcgattactgtaggtcttagggtagactcgcttggactttgactaaatactatgctttagaaatttatctttaggagataaatttggggggtttatctttttatatttgctttgtttcaatttatttaaataaaagtagtctttctagaagtatgttttatagtaccacttacctcggttactgtcccagttaagcagttttcacgaatgtggaaaaatagtagtgtttttctttcatacacgcgtatatgaaaaatttttacattgatagagaattattcgtaaaaattaaagtaaatttactgttagtctctaattttgttctgagatagccacgctgtggcattaagaaggataatcaaggaataagccataatgttcagaaaggggctttactttttatttttaatattattgataaactttgtttagtcgaattgatgtctgcgtgtcttcccccgccttccccataaaacagcgggacagaaagtcctgaaaactccaaaagggaaatatttactcagaggtctattcaaatttgcttagtctctgacgttttcctgtgtcgtacaaatccctcgtgcggcaraagtagtttgtctttamtaggccaccgtctcgtcagcgttacggagtattttgtccgcctgccgccgccgtcccagatattaatcacggagttccagggagaaggaacttgtgaaatgggggagccggctggggttgccggcaccatggagtcaccttttagcccgggactctytcacaggctggatgaagattggggtgagtgggatctgagaatgtaccagkgtggctcgggttygcgtctaaaggtttcttcctccctacttccgcccactcgtggtgacaggtgtggaccaaccctgcctggggagtgaggcccctcgtcactcctgttcgtgyccctggaagagtctgggagtatcgttcggcttctgtcctggccacagggagagtagaatattgtctaactggagttaactgtcgtttttcactattcccactggggaagtaccgggtgatctttttgtgtggctaacactggacgtctttaggaggtttagagcaaaatggctgggaccgccaaaaaggctacaagctatttcctgagtgtgaaatgtgggcggtgagcacaatggagtgggtttttgtgtgtttggtgtatatgagagaatgtggttatatacaagaaattctaatcttacagcttttactattggtttaagcctgatgtcygtcttggcagaaaagcaaaacacccaagcacctgacctcgggtccctgcttagctacacctaatacttatggtgtaatcctgactgctctccagatacagctcttaattttcttgttaatggatattttgtttggttttggtggtcaggaagggtggaatgggatgaagtggaaatgagaatgaagaaactttgttatctaagtatttagaggagacttttattctcctcttgattgcaagatataatagtaatattgttcttaggttccaatatgaatttgggattgtgtaggttcccaaatgggcccgctagtgagcctacaccactcatcagccttggaactggggggaacccagtttatctttctcccttggatcagcattctcaatagcaggagtggaaggaatctcaactttttattgaacaaagtcatttaattgtttcaaggacagatgttctctaaaactatattctattggagatttattttaatccttgggtagattttttaagagttgctggaaaacttaagattttttattcccattttcccaagccaaatgcattagtgacagtaaccatttatttagctctttgtgtcagggaccctgttaaactcttgacatgaagtattttgtttaatcctaccaacagtccaatgaggtactgtttattttagagatgaggaaactgaggctaacagaatttgtgctcagattcttagagctagttagtggcagaagaaggatcagaccaggtttttctacctccaaagtctgtacccctagcatctattctataatgctttcctaactcatgtctacagattttattcttcctaagatccctggttattaataagactacttgaatatattgggtagttatgatttattttgtcagctagtcagctattatattttcatgacatttcttttctttacctctttttttgagatggagtttcgcttttgttgcccaggctagagtgtaatggcgcaatcttggctcaccgcaacctccgccactcgggtttgagcgattctcctgcctcagcctcccgagtagctgggattacaggcatgcaccaccacgcccggctaattttgtatttttagtagagacgaggtttctccatgttggttaggctggtctggagctctggacctcaggtgatccgcccacctcggcctcccaaagtgctgggattacgggtgtgagccactgtgcccggccagtgacatttcttaaagtataactgtgggacacttcctggtagcataattttatgtcgtcttctgatacccaggctgcattttccagacttatctgatcacttgacttaatgttctctracagagcattcagttctttgtagtcagttcaccgactcacttctatcgggtatcctgccctgtccctccctgaatgtgcccatttccattgttttccaggtttcccttttcaaactgttaacagtcttctcttctttgaagactttaatttaattccttaggtgttcagtaagtmggatagattttgttggcaatagagtgaaacactactgtctgatagtgtttcgttctgtgacagttgctgttttggatgttcaagtacttcactgatttacttgattttgttgttgttgttgttgtttcttttagagacagggtcttgctctgtcgcccaggctggagtgcggtgatgcaatcatagttcactgtgacctggaactcctgggctcaagtgatccttccatctgagcctcctgagtcgctaggactacaggtgcacaccgctaccatgcctggttaatttttaatttttgaattttttgtagagacaggggtcttgctgtgttgcccagactggtctccaactggcctcagtcatcctgcctcaacctcccaggtgatgggattacaggctcaagccactgtgtctagccttgatttttttttaatattagacactatctagttaaaatttaaaaatcagattatgtaattagtatgtcctgtgattttaacaactctaaataatttaaataaagtgattaactcagaacagcctgtgagggatgtgctttcctttttctttttaacttaggtaatgaaatttagagcaagagtcttcaaacattttctgtaaaggttcagatagtaaatattttaggctttgtgattacatggtcactgttgcaactactcaagtctgctgtgatagtgcaggagcagccagagacagcataaacaagtgagcatggctgtgtttctataaagctttatagacactgaaatttgaatttcacataattattttaaataataagcctacttttttagtataattatagatttacacaataattgagcagatagtacaaagagtccacatacttccccttcatccccagcttctcctattggtaacatcttgcattagtgtggtacattggttacaattgatgagccagtattgrtacattattattaactaagcccatcatttaaagttcactctgttgtacattctatggcagggatccccagccttttggcaccagggactggtttcatgaaagacaatttttccacaggaggtggggacagggaggcacaggaaatgttttcaggatgattcaagtgcattacatttattgtgcactttatttgtattgttattacactgtaatatataatgaaataattatataactcaacataatacagaattagtgggagccctgagcttgttttcctgcaactagatggtctcatctgggggtgatgggagacagtgattagatcatcaggcgttagattctcataaggagcgtgcactctagatccctcacatgtgcagttcacagtagggttcacactcctatgagaatctaatgctgctgctgatctgacaggtcgtggagctcaggcggtaatgcaagtgatggggagtggctgtaaatacagatgaagcttcgctcactcacccacctgctgctcacctcctgctgtgtggcctggttcccaacagggttgggaaccactgttctatgggttttgacaaaggtataatgacatgtatccataattacagtattatatagaatagtttcactgccctaaaaaagccctatgctctacctattttttcctccttcctcttccctacctctggtcaggtaaccactgatcttttcactgtctccatggttttgccttttgcagaatgtcatatagttggaatcatacagtatgtagcatttttgaattggcttctttcacttagcaatatgcacttaaggtccctccatgtcttttcatggcttgatagctcatttcttcttagcactaaatagtattacaaaaatactatttacagtgttacaaaaaatagtatgtatgttctatagcctattagtctgcctaggctgccataagacaacaccacagactgcgtggtttaaacaatggaaatttattttctcccagttctggaggttagagttcaagatcaagatggccgcaccttcaggttctggttagggctctcttcctggcttgcatgcacatggctgccttcttcttgtgtcctcacayggcactgagagagagaatcttcttcttcttataaggccacagtcctatcagattagtgccccactttaatgacctcatttaactttaattacctcctaaagacwgtatctctcgatatagtaatatttggggttagggcttcaacatacgaattttggaggacacagtttagkccataaattcacagtttgcttatccacttacctattgaagcacatcttggttgcttccaacttttggcaattatatataaaactgctgaaaacatttgtgtgcaggtttttgtgtggacatgcattttccaattgtttgggtaaatatcaaggagcacaattgctggattgtgtggtaagaacatgttttttgtttgttttgtaagaaattgccaaactgtcttccaaagtggctataccattttgcattcccgctagcaatgaatgagcatttttgatgctccacatccttgctaacatttggtgttgccagtactttggattttagtcattctaataggtgtgtagtggtatgttttaatttgcagtttcctgatgacatatgatgttgagcatcttttcatatgcttatttgccgtctgtatgttttaccctcctctctccttctctcttctcttttactcttgcttgaatttgtgcaaaagctgctttattctgctttcttctttcttccctcctcctcctcctttctcctttctcctttttccttctctttattcttctgtcagctgtacttaagatatgtgtatcaagatcagaagctttcgtctgccactgtggtttcgtttatgtcttcagtctcttstgtgaaggttctcttggctttctagcactaaatcaaaatctggtgctcctggatgacacaacttcccgtaatgccccggtgaacggttgctaattttattctcaaaaccttttcaccatagggcctctgttggtgggataggtgyctccattgtccttcactgctattctcctttcctcctccctaaaaatatctaagttgaaatctcattttgtcacaatatcccatcctctacctctcctgattcctggatcactctctttcacttttytttttttcttttagagatggggtcttgttctcttgcccaggttggagctggagtatgcggtggagcaatcacagctcactgcatcttcagacccctggggtcaaaggatcctcctgcctcagcctcccgagtagctgggactacagacacatgccaccatgcctggcttctttttggctttttgaaaacattttgccactagcttactgttactttcytcaccattacttccatcatgattcttggatgatttcagtatccttagagaagatccttcagatacactgacctgtcattttctggacctcctctttatcactgatcttaccttttacccagtctcagccatttgctttcctgatcataagcctaagtcttgtcactaccaataacatctcactttcaaacatcctgctctgactgccttcgcctgttttaccagcttacttcctttagtattccagtttcaatagttgttcagtccttctgagrttttgccatgtttccagtgtctctcattctcttcagttcatcacgtccctcttacccagtttaaataccatggacagtcattgtcactatttccttcctttcacctttcatattcatgtctgtctcttttctggtaggtttctcttggataaacctattagttaaattcagttttgcccacttcatgcctgtcctagtatagctgaatcagctgaagaaaacacttcaactgtcctgactggtctcaatttaagtgttgccagaccaatcatatttccctggtcctctcactgtcccattctgatgattgctttataaagtttcttctatcttcaaacctccaacatctctcccatcctttgaatcagaagagaacttctacagtctcccactacctcatttacccacctatcaacatgtttgctttctcttttgttggtgagaatgagtggcttcttgctcctagctagagccagtccttccatatgtgctttagattcttcctgttttgttcaagaatattgctcaagctattcttcctcctgtttcctgcatcagcatttcccctctctactagatcatctctgtcagtaaatgaacatgttgttgtttctcctagaagtactgtttctatatctagatagtactctagctagagttaaaaaaaaaaaaaacaaaaccaacaaactcaaaactctcttcagatgttacttcacctcttgctgttactgcatttctctactgtatgttacagcagaattccttttaaaaaatgtccacgttcactgactctagttttttatttctccttgtctcttgaacccagtccagtcaggtgccaccactccactgaaactcctgtttttttttttttttttttttgagacagagtcttgctctgttgcccaggctagagtgcaatggcacgatcttggctcactgtaacctccacctcctggattcaagcgattcccgcctcagcttcctgagtagctgagattacaggcgcctgccaccatgcccggctactttttgtatttttttttttttgagacggagtctctctctgttacccaggctggagtgcagtggctcactcggctcactgcaagctccacctcccaggttcacgccattcttctgcctcagccttccgagtagctgggactacaggcacctgctaccacacctggctaaatttttttttgtatttttagtagagacggggtttcaccgtgttagccgggatggtcttgatctcctgacctcatgatccgcctgcccaccttggcctcccaaagtgctgagattacaggcgtcagccactaatttttgtatttttagtagagatggggtttcaccatgctggccaggctggtctcaaactcccgacctcatgtgatccacccgcctcggccttccaaagtgctgggattacaggcgtgagccatcatgcctggcctgaaactgctgtttttaagggcactactgatttccacattgctaaacccagtgactgtgtctgatcttattaaacttataaggagtaaatgaataaataaatgggcaaggtggaggtgaggtgggaaagtttgttgagtacactaaaaatagtaactaccattatttactactgttgagggaaatctaatagtgtgggactggtgcaaaggatatagaaataggcaataggttttaggatactttggggtaactgatgctaacagtttcttatggattcttttggaatgttctataaatatacgagtatatttatcaacccaccttcagttatttttttaaccacagaaaagtcaaaagatcagtacactgataaacgtgcgttttccttatctagatttaccaactgttaacatcgtgccacattcactttatatcttaatattacccacactttcctcctttttcacatctgaaagtgggctgcagataatatgaaactcctaaacacttcaccatgtatttcctaagaatgaggaaatgtttatttttaaaaagcatcaattcattttaatatgctttatacttcaaagctaacatcacagggttctttttcaccttcttgcaccatatgcttgtatttctcttctgccgctatgagaatcctgattcccaataacatcctttgtttttataggctcacttcagcagctctgttggaaataaactgaaagaggggcaagggcagaagcagggagacgttttggaggctgttatagcaatccccatgagttacaatagtagcagtggagtaatgagaagtagttggattatggatatgtacacacacacacacacacacacacacacacatacacacatatatatacatacattttaaaattttgaaatagtttgaaatctatagaaaagttttaagaacagtgcaaagaactcttgcatgccttttacacagactcctcagttgttaaattttactgcatttactcaatttctctctttctccctttcaagagagagagatgtgttgacccatcacctttaaatactgtagtgtatactctctatcctcctgcctcccaaaagaaggccactttcctctattactaccctatatttcttccagtcaggagataaacattgatacaacagtgtcatccaattcaaagacaccattcaaagtttgccatctgtttcaataatgatttgcttttctagtctaggattttacttgcaaacactcattgcttttacttatcatgtctcatcagtgtcctttaatctggaacagttctttagtcttttcctgtctctaatgtccttgacagtcttaaagagtagaagtcttttattcgacaagatgatcctaaaccactaaggggttccttggaaaaatgaccaattccagggctgggaaagtgcagggaaagtgcaaaataagcctggaaaatcttgggccagaaattctcagcaaatgaacatgttaaaaagaacaaaggccccaatatgaatgaactccccgtggtcaaatctgggaaaatttggcatcagaataaaatgagggtatacattatagtgtaaatactatgcgatgttcctatgccatcatatcatcctgtgatatagtcacatgatcacttggtcaagttggtatcttctaggtttcaccactgtaaagccactgcttcccattttgtattttattgctattttgggggagataatctgacataacaccaatatccttttcttattaaacctctaaccacgagccctagcctcattaataaccccaatctatatcagttaccactctaatggttgccaaatggtaactatctaactctatcattctgtctatcattctatcattgttgattgacattgcactataagaaccaacctacctacctaccttccttccttcctttgttccgtgatgaactcattgattccttttttatttggtggttggtaaaccgctactctcattttattctgatgctcagattttcccagatttgaccactgagaattcattcatattggggcctttgttctttttgacatattcctgtcatttgctgagaatttctggcacagcaagatttccaggcttattttgcactttccctgctgcaagccctggaattggttatttctccaaggaaccccttagtggacttctgtttggtggaagatggtatttagtatccaagatctggtcacccagtattttcattgctactgggatgtcattgcttctaggacctcttagcagacagaactaggaaatatatatacatgtgtgtatatatatatatatgtgcatgtgtatatatgtatatatgcataatacaaacatctgcatatgtgtgtacatatatatatacttccacagctatctgtatgtgttatattttaaatgagtttatttactaatacttctagttctaatccaacatcttaggattcttttagtctcccgactctttccatgctcttaaatcctttctcagactgtgagaaatctgactccaattattttagtaaaaggcaaaagattcattcgttctgaagagaaaccagagcattctaattattttagatatattcaaccatttgctcagtcacctaacatatttgttcagtatgaccactctcctaaccactcagcctgcgttttccatctgctactccattccccctcccactgggctggggcatgctggcatctttgctgggcaatagtctctcccacaccatcctatttccttggatatgaggcatattgctggagatgactgtgcacaaaaccccatcacctttgttgccctgcttctttggaagctgacatctctgtgttgggaggggtagggaagaaaaggaaggttgggaagggaaggaagaatgggaggaaaggtaggaagccacattacagatatatattttgagaacagagctgacagaattttctggtagattgattatggagagtgaggaagagaagtaaataattaagtaataatgatcccaaggtttttggcctgagcaactgggaaaatccaattgtcattaactgagatgaggacaaagcagtaggaggtttggtggggttgatgaggagctcattttggatatgttaggtttgacatgccttttaaacatctaagaggagatgtcatactcactgcacatgcatcttgaagtgtgggttggagatgtatatttggaaatccttggtatatagattttatttaaagccgtgagctcagctgagattaccaaggaagtaagatagayagaaacgtttatgctgagcccagggacaaatttgtgttagggagatgaggaagaaccagcaaggtaggtcaaccactgaggtgggaggaaaacygggtaagtgtgatattctggaagtcaagtgaagaaaatgcttcagttaaaatgaaaggatcaactatgttaatgctgttgataggtcaagtaagatgaggactatgagtttaccattgaatttagcaatatggaagtcactggggacattaataattatgtgtatgtggagcggggagcttgattggagcaggtttagaacgaatgggaggaaagaaatgagagagccagatagagaactctttaaaggagtttcagcctatatataagccgcagtcctctgcttatatgtttcttggctctgcacctgagtagtcttttctgagagtcatgtgagtaaccttttgttattactacgtatacatttttttgctaaatactattttgtcttaggcggtgaaatgttactgtaattggtcaggttaataacagactgacagtgcagttcctacacttgtgcactgaggaaatcatcagagcagtttcagcagcataaaataggtagagagtacaaaggaagacctagttttgaaaaactcttcaaagtgcttaaagttttgaaagtgtcagaggaaataggaacttcatagattctatggtgaggagccttcttgggccttggtcaacaccttaacctttctttacaaaaagttttcagtatagtgtattgaagaatgttttctgtatccacatatttcttgatttgtaatgaaacctcattaggaaattggaatatagttagatttgctgaaatgaatttgatggtttagatgaatgaatcctttattgtctagatagaaaattggttgcacccttaacttaaggcatggataacaaatacgcagtgtgtatatactttccacagccctctcctattgcttatgaaccatgtctactttccacagttgtctcctattacttatgaaccacattaactcttcatgctgaacccagatgtagcatcagaattcttgttagtaatgttccataaagccactaccaattagtcttacatgacatatgacataaaaccttttttgatccctggtgtaagaattcagttcacaagataaaaattatgcagaaaacaacacataaattggaaatgagcattgaattgcttattcacattactggagtttatcaataatagtaatggctaatgagaaaccttaatagaggtgacatagggacacagtgcttgtttctttgtcaaataattgaattgacagttcatttctattcttttcctttgtccaaagattctgctctctttgctgaactyggttatttcacagacactgatgagctgcaattggaagcagcaaatgagacgtatgtaagtatttactaaggttgaataatgtgatatttagtctttaaccctaattattgcaagaaagtttcaggacaacaggttcaggctagtaatttaagttacatacttaatggtaaatagcttctaccattaagtatgaaagytagtagccattttgtaatcagtaaatgtaggacagtagaaattgcattgtattgcaattctaggcccacctttggccctagggatgggtgactttggaaaagtcactaatctgcctacctggtttttacagatactttgctacataagggaattggcaggtgactttggaaaagtcactaacctgcctacttcttggtttttacagattctttgcttttaaaaaggaagttggtaagttctgcttgactaagttagtcctttttaaaagttgtgtattcatgtagaaagctctgaaaagtaggtgtatccttacctttgattggttagaggtctgtgtgaaaactattataacactgagtccccgagaatatcttagattttcttttcttgattagtacatataaaactctttgccctatagaactttgattttgtcttattctttaatggatgaggtgctgtttcacttaagaagtaattcaagtgagcagagtaatttgtcaatcaggttgaatatcacatcattttaggctcttattaacttgagtacaaaatatgtaaagattgcttagtgagtttcagacatttcttaaacaatgatttagcagttgtttttaccattaatcgacagaagagaatgaaggacatgatatattttaaaaaatcagtactagggattttaatggtttcatttactccatgagatactttagaatgtggcccattgattaaactgccttttaatattggctatttgaataagcaactgatactcatatttcataacatctagaatcctaaaagaaaatgtttcttttaaactatgtcaagaaactgtgtgctcaattggaaagattaagggaaatatattcctgattttacaactaacattctattattttatgcaaatcactcaatctttcagttccttagtttttctagtatgacatgaagggattgaatctctgagacccctcatgtcattcttcttccaaacggcaatagaatttcccatgctaaatcactgaagagttagagtatataagtgccagtatgtttcattttgcatgaactgggcctgttaaatttctgatgtgataaaatctttatgctgtagaaggtatttgacttatttggctgaagattgagtcagaagtttcctcaagtagatcatgcccttatttaaaagtgttgctggcactcaggcaagcaacattggtaactttacttagattaagaaagtttaaggattttttggttgctaaaacaaggctgcttaatttttttttttaagacagagtcgcactctgttgcccaggctggagtgcagtggtttgatctcggctcactgcaacctctgcctcccaggttcaagcgattctcatgtctcagcctcctgaatagctgggactacaggtgcatgctatcacgcctggctaatttttgtatttttagtagagacggggtttcactacattggccaggctagtctcaaactcctgagctcaagtggtccacccacctcggcctcccaaagtgctgggattacaggcatgarccaccacacctggctaaggctgcttaattttttgatgtgaagatccaaataagagaaaaaagtgaaggagattgattttttaaaaaatggtttttttatgatttaaatacttttttttcatgtgcactttcacatgttctctttatgtaccttgtactaatatttactcagttatgggcatcataagaaaatagtttcccttstgtgtttctgttacattctcaataaaaatgaaccatatagtagtcattttgaaatgataatattcttctagaaattgttaacaaatggtcgttaccaattactagatacatttttactttttttgcctgaggtgtatttttttatttttatttttattttttttttgagacggagtcttgctctgtcgcccaggctggagtgcagtggcgcaatctcggctcactgtaagctccacctcccgggttcacaccattctcctgcctcagcctcctgagtagctgggactccaggcacccgccaccacgcccggctaattttttgtatttttagtagagatggggtttcaccatgttagccaggatggtctcgatctcctgacctcgtgatccacctgcctcggcttcccaaagtgctgggattacaggcgtgagccactgcacccggccgaggtgtattttattgttgctgtttttgttgttgttgttgttttgttttgtttctttgacagggtctggctctgtctcccaggatggagtgcagtggcatgatcttggctcattgcagcctccatcttttggactcaagcgatcttcccaccccagcctccagaatagctgggaccgtaggtgcacgccactatgcccagctagtgtttgtattttttttcttaggtagagatgggttttgccatgttgcccaggctggtcttgaacccctgggctcaagcaatcctattgttgctgttttatcatttgtgacattaagttaatatttactgccttttgactttattgcattatttatgtattaagtttacttttctttttgtctctgtgactccagacacttaatttaaaatagtactgtttggtactaacttgatctcagacttacatgaggactctgaaattatgtgacacttctttattcatgtatatagtataaggtggttatctggatgacccagaatatgcttatattttggttagaaaaaccacctaaatgaaaagaacttaatgcaggctttaagaagtttgctggaccctgttttagaaaattagttttattttataggattaaaaagtggtgttttttttgattcataaaagttttagaaatttaagaagtatagaactgtagaaaaaaggaaaattactcagtgattcataaaagttttagaaatttaggaagtatagaacagtagaaaaaaaagaaaattactcagtggtaactatcctctttatgattcttgcctgtcttttggatatatctatattctttctattgtatatagagattatattatgaatagcatttactttgtcttgtttttcttaatggcaatgggaaaatgtattttgctggatttcccttaagataaaagacacatttttgactcctgtaatggtcattctcatagaaaataatgaagccaactaaatgttttaaatactgaatcccttacctctttcctagttgttgctgctgtgcttcaagtaactgaattgattttatctctaggctatccaagatgtattctcatacaagactgacttagagtattctttttactaggttggctaatagcagttaaattatttgtgccaaattgtgtctcacagtttgattttaagatgtgtatgttttattcttttaatattcttttgctgatttgaaacctacaggaaaacaattttgataatcttgattttgatttggatttgrtgccttgggagtcagacatttgggacatcaacaaccaaatctgtacaggtaattatgtgtttcactggtaaaagttttaaaaagatcaattttattttgtagtttggtcatactcaaaattaggtggggttattgggctattctggtaggttaaaagattcctggtgttatgcattctacttctggtatggcaattatgtaaacaaatttcttgccaaaaatggrtatgaggagtttcatagttatgtttcagtagtgtaatgaatgaacagttcatatcagaaatagaaatagtgattttgaattatgaataatgtctctgtataagattaacctgagaaccagacagggcttagggaatsaaagggaagagcctgggttaccagaacctargaacttggtggaggagtcccatgcatttaatacatgtacttctaagaaggggcagcacctggctgatactaatatctttaagggggcctgatgaggtcggggttgagtatactgaaagaagccagaacctggagcaaattgccagtgctgggatacagctgatggtagaatgaagaaaaatcccttctcctcccttctagctttttctagtatcccctattgacaggacctaaaaggatgccagctgggaataatttatatcaccgattatagaaagtggacttagtgctgagagacagtgaataaataaccagcacattctcctatctaaattcctctctacctctgcactacctattcctcttcattttatgtatttacttatactgtttcatgcctgtttgccttcatagaatgtgggatacacaaagtcagtgttctggttttatcgtttgacaaactaaatcttagttgcttaaagcaacaaccattttattagattgctagaatctatgggtcacgaattttgactgggtgcttacgaattttgaccgggtgctccaaggatggcttgtctctgctccatgatgtccagaccacaactggggagatttgaagattgtagtagcttgacatttgggggctagaatcatcttgaggtttcttcactcatatgtgtggcacctggggtggaatgacttgaagactaggactactaaatggagtgcctgcatagggcctctttgtgtggcgtggtgttctcagtcatggtggtctcagggtagtcagacttcaaaggctccaagtatgagtgttccagcacacaaagcagaggctgcatttccagcttcagaattcacatagcattacttctatcttctcttgattgaaggagtcaagcccacctaaattcttggggaggggaaatcgactctacttcttggtgggaaagtggcaagatcacattgtagaagatcatgagggaagatcatgaaggatggtagatatcgtatggctaattttggaaaacacagtctgccatccccaccctattctatctttgacaccaagggatactgcctgggccatagttgctcagtacatttttataggataaattaatagtttaaaagatatgaacattttttatgagtttgaattgtattgtcaaaaatgctttccaaaatatttcctgtttcttatttttttaaattttttgggaagctataatattttgcatatggtaaaatattcaaaaggtacaaaaatctgtatagtagaaaaatgtctcctgcttttattcctcagccaacaagttctattttccagagacaaccactgttaccagtttcttctgtttacccttccagagaattagtgcagatgcaagtgtacacatatatatacacacacacacagacatacatatataccccctccccacatatatatataatttgtaacacaagtggaaacatactagatatattgttttctgcatctttcattttcactcgttatattttgrtgaccttagcttccatatctgattgaattttaaaagtagattttaccttctttcttgttcattttattataagtttttattgtccagtgggtaaaacctttcctccatgttttccagttaaagatattaaggcagaaccycagccactttctccagcctcctcaagttattcagtctcrtctcctcggtcagtggactcttattcttcaactcagcatgttcctgtgagtagccagtcttttacaatgattttgsttataatatgctatctggaaaatatgtatatggaggaggcagttaacatttattgaatactactatgagttatattgtctcatttawtgagggaactgagactcaagaaagagccttgtgggagctagaaagttgttagtgcctttggttttgctctcttttcccctctgttcatgcctccataatttcattgtttcatttgtttcattgcattttaacagtatccagtatttgtttattggcttactgtcctttctcccaccctttctttctcctccctattaggatatacattctttatatatggacatagaagaatgtaagatggtcagtttttatatctctttagtcacagcatctagaatgattgccttagtttgggaatgcctagtgctaccttttgaaggggctcacgtttttatagaagtctggtagctcttttaagaacacttctgctctgtgtccagacaaaagccctgaggccaggaaaaggaagtacctgatttaggtactttttagaatggggaaagggaaagtataagaataaaaaaatcaaataatattttagtatattatatgtgctataaattgtggtatctttgttcctgcaggctctacatttagttactaaatcctggtggttatatgcacatattaattcaaggatttatcttttctgcccctgccaggccatcactatctcacctggattaagtcaataggattttaactggtcagccttacaactcctcaaacctttcttagcagtggaatcttcaaagagaaatctttcagtgtcacaagctttactgtatcagtcatttgcttaaaactttttagtaacttcccagtccttacaaggatgaaatttaaattcccagagtactaggctttccatgatctggcccccatttacytttccagtctcttttcttgctatcccctcctacttccacattccccttaatttgagccctgtgagagttcctctctgagagctcctatgcactctactcattcaaccgctgtgccaggcactgttccagatgctggcagtgaacaacagcagtgagattgctgctgttacagttctaggtttttgcacatcctctttcttctgcctagaatagccccatttttttcttgtcttggaaaactcatccttcaagtcccagttcaaaaactacttcctttatgaagcttttctctgattgctgctattggtagctctctgaggtcccacaatttctccaaatgatttaattttttaaaaaattaataattacaaaaggtagcatactgtataccctgtcctgtaccttgtttttttagcttagcaggataactcttaatttcagagtatataattttcccattatgctacataatgtttcattgcatggccttatcatgcttaatttagtgatttccttattgatgagtatttgtgttgtttttagtcttttccagacccaattaacctgtacataagtcttttccagactcaaataacctatagtaaataacctggtacataagtcactttatatttttaccaggatatttttgggatatatttcaagaggtgggattgttgacaccaaggtaaatacacttgaattttgctagatactgccaaatttctctctataggggttgtaaaattttacatcctcatcagcagtatgtaagagggcctgttttcccatcatcactccacaataggttttgttttatatctcttttattataagtatggttaaataatatctattcatatgttttatatgtttaaggcctatttgcatttctttttaaaaaatgaactgtcatttcaaatttttgttctttttttttttttggagatgaactctctctcttgtctaccaggctggggtgcaatggcatgatctcggctcactgcaacctccgcctcctggcttcaagcaattctcctgcctcctcagcctcccgagtacctgggattacaggcacctgccaccacacccggctaatttttgtatttttagtagagacagggtttcaccatgttggccaggctggtctcgaacttctgacctcaggttatccacctgcctcggccccccaaagtgcttgggattacaggtgtgagacactgcgcccggccgttcattttttaattgaattgtattggtctttttctctttaatattttaggtgctttattatatattaggattattagtccttagtttgtgaaataagctgcaaatattttttccccaatttttcttttgtctctttgctttatttctggtgtttatttttccccaggtgtactgttttctatagccaaattattgatcttttctttaattgcttttttgttcactcaaaggaaggttttcaccactgagaggttataaaataattcactcatatttttactctttttttttgcttatgttaattttttgtttggaacaatctcaaattcacagaagtgttgtgagtacgttgcaaataacttgttttttccttatgcatttcagagtaagttaccagtccgatgcccctatcactccaatactttagtgtctacttcctacaagcacagatatttcttagccataatacaagcacaaaatcgggaaataaacattaatatgttactataatctaaccttcagctctcgtttaaattgtgccagacatcccagaggtgtcctttagactatcaaaaggacccagttcagaatcaagcattgcatgtggttatcttgtctttttaatcttgttcagtatgaaacagttcttcattaatccttgactttcttcaccttgtcacttttggggattaggagttagttattttgaagagcatttcttagtcgggtttgtctgatgtttctttaggatcatattcaggttttatatctgtggcaggaatgtcacagaagtgctgtctgtgtccaacttttgatgacccaattttgattttttctaatactgattattttcactttgatcccttcatagatgttatctgccaacctattccattgtgaagttgctttttctctctatgccatacatattttgtgagaaagatactttaagactatgtwaaaatatcctgttcatcatcacactttatatttgttcacttatttgttaatatctgtatggattcatcgtttcttattttattcaacagattataatccgttactataattatttattctgattcttacattgttctggatttggccagtgggggtcccttcacaccagctcttatgttcttttaacatgtctcctttgggctctgatgtccttacactaggctgtcttcccatgcggatgccctcctcactctgctgtgactcctcatgccaggccgcctgccatatcagtgccctctctacccttcttggaccctgacattccaccaggctacttctctgcgtggatggtggtcttgctttaccccatctagtggcttaggataaaattattcaggaaggaatattttctaagtgactatgaataagtatttatcatgagatattatttttagtgtttagatctcggatccatttgaaattacccttgtgtattatatgagatacaaatccaattttatgtttttccaaatgactatcaaaatgattattctagtaccatttatcaaaaagttcatctgatttcaattatatgcatgtattttaaatttatgtaaatggcattatagtagatatctttatattatttacttttaaaaatcagcacagtgtttttaagataaattcctattgctctgtgtacatcaaatctgttgcatctaactctgtacaacattcaagtatgcattcactacatttttacctacaccataatgaatattttaaaaaatgttcccttgcggacccatgtgagaaatcctttagaatatatgcctagaattgctgggtagtagaatgtgcaggtatttaatttgacaagtgcttccatatttctctccaggatcatcatagtactctgtgggctggcagcagtgcctgaggatccctgtgacttctctcctgatacttggcattgtctgcctttttaatttttactccatggcacaatgtgtttttttgttgtttgcttttattttgttttactttgtatttctttggttattgttttcaacatttatttacattcttatgagctttttggactttttttcttttatacattgtttattcctgtcctttgccagtttttctactcagttgttgtcttcttgtttatcagcaggaattcctcatatacttgaaatagtaaaactcttgttggatttagacattcaaattgcctatatcttttccctttctattatctattaactttgtagtctttattaagtataaatagttaattttcaattactcaggcttatctttttttttcttttcctttatggcttatttaagaagtccttctatgcttttagagcacagaggtattctgcattttcttttattaaccatatggtttacctttcacatttaggtttcttaatactcttagacaccactttaatatgtggtattatgtagggatctagcactaggtagggatctaattttaattttctctataaaatgaatcagttttcctaactgtattgtctttataatcacttgtaatcactcttttcaacaatattgtatatctctctgtttactgaaatcttttatgccttagttcagttgtgtagttttcttcatatgggtcctgcacattccttagaaaatttctaggtattttgtaattgttattgctattgtgagtgaaatatttatttatttgttttatttaaatcttttttatttttaactttttttgggtacatggtaggcatatatatttgtggggtacatgagatgttttgacacaggcatgcaatgtaaaataattagatcatggaaaatggggtatccatcccctcaagcatttatcctttgtgttataaacaatccagttacatactttttgttattttaaaatgtacaactaagctcttattgagtatagtcaccctgctgtgctattaaataatatgtcttattccttctccttttttttttttttttttttttttttacccattaacaatccccatctcactaccagcttctcagtaccctccccagcctctggtaaccatccttctaccctatgttcatgatttcaattgttttggttttttgatcccacaaataagtgagaacatgtgatgtttgtctttctgtgcctggcttgaaatatttattttttattatgttttctaagtgtatattaatacaatattttcaagtcaaatttttttttcagtggattgttacatgtgcttcaagtatatagcatattaccttgctaaaaggcacgctgtctcttttgttttaatgttttttaaatttcttcttttagtgtaattatactagaattacagaaaaagcaggtatctattttttatcctgactttaattgtaatgcaytcagcattggacttggctgtataattactgatagctttttaatgttaagaaagtattcctcggatccttgttttctaggattttattgaggaatacttgtcgaatattatcaaataccttttaagcatcaaaggccgtgaagataatagtctcctcccgtgttaccttgtactctttggtttcttggaaatgtattttaatacactctacatattgctcagcttacatgctgagtaggtgttaaggatgaaggaagatgcaattgtcacttgtcactctcaccagtgagactgagagcatttctttctcccatatcctctcaaggtcatttaaatttttttttatgataaaaaaagtttaaatttgcctttgactaccatttgcgtttccttttcagtgaaatggctgttcctgccttttgtctatttttcgcaaatattttctaccaatatatatcttttaactttgtttatggtctagtttttattgttaaatagtttacttattatttgttcaaatctatttcttcttcctttgtggcttctgtgtgttctgacttaagagggtctgcaacaccctgagagtaaacaagtattctcttaaattttatttttatattataatcttatagattattttgaagatgttatgaagtagagattatgtctattgcgtgatcatgcatgccatcttttctgtctgaattgaattgctacttctatgttgtttctttattctaacaaaatgagatagattcactgaatattaaaagactttgggaaaatgcgaatgttatctttatgtatctcaatcattatgaattcacctactaaattaaagaaaatagcactgttggctgggtggggtggttcacgcctgtaatcccagcacgttgggaggctgaggtgggtggaccatatgaggtcaggagttttagagcagcccagccaacatggtgaaaccccctctctaccagaaatacaaaaacttagcaaggcgtggtggcacacatctgtggttgtagctactcgggaggctaaggcaggagaattgcttgaactggggaggcagaggttgcagtgagctgagattgcgtcactgcactccagcttgggcaacagagtgagactctgtctcaacaacaacaacaacaacaacaacaacaacaacaacaaagcactgctccattcatgcatctttcttttacaacatttggaacaaaggcagtattacaaaatagaaaacagaaaagaatacaaataaaattattttgcttttgatattcttttaagaccaaataagagagattatggagaaaggatattggcattttaactgcaaccttatactgatactgaatgtttgtatgactacgaaccaagttttatatgtgtgtgtgtgtgtgtgtgtctctgtgtgtgtgtgtgtgtctctgtgtgtgtgtgtgtgtgtgtgtgtgtagtttgtaggaagaaatgtagcaacagatcaatgattcatatctttaacaggatggcatagacttactctgcattttgagttatttttcctttggtatagatggatcatgctgatagtcacttattacttaatatatakatacagtttctaatatacctttcctttgaagttaccytgaagtgtttttctgtttatatgtgggtctcctccttttctatgcaatttgctgcttaaggattatactcattaatttttgtttttattatgctacaggaggagttggatttgtcttctagttctcagatgtctcccctttccttatatggtgaaaactctaatagtctctcttcascggagccactgaaggaagataagcctgtcactggtyctaggaacaagactggtattactctatctcctaacttctgttatttctatttcagattgagcttaggttccatttcttaaaagaaaatgctggattaaatttatgtttattaggctggcttgctgttttttaattggtggacctatattgtttgttgtgagtgattaccgtggagaggaaaggggagaaataatctttggttgtctctgtctttacaggtgaaagatactttaaaatagactcagaccccaccatcttcaggagagatttcaaagtttcagttaaagataactgaatggagctatgacatttgttacctcattaatctctgggtgttatcccgtgattttagcaattctcctttaccagttagtgtgtcccattcccaaaactgcagcttggttagaaaaggaggtaacagtttaagtacttttcttcagttcattcaggtatatgtactgtagctatgcttaaactccagttaaagattgttaatcgaagttaagataatgtgtagagaaaggtgtgtgatagaatctgttttttagggcttgcgtaattgctttcacattgacttgtggtttgtctggtttttctccagaaaatggactgactccaaagaaaaaaattcaggtgaattcaaaaccttcaattcagcccaagcctttattgcttccagcagcacccaagactcaaacaaactccagtgttccagcaaaaaccatcattattcagacagtaccaacgcttatgccattggcaaagcagcaaccaattatcagtttacaacctgcacccactaaaggtacctgagcagaatttaaggctgtgtaaatttatttggagggcagtaagggttgtgtcatatgatttgttttaattcaggttataatttctgagcacgtgctgtttgtcaggaatgtctttggttatgaggacgttgcagagatgactaatgtgtggttcctgtcataacaagggatatagctctccagaccagttacatctgatggttattttgaaaatctgggacactttcttggtgccattttattctggtggataaaatacaggaacacaaattttaagctagttgaaggcagagttcaggtcagccagatttttgtggctgtgaactttttttgttttgaaggaatatttaaaataatagggtccatttcaggtgtgttatagcaatagaatcacacccttaatctctgaggaggctgcatggtttagtaaacagtatattgacctggtcatgaggagacctgaactctgctttcaactagctaagaatttgtgtgtttcrtattttatccaccagatggcctcatacacttgtgattctatgagaggtttatgtcattattgaaagaagttcaagtctgaggatttggtactattcagatatgggagtcatttccgtatggagatctcttaggtagattagtcatcattgtactcatactgatatctgtatacactgggtacaagaaaacttttgcagcattcttatctctggatttagtttgttggcaccagatatgactaggcgataatggggtatgggttgtaaataaacaccaatgttacatttgtactgtatctccaattgtgaataggtagctcgttttttggagcatagttttaatgagggtaaatttgataaatttaatttccagatactcttttagctttgttctattacatggtcatagacaatatgacattgataaaaagaagacctagatgagagaatggatgaatcagtgaaaattcatccatcagtcccaccaaaaataaacagacaaacaaacaaacaaaaaccagtttgaaatgcctgctctctcagtacaaagtcagaactgctgccttttccatctgaaaagtagcattcctatagaataggtattcttgtgatttataaatgtgtattaagggttcatgaactccttgaaacaaaatgcaggatttaatgtatgttcatatgtggattattctagggatagtctccaaaactttcattaggatctcataaggatctgtgccttcccaaaggctaagaatttaaactaatgaagaacctcattgtagttcccataagctattaaaatacgtctatacaaaaagtctgacattaatatgactagcgtataaagcaggggtattcctaagaatttgcccttagcagatcattgactatgtttgagtgatggaagatcttacctataataagaagacaaactgttcttttctgagcagtttatcagttccagaaacctgaattacacattatttgaaacttcaatactttcctgtcatctgaagactatagttatttttttgtgagcatgtgctaatatgaggaactgcaccttgcctgttttttttcttttatttgagacagagtctcrctgtgttgccaggctggagtgcagtggtgtgatcttggctcactgcaacttccacctcctgggttcaagtgattctcctgcttcagcctccagagtagctgggactacaggcacgtgccaccatgcccagctaatttttatatttttagtagagacagggtttcaccatgtcggccaggatggtcttgatctcttgacctcgtratcgcctgcctcggcctcccaaagtgctgggattacaggtgtgagccaccgcgcctggtgccttgtctgtttttatagtacaatctaaataggtggtattattataataacatacagatttaaagtatgtttttcatttatttgagaatggggaggaagaagggaagtatgggcaagacattatacagttaatcatgttaatactagtagtaaatatgttaccattgaaaaagaagaggtaatttccacaggtttaagactgagattctctagcttggaatgtaaaactcttcacaatttggctctagtttagttttttgtttttttgttattgttgtttgtttgtttttaatagagacaggatctcactatattgctcagtctggtctcgaattcttgggctcaagggatctacccaccttgatctcccaaagctctgggattaaggcgtgagccaccatgcctggcctcctagtttagttttcgaactttataatattactcttttctataaatcccttcttctagctcaactaatctgtcattgtcctttgaattctcttgtttttcctagttttttggctcaccattttctaccaaccagcaacaacttatgcctacttctacttctcagtcctccatgtcctttaagactgttttgagtagtgtagatgagagataatgaaagcctggaatatcaatgaaagtggagaaccaggatgaagagtagagatgttaaaagtgtagaatcttagagattggtaattggattgtgtagaaggaggctgaacgatagagaggaaggtgtctaggatgacttccgtttttctatcttggggctttttgggtagatgatggcraaaattattgaaatgggagacagaggtaaaatatgttgcccagatcactctgctaataagaagtggagccagaacttgagcccaggtggtctggctcggagtctatgtgaataatcactatactgtatcgccttaaaaaaaaaatgacagatgtattccttgctctcaagaattctacactttaattgggggattaaattcacataaacagttaaataacagtcactgtgataactaataaattaataactcatgcagtgcccttatggaagctattattatatagaaaaggagattaataataataataattgcatttaagttcttactatgtgccagacactcttctaagtgcttaagtgcattatcttatttcaaataatatttacacattatttgaaacttcagtatgtttctatgatttatggtgatgggttgtgatatctccattttttagatgagaacgctaagtacagattatttgccctaagtcacacaccgatgctgtttcagacaaagtaggcattcaataaatgtttgatacatagtttaaaatctttgaagaaagtttaaaagaaagaactatcaaaatcagtgagttacacatagtcaaaaaaatatatggcattgaatccagccatgttccgttaagggggatttgcatgtaatgccagagaggattttgagcatgctaaaatggataaacagcctttggaatgtcctttttaactgtttccacactaggaacagtagtaactatgttcagctgctatttaaggccccaaacaattctttgcattgtagtttgtggcctggtcagcatttaccaagtcaccatgagagttttttgttctttcacttgaacatattgtcatagaaatttagttgtttcccctcattctgtgttgaacccaaacatgcctagaatatttagagtatccctgatttagctgctgggtaatttgaggatagttgggtactctgggatgaaaaggcttgatacaatatgggaaaaaaaggaagcagcagtggcttggtagractcaagccacatttggccttgccttggtattcttccatctcctttgtgtgatgcggtcgtctcagcaaggagacagtggtaattacacaattggtagtacagatttggattatttttcttaattagtttaagaaatattacaaagccctctgtacatgttatctgctagggctttaaatctgtaactgtagctagaaataggattctttcttataagttgcctaattcattatatttacacctcttctgttctttaaaatagtcccaaagttccctgaacagtgtttaattttggggagggatcttttaatcataattttaaactcagaggatgtagaacatggcttcctataatactcttctcaaagtattggtttaagtcagtggttctcagtctgtatattgtggaccctgggatgtgggtgatgggggtagtagctttatggcattttgcaaagcatctgcaaatccatacttgaagcaagcattttctgtagaccaaataatttatttcatatatctttgtacagctcttcaaatttttatagctatacttctgactaataaactccaagttcattttaaatcttcactaaattcttagcagcctttttccatcatgtattttctcagtacacagaagctgaaaggacaaccttgatggttttgggtgaccaggatattattttatattaaaagagagcccttatattcaggagcctttggggagagactatgggttttctaggtgtagaattatatcatctgtgtgagagatggtttgacttcctctcttcatatttggatgccttttatttctttcttttgcctgattgctctggctatgacttgagcacttgggaattcttgttttttggttttttttttcacattatgataaatatatattttcatagtgccagatttactgtaatttcttattgttattaaaacctaacacttggtcatatgctatttactttatgtgtttctaatttttatttgcgtatttggcctaagcatrtttatatctgcttctgagtaatttctgcattttatatgtttttacttcataaaagatggaggccacctcaaaacaaattaggcatcaaaggaacatacctcaaaataataagaaccatctatagcaagtccacagccaacattgtaatgagtgggcaagagctggaagtacattccctttgagaaccagaacaagacaaggatgtccctctcaccactcatattcaacatagtgctggaagttgtagccatagcagtcaggcaagagaaagaaataaaaggcatccaaataggaagagaggaagtcaaactacctctcttcacagacgatatgattctatacctggaaaacccatagtctcagcccaagactcctagatctgataaacaacttcagcaaagttttaggatacaaaatcaatgtacaaaagtcagcagcatttctataccccagtaatgtccaagctgagagccaaatcaagaatgcagtctcattcacgatagccaaaaaaagaatataaagtacctgggaatacagcaagctggggaggtgaaagatctctacaatgagttacaaaacactgctgaaagaaatcagagatcacacaaacaaatggaaaaacattccatgctcatggataggaagaatcgatagtgttaaaatggccatactgctcaaagcaatttacagatttaatgctattcctatcaaactatcaatgacatttttcacacaattaggaaaaactattctaaagttcacatggaactgaaaaagagcctaaatagccaaagcasccctaagcaaaaagaacaaagccagaggcatcaagctacctgatttcaaactgtactacaagactacagtaaccaaaacagcatgatactggtataaaaacaggcacatagaccgatggattagattagagaacccagaaataaagctgcacccctgcaaccatctggtctttaacaaaaacaaacagtggggaaaggactgcctattcaataaatggtggtaagataactggctagccatatgcagaagattgaaactggatcctttcctttcagtgtatacaaaacccaactcaagatggatgaaagacttaaatgtacaggctcaaattataaaaaccctagaagaaaacctaggaaatatggttctggacataggccttgtcaaagatttcatgatgaagactccaaaagcaatcgcaacaaaaacaaaaattgacaaatgggatctaattaaactaaagaggctgggcgtggtggttcacacctgtaatcccagcactttgggaggctgaggggtgcatcacttgagatcaggaattcaagaccaacctggccaatatggtgaaaccccatctctactaaaaatacataaattagccaggcatggtggtacatgcttgtaatcccagttacttgggaggctgaggcaggagaattgcttgaacccaggaggcggcaggtgcagtgagctgagattgtgccactgcactccagcctgggtgacagagctcaaaaatcaataaataaaaatcaactaaagagcttctgcacagcaaaagaaactatcaacagaggaataggacagcctacagaatgggagagaatatttgcaaacagtgtatccaacaaaggtctaatctccagaatctacaagaaacttaacaagcaaaaaacaaccccattaagaagtgggcaaaggatatgaacagacactttcaaaagaagacatagacatggccaataagcatatgaaaaaatgctcaacatcactaatcattagagaaatgtaaatcaaaacaacagtgagataccatctcacatcagtcagaatggctactatcaaaaagttgaaaaatatccgatgctggcaagattgcagagaaaagtgaatgcatatacattgctggtgggaatgtaaattggttcagccactgaacgtagtttgtagatttctcaaataacttaaagtagaactaccatttgacccagcagtcccattactgggtatatacccaagggaatataaagacacacgcacacatatgttcatcacagarctattcacaatagcaaagacatggaatcaacctagatgcccatcagtggtgaactggataaagaaaatgtggtacatatacaccattcaatactacacagccataaaaaagaatgaaatcatgttctttgcagcaacatggatggagctgaaggccattatcctaagataattaatgcaggaacagaaaaccaaatactkcatgttctgtcttataagtgggagttatacattgagtacacatagacataaaaaggggacaatagacaacaggggctacttttgagggtggaggatgcaaggagggtgagaatctaaaaattacctgttgggtactgtgctcattacctgagtgatgaaataatctgtatgccaaacacctgtgacatgcaatttatccatgtaacaaacctgcctgtstaccccctgaacctaaaataaaagttgggggaaagaaaaactgaatccaagggaaaacgagaaggtaaaaatgtttaatgatcatttatgccgaagtattaatacattgtatctactccaaatccatgaaattatttttagatcttcttatctgggataaaatgctgtttattgaaattctgctactttcagtgtgttttttgaggccatctgaaacaagggctttgcttttataagttatcttttttagccaagacagatgttcttgacaaacaggtgttctgaagctttattttgatttttagttttccccgatcctttgaaatattgagctgagttttacatgggtcaacctgtctgaaagcataatgctttttttttcttaaacaaattataaatttacatgatattttagttgccagttattttagtaccttcattttgttagataggctcaagcagctgtggatgttaggcaaggctttcagcaccttataaaaatctgccagatctgaaaggaaacacttagcaggcaagtaaaatttttaatagattagtgttatgagttgtataagtctttaggttaatggtacaggtttagtaccccttaaatgaaatgcttggaaccagaagtgtttcagattttgggtacttttggattttagaatatttgcatatacataatgagatatcttggggacagaacccaagtctaacatgaaattcatttatgtttcatgtatatctcatacacatagcctgaaggtaattttatataatattttaaataattctctgcatgaaaccaagtttgcatacagtgaaccatcagaaagcacagttgtcactatctcctgtggacaatctgtagttgtttggcaccaccatcattcctggctctgaattcatatgctactgacaagcaatcattttcttacacttattcacaaattcacacctaagaacttaacaaaaattatgacataccattaatacagtgaaaaaataatgtgtgcagagtaacaaggcaggacagtagaatcaccagaataccagtgtcagctactacacaacagcaacaacaaaaaatggcagctttcagtctctgcctttgatgctgttttcattaaaagcctactgtaccctctattttatgtcttcaggtgagaagaaacatcagaagcagttgagagactggaagtgggtcctctagggatgaggaggcattctgctggatgacttctaaaaatgttttctatggagtcatctgcctcattaacaagtttttgtyttagaagtctctttttgattttgtaaactgacatgatttctttttctgttatgactgtatgctgctttagtccttcactaggcccatcacacatttttaccatgtcatctataggcactttttctgcagcgttaacagcatcatcttcattgtcattattatagattgagtatcccttatccaaaatacttaggaccagaagtgtggagttttccacttgtgaagttgtgtcagcactcaaaaagttttggattttggagcattttggattttgggtttttggattaaggatgttcaacctctaataattctcgtcagattagcataaatttaaaataatgatacctctgaatactcagaaaagaattgaaggccatttttgggggaagagggaaagggctggtatcatctacagactattttgaatcacagatttatgtttaccgtgattgttagctaagatttaatctcaaatggttttaagttttttggtatttgtagtcttttttttttttttttttttttygtcctttttagggatctgcctgcctcagcctcctgagtagctaagactcgaggcacataccaccatacctggctaatttttaaatttttttttgtagagacaggctatcactrtgttgccttggctggtctcaaactgctggcctcccaaagcactgggattacaggtgtaagccacagtgcatggcctgtagctccttcttcttctaatattgagttactaagtttatgttcagatatttttggtattgtatgcatttgtaaatcctattaatttagaatacatgactctccatattcagtgtaaaagatttgttatttataataagacaaatccttttagcrctaataaatttcagaggttaattcttagaaatctagggattacagcaaatttgatagctgtttagttgagaaagataaataagaaagtatattaaagtatattgttaatgataactcaaagagatgaatttagttggtcacattaaaaacataacaaagtcaccataagcgtgtgctgctattgatccaatgttttaattgatggtgtccaatcccttggtgttgatcttacccattacgtctgcagaaaagacctaattataagctgcttcccctgccacagtagttgtgtaccctttgattccttttcttttttctaacgcaggccagacggttttgctgtctcagcctactgtggtacaacttcaagcacctggagttctgccctctgctcagccagtccttgctgttgctgggggagtcacacagctccctaatcacgtggtgaatgtggtaccagccccttcagcgaatagcccagtgaatggaaaactttccgtgactaaacctgtcctacaaagtaccatgagaaatgtcggttcagatgtaagttttgaaacttagtgcttctcttaatgcctgatttaaaaaccaacaaaaaaacaccttttgcttttgttgccttgtttttgttttttttagagtttcttatattgcatcaaataaaagagtgtgctgaattgcacatctagtctttggaggaaaattagggtaaggcttactacgttagaatctaagtgaaaaggtttttgaaagtgaagtggtttgatgaaaagcaaagtatgcatacctccctcttctttactccttctttagaaccaaccctcttattattctcttcaagcccttacaccctcaacccagtcatccactaatattttacagattcaacgtttcctgattgaaatgttttagcgatcttcagataagagtctatagattactttttaggtaggttttatatttagctttcttccttgccgttttgaagtattttcaccacttcataatgatgactagctactcttaggaattctgtctcttagtgattatttggtactttcccatttttgcaaacctttaaattttctagcatgttgtagggatttcttataatttataaatcacatagtttcctaagacctgtcactctctaaagccagttactgcacttgccaactaactcttgctttctttcaaaatgattggaaataacttatgtattaaattgaacatcttggtcctaaaatttaatgaatgttaaagctatatagtcaaacagtggattctctaaagttacgattgggaaagcaaagtgtgtatgttttctttaaaataaaaatggatactactagttgttaatattactacttcatcctttctttaggtagaatgcatttgaaaagtaattttaaaatcctgtgggttatgcaaggttgtttatcagactactgtctgatctgtctgccagaatttattaaccagcatgtcagtgacccatttaattataaaattgctccacagttgcataaacagtaatctcagccagcaatattgtaaaaattcataacaaaggaatattgtctggtgaaagtagaacatccagtttctagaataagagtcccatcgtttgtataggtattgaaaacaatgcatgtcaagacatggaataggaaaattagtgttgctatgagactagagaccatggacagtacaggattaggcttgactgttatgttggtttgttttgaggactagaagaggtaagcacaatgcttatggcataataggctctaatacatagcgtgtgtttcagttgaagatgaaacaatgttgctgggatgggaaggtggtgagcacaggatagaggcaactggattggcaaaatgttgataatgatggaagctgggtgtttatttttctatccttttggtgcatggaaaaatttctacaatatgttaaaaaaatgacaataacaaaaatccaaaagctttctgtgatattttcaattaaaaagttgtgtgaccaataagaaaagagtatgattttcatgggagaccaaccaggttaagaatgatgaaaaaggatttttaaaaataatgctttgaaatttctttttttttgttttattatactttaagttttaggatacatgtgcacaatgtgcaggttagttacatatgtatacatgtgacatgctggtgcgctgcacccactaactcgtcatctagcattaggtatgtctcccagtgctatccctcccccctccccccaccccacaacagtccccagagtgtgatgttccccttcctgtgtccatgtgttctcattgttcaattcccacctatgagtgagaatatgcagtgtttggttttttgttcttgcgatagtttactgagaatgatgatttccttttaatactcttttaaattatgaacttgaatgtttcttatataatacccccaaatgaaacttataatagaaaatatccaaagttgcctttatgtaatatgttaggacatttaaaatatttttatgaaatattttagacatgaaaaaaagataaagactaattagaactttaaaaatacataggtcaacagtatatcactgttgttaaaaaatattaacaatattaatctaagtcatcccaaacatggaaaagtccagaaaagcatagctaggatggggagagtatctagaaaccatggggtagaggagtgggttaaaggttggaatgattcagtaaactgaagaagagaggatggaaagtagacctgggagccatcttccaggaaaggaaggttgttatgtggaaaatagaattgttctgcttgttccagaagagttatctggaacaggtgcaggaaaaatatagaaaggtttcttctaaacataaggttttttgatacaatcattgtatttaaaaaccagaagagcaacccccctgcctttttttttttctacttttaggcttactatctgaataatgagcatcttaatgttgacaatcatcactgtatgccattgacccattttataatctctaaacatattccaattaattatatgttggtctattagtcagacatcctttattagttctctggtgtgaaagactgtgtctgttcagcttttgtactcttaagggggatctgtaaatttaaagtatttttaatgaaatattttagacatgaaaaaagataaagactaattagaagttaaaaaatatataggtcaagagtatgtcactgctaaaaatatgagaaaatgtagaaccaataaatactgctagaaacaaaagctaatacttattggttctatgttttctcatctcacacatcccccagttcttcaacgttaattgagactttgtcagcaaagtctcaatgtatgaatgtctacatttattgtatgaatgtatattcagatgaggttaatttttttaacaatgatataccgttgacctacatatttttaaagttctaattagtctttatcttttttcatgtctaaaatatttcattaaaaatactttaaatttacagagcccccttaagagtacaaaagccaaacagacacagtctttttgaagtttagaattgacaggattataaagaaagattcaaacactttatgtttaatgcaaagagacctaaggacaattagaataattttctagtcaacctgcattgaggtttttgtgcttatttttacttggccagcacatcgagacgtgagccaagcctttcaatatgagtttttttggtagaaattttgactgaatgtttatttcaagtaaagaagcattagtctgtcctagcagcaggccaacccactcaggaacccaaagtaaatctgttccagaaggagttgcagagaagaactttgatcagcttgtatagccttctgtgttagtaacttggttgacctcagtattacatgtgtctgttaaaacacaagtcctattaaattaggataaattaatataaattcctaatttaaaatgatcaaaaaaatattttttatcatataccttttgtgcctttaaaccaaaagtrtggtgaaagaattgtaatccaccaaaaaaaaaaaaatcatatcagtttttttgtggctttgtaatgctgacatggcttctttttctaccttttttagttcttttgtttggctggtttcactctccagaggcctgctacagccataagtagcgtttttagcataccatattctgcaaactgcattaaatgccacattttctgttatgaaacagtttgcctggttcaaattatatcttactcttcctgtcttttgctggtaaatctgttttgtttaactcttggagacctcacctaagttttcaagaaatatggtttgtttttggctgtgatcctgatggaaaaaatgaacatgatctctcatttcagtgtagaagttctctgtgcagtttcttagtaaatggcaatcttggaactacaaagttgactttataggacagcatgcttatctttctttaaagggctatttagtgttgccacacatcaaaccaagggcttaaaaacaagcagtctgtttaaatctgcattacactcactacttccacctacccatcataatcgcataaactttatgaaacattactgcccttgttttaaggttataggaattacattgttttagttattggaacaaaagaccagaaaaacaagtggtaaaattctacatcttccacagtgggccacattggagcaaatactcttagtggaaatcagtaggtgggaataatggaaagaaaagtatccagaactgatatagaactataaataacctcagatgtgaggttgatgaagggatacaaactactgttaggagtctccttccttccggctcagtcaccccactgaatatcttccaaactctgtatcaccttttaccctgtttctaaatcctatagttaggaaacttgatcccttccatcccaaaatgacttccctttgggagtccctgtcttgggttcctagagtcatcatgagaaggtaggtgctggggggaatcctttgctactggtttgcaggtattagaaatggtgcgaaggggattctcctgtcataccaaattagaactttgtatttcctttctctagaattggtgtacagttaatttagggatttcaggtatttttagtattgttctatgggagtgatgtgacatgggcctagatggatgccctgcacacagtgttcctctcttgcagtggaggaacatgagcttggagaatctaccatgtgtatagcaagcagaaagcaagcctcctcattgtctagagggagattttatctcatccttcaaggttgcttgttggaaactgaaccttgagaatggcctgggaaaagagtggtccggaccttgcattctttgcatacccaataagacgtgtaggagcaaaactcataagagactccctggaggtgtgtttctcaagaaaaatatgtctataataatctatttgcaatgcatagcaactcagaaaaacagagactgcctatgttctatttcagaaaaaaagcaaaacttcaatagacgttgaagttgcttatctgtaacatccaagaataggacgctggttaggtcaaaatgtgagctgaatctccttaaattatgtggctagcttagatctcagaagataaataatgaataggcacttcttaataacttctaacaacaaacaagttgagatcatgatatttctttaggctgcaaagtagaggaatctatcagaacaaatccaataggaaggatttggagagctggagttatccagggtttagtaaaaaaattacttctgtgctgactgcattgtggctttgctgctaccagggactctgcaaataaaagaaaatatgctttgtttaaatatttgcagtatctctttaaatgtaggtttggagcttctaaaaatttatcttgaatagcagttcagtttcatttgaggttacagtagctttggaaggggaagtgaacagcttttttttgttgttgtttatttttccttcctgatgcattgcattaggataaatttatgttgtggcaacctcagcattctttattctgtactttttgtactttttagtttgtcatcttttttttttttttttttttttttttttttttgagacaaagtcttgctctgttgcccaggctggagtacaatggcacgctcttggctcactgcaacctccaccttccaggttcaagcgattctcctgcctcagcctcctgagtagctgggactacagctatgtgccaccacacccagctaatttttgtatttttagtagagatggggtttcaccagtttggccaggctgttctcaaactcctggcctcaagtgatccacctgcctcggcctcccaaagtgctgggattataggcatgagccactgcgcccagcagtttggcatctttataagaataataaataattatttttaaggattctgatttttatcttaataaacaatgaaatacttctctctcctttctctaatttcccttctcaaaaccttgtggggactcattctagggagacagtccttttataccccagagactttcttgcaaatcagtttccttgtctggtagtcattcttactagttttgtgtgcattcttctggagacagttctttaatatgtaagtacttatagttttatttattgacctatttcatagaaaaggtagcatactgtacatgtcatcctgcaacttgcttttctcacttataccttagagatctgttcagatcagtactaaaaacttttctcattccttttttaaatttttatttatttatttatttttttaaagacagtctgttgctctgttgcctaggctggtgtgcagtggcatgatcatagctcactattgccttaaatatctgggcttaagcaatcctcctgcctcaggctcctgagtagctagatgtgtgccacctggctaaattttgatttttttttttgtttttgtagagatgggggtcttgttgtattgcacagggtggtcttgagctcctggcctcaaatgatcctcctgcagtggcctcccaaagtgctgagattacaggcataagccaccatgcctggtctttttcttattcttttaatagctgcattttaatggctacatagtaacctacttcataggggtgccataattattgtaaaattttgcagtccttttcattataaacatttcttcattgaataacttggtacttatttcattttgttcatatacaaatatatctatgggagaaattttattttatttttattatactttaagttctagggtacatgtgcacaacgtgcaggtttgttacatatgtatatatgtgccatgttggtgtgttgcacccattaactcgtgatttacattaggtatatctcctaatgctatccctcccacctcccccaaccccacgacaggccctggtgtgtgatgttccccttcctgtgtccaagtgttctcattgttcaattcccacctatgagtgagaacatgtgtgttcggttttttgtccttgtggtagtttgctgagaatgatggtttccagcttcatccatgtccctacaaaggacatgaacttatccttttttatggctgcatagtattccatggtgtatatgtgccacatttttttaatccagtctgtcattcatggacatttgggttggttccaagtctttgctattgtgaatagtgctgcaataaacataagtgtgcatgtgtctttatagcagcatgatttataatcctttgggtatatacccagtaatgggatggttgggtcaaatggtatttctagttctagatccttgaggaattgccacactgtcttccacaatggttgaactagtttacagtcctactaacagtgtaaaagtgttcctgtttcactactttgtaatgattgcctgtttcctgactttgtaatgattgccattctaactggtgtgagatggtatctcattgtggttttgatttgcatttctctgatggccagtgatgatgagcattttttcatgtgtctgttggctgcataaatgtcttcttttgagaagtgtctgttcatatctttcgcccactttttgatggggttgtttttttcttgtaaatttgagttctttgtagattctggatattagccctttgtcagatgagtagattgcaaaaattttgtgggagaaatttttagaattggatttgctgggccagaaggtatgtacttgttcagttttgataggttttaccaaatggtcctccattgaggtagttctaattgagaagtcagtcacagggcttaatggagtccttgggtgggtttcagtgtttccataatcagcatcctatattagtcagttctcacacttctataaagaaatacctgaaactgagtgatttataaagaaaagaggtttaattgtctcatggttctgcaggctgtacaggaaacatggctggggaagcctcaggaaacttacaatcatgactgtgggtgagggggaagctggcacatcttacatggctagagcaggagaaagagagaaaagagggaagtgctacacacttttaaacaaccagatcttatgagaacttactatcatgagaacagcaaggtggaaatctgcctccatgatcgaatcacctttcaccaggctcctcccccaacattggggattacaattcgacatgagatttgggtagagacacaaatctagatcatatcacacccctttaccccacctcacctcatccctcatatagttgttagcaatgtgcaagtgcatttgtctggggagtccataagctcttttgttgtctttttttttttaacagcttcattgagataaaatgcacattacataaggatcacccttttgaactgtacaatttagtggtaccatcactgctgtctaattccagaatatttttgtcaccctaaaaagaaaaccccatagtcattagccatagtctttcctcatttctcactccctgcagcccctggtagccatttaatctgttttctgtgtggagttgtcccagacatttcatatgagtggaatcatacactatgtgcccttttgtgtatggcgtctttcacttaccatatttttttcaagcttcagccatgttgaagcatgtgtcagtgtttattcttttttatgactgaataatattctattatatggatataccacatttttgataatccattcatcagttggtagacatttggcttgtctccactttttgtctgttatgagtaatgccactttgaacactcatgtacattttcacagtcttttaagaacgatttttaatatatagagtataaatcagtgagaaaaatgcaaattaattcaaccatcaatggacaatatatacgaatagataattcacraagaagagtggtaaattttaaaaatgaaagtatcaatggctgtgtattcctgaagggatattccctctgaaagattactattttataactatgtgaaagaatattaattgttagcaggagagatcttgtggctggttacaggtagttcgagaatgatattcaagaatttaaagtgttatggttagacttttctgtggctcttacctcccttgagtatgagwtctaaaggaaaatgtcttatggcttcttataacttcccagtgtgtatacactgcggttgtgtgtgtgtgctgacacatgttaaactttggttattgtatgggtacacatgttaaactttatatttagttataattttaaatttcaaaaagtacaaaaacaaaaaatagtacagagaacacccaggtattcttcagccagattcacctgttgttaacattttacccaatttgcttgcttattctttatctacctacctacccatccatccatccatccactatccatccatccatccatccatccactatccatccatccatccacccacccatccacccaccatccaaccatccatccatccatccatccatccatccatatacacacacaatttttttcctgaactattttagggtaagttacatacctcacagtattttacccctaattttttcagtgtgcattttctaagactaggtacattcttttattaacttcaataatttacattaataaaatagttcaatcacctgtcaatattacaattctgtcagtcgaccaaatatttactggattttcacaaagtctttgtgaaggggacattatttattcccattttactactgaaggaatcaactagctaagtgattcaacaaatgtcatattgctaagatggctaatattaataaagtactatgtgccaggcacttttctaagtgcataacttgtaaatactctctttaaatcttataacagctctttgaaatgaatcagggccctgaggaatacagagtaaggaacagacagagtgctcagaggaatgttaagttttaggctctttttctgcttctttagtgattaaataacatttcatgctttgtgtgtgtgtgtgtgtgtgtgttttaattttaaaacttaaaatctgaaaatgggagctggaatgggagcaggtattttcctttttttttttttttttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaatttttgtatttttagtagagacggggtttcaccgtttttagccgggatggtctcgatctcctgacctcgtgatccacccgcctcggcctcccaaagtgctgggatcacaggcgtgagccaccgcgcccggccaggagcaggtattttcaatattgctttagttgcatggtatatcagagcagctgtgaggtacattgttgatggaagtaataattttgcctcctctgtgtgtgtgtgtgtgtgtgtgtgtgtgtgtgtcacataattttcctgaaagccatatttgtatggtacattatagcttacagagaaccttcatgtctgttacacagttgattctcaccccaatcatttgaccacttataattgagttaggattcaagcctagctcaattataactggtcttctcctaatccagtggtgtcatcattactctgtgctccattaatagagcctttactttcaaggtagtcctgatgcagctcagactttaaattacccacgtcctttgcttacaactttatgggaaaagaaaaaagaaaaaaaaagaacaaattacccaagtctcgaaacttgctgataccttttttctccctttacaaatgttttttcttaatttataaaaattaagatagttttaagatttaatttttaaaaattaaggtagcagatagttttaagtcatgagggacaaaggtttagaaagattgaccttatttgaataatttggtggtatcaaatgaaacctgtagcaaaaataatcagatccatatttcattatatagtagtcattattgtgctatgtcgttgtgccaattaaattaagtgtatctatttagcatcagccccagaattattttgtttttggattggatgagacctttagaggactaatgaagtggctttaaacttttttgtacacagtccacagtaagaaatgtatttaacctctctttytctcttatactcaatctcatgaaacaactcttactaaatataatgcaccctttttcttttattctgtcctgtgcttttctgtcaaattgtttttgaaggctgtggtgatttactaaattgataaacctgatattgggttataataatgtcataagcactattctggtctaactctctctttttactaatatgtaaatacaccctacaaggtgaygtgatttatttttatttttatttttagattttccaattaattcattgcaatgctgggccaagaattaaggactcctaacttccaattttgtattttcatttaatgacttaaattactattacttttatttagttgcatcaagtatttcttttctttctttttttttttttgagatggagtttcacttttgttgcccaggctggagtgcaatggtgtgatctcggctcaccacaacctctgcctcccaggttcaagcaattctcctgcctcagcctcccgagtagctgggattacaggcatgcaccaccactcccagctaatttttttgtatttttagtagagatgggttttttccatgttgaggctggtctcgaactcctgacctcaggtgrtccgcccgccttggcctcccaaagtgctgggattacaggcgtgagccaccgcgcccggcctccatcaagtatttctgaagacacgtgaagcagtggagtcattaactgaaataacaggaaaccattttgaggctcctttgaagatccctgtgttcaggacttgggtccctctattcttcaagaggctgtgcccatggtgtggctttgctgagagcatctggtgcatacttctgcttttacctctcttttggttgttctttatcttcattcagaagatgagattggtagggtttccccatcctataacctagcagggactttgtctattatctgttctcattctggaaactatactacatatcagaaggcattcttcattttaaaaaatagaaggaaatagtttgcaggatgaagattatttccttgataatctgccaaataaatggttcaggttgccagtatgaagcttctttaatttttggcaaatgggagctggttatatgcatacatacacacaaaacttaatagaaagagtaaaataaaattttgactgtcatgagattgagaagagtagagatagtgaaagtctaaattttctctttttttctgctttaaacaatttaatgagaaaaataagtgtacgtaagattcttaacaaaaatcaaattaagttttttaatgtatttgaatatttaaagtaggattgccacaaattaaatttgccaatgattttaactatgtgtgttttttaagaatgtatctataaatatgtttactgcaatacatatgcaataatgtatgttatgtaatttttatttaattgaaagattgtatttttatttttggtcagttacagtgaagaggttaatcagtaatggcttccactttatctatcagtttagagggcaagattcagccaaatgagaataagaactgttagaaagatgtgcagcaagtcaatgattaccatgtgattcatccataggttatcaatacttgatctgacttgagtttacatgagatattcgaatgtatttcttagcataaaaatcccattttaatttttttttttttttttttttttttgagataggctcttactctgtcacccaggctggagaacagtgatgcgatcatggctcactgcagcctcaacctcctgagctcaagtgatcctcctgcctcagcctctagggtagctaggactacaattgtgcaccacgatgcccagctaattttttaattttagcagagacgaggtcttcctatgtttcccaggctgttctcaaactcctggcctcaagcgttcctcctgcctcgacctaccaaagtgttgggattacaggtgtgagccaccactactggctcctatctagtattatatctaatttaatttatggtcattgagctcatttcttagcaacatcacagaaacaaggctttagtcaattttattaataaaaagagactataataacttacagtgtttatcaatcaataaggtttttagttttaaaaaccttattgattgataattaaattgataattaaattaaaacaagctgggccagcactttgagaggctgaagcaggaggattgtttgagcccaggagttcaagaccagcctgggcaacatagagagatcctatctctacaaaaaaataaactagccaggcacggtagcatgcacctgtagtcccagctactgrggagcctgaggctggaggatctgttgaacctgtgaggttgaggctgcagtaagctgcaattgtgccactgcactccagcctgggtgacagagtgagattctttctcaaaaaattaaattaaattaaactaaaaacaaaatgtggacgtacttgaaactttgactcttacattgattcaaccttcaaaggaacttgtccatttgtgaaagttttccttttatataagtctttcttacagtcaaataagtgtttactaagtgaaatactacattttatagtgcagtggcactcaaaggaaactattttgcagctgtagagttttttcttttgtcctttttactttttccaaggcaagatgcctggtgggagagttgtctggaggcaggatgatcagaagcaggacctggccagctgttcgcttatttcagtctgtatgaaatcatctgatatgcccataagagagatgtgtcaattggctaatgggtcagagtattgattttatgttttcagattgctgacagagagattaggcttccagatacaagcagttccacaagtctctgttttcagacaggcacataattaaagtaaccacacagttctctgaggttagagttccatgctgtgatgcaagcctctctatttggtatttaaaagcagtttgaagctgttgtgtaagtatcactgracttggagtcaactgacctaagttctagccttggcccttctactgtcttaacagtggattaaatgatgaggcttattttaaagaatcttgaaaactatagtaatttcaacaagaggagattaattgaatatattatgaaacatcaagataattgaaaatctgtgctgccattattgcatgtcaaaggtcattttgatacactgtatgtgcaaaagcagtttaccaaacagaattacatacagtgtaatcctttttttcttatataggaaaatacccacttccycccacttaaaaaaataccaaacaccacaatgtgtgtatgtttagcctacaaatcatattttttttgcctaggaagtattgaataatttaaatattttatattcagatagctaaagatggcttgctgagataaaacattggagccctgtgtttggtgatagccgtgggtttcatttatttttactgtctttatcctctgtatttattgatagtattgaatatttattttcagaactattatagtgtatctgtttctatgggaagaaatgaatatttgaccacagatggttttcatttttttagtatggggcacgtggattgacagcctttgaaacttgaatgctgtgtaatattcaggtgcttttattgtttatagaaatgcctaatccttgtttgaaatttattaaatggtatgccatctgtaagcccctctaaattccacagattaattagcctttaaagtaaggttgccttttgtctaacttttagtataaactcttccatctgggaactttcacttttatgtccctgttcagtgttctgtgtacttcagcactctagtattaattatggacactggcattctaagtaacatgaagaacactaaaaataaaagtagactgaacaaagtggcaatgtccggagaatagtttgcatttggtgaataatcaatccatcatggctttgccattgctctttgtatgtgcgtgcgtgtgtgtgtgtgtgagtgtgtgtgcatgtgcgtgtttagcattacttaagagtgagatagttattcttcagggaaatttttacagatgatggtttcacaaaaatcagcctttttgtagtttaaataaaaaaacaccctttttgacatttcatgtaacatttccttgtgggttctgatttaaaggttgttgaaaatatttggtgttggcagatcacttggttggctttggcatacttctctttctaggaaatgtagtatcagggtgggaattgtgttgttgttttaaaagaaatagattacaggctggcacggtggctcacacttgtaatcccagcactttgggaggccgaggcgggcggatcaggaggtcaggagattgagaccatcctggctaacacggtgaaaccctgtctctaccaaaaatacacaaacaaaattagccaggcgtggtggtgggcacctgtagtcccagctactcgggaggctgaggagggagaatggtgtgaacctgggaggcggagcttgcagcgggccgagatctccccaccgtactccagcctgggcaacagagcaagactccatctcaaaaaaaaaaaaaaaaaggaaatagattacattctttaactttatttactggtctcagtaagagttattgaacactctagagtgtttactttttaaagtccattgcaaaatatatagaaattagtaattcaaccatctgtgtactcatactaatcaatgtaatataggttggcgctttttatgcacttaattttgccacctctctcacttccccaaagaaattagwctaatgtataacaataggcttcataacttaatttagaaaacataacaaaaataatttcgctcagtaagtttctgttgtagtagatattgttggtattaaacaaaaaagtaggatcagatgtggtttggctttcaaggtataaaatctaggtggggaaagagagagagagttaacattcttgaaacaattgagagcattagagtgttccagtatatcctccaaattctaaggktataagatgttcagagaaaataaaaaatcagggtgggttagaataattgagttcaaatggaccttggaattaggttagtggaggagatagcattccaaatggaaataaacaatgcgaataaggaaacatgttagacatgtatggagattatgaagtagccttaaatgataagattggaggagtgtggcttgaatagctgtagatttagggcagaaggtctggttaggccgtgggaggtcacaatatggaagaccttaaaagaaaagatgggtagcagggatacatgactagcttgtttttgcaattgagtagtaagataaaaatattttcttaggagaagttatcttagaaatggtggacaggatgagatggaacacaattgaaataggagtctgttgcagtagtatagggatgagttaatgagtgcctgtattaggagagtggaagagggaatagagagaaagtaattactgagacacattttcactggaataaatttggtcattagtatatacttttaacatattcaatgagtgaatgagggattgagaaggactgaatatagtgaataaagtaaaataatagttactattgatagaaaatggatagatttttaaacaatctagttagagggagatagttcagtttgcacataatgaatttgaagtggtaataactgtaagaagtggccttataattaattgaatatatggttctggggcatagccatttaagggccagagatacagatttaagatgtatgtatatatgcatatatatttaaagatactttctgagggagtttctaaggggaaaattggaagattaataaacgagccttaraaaacataagaagaaattatttaacatttgggttttagaaggccttatttaatcatttgattttaacttatttagtttgagcagtgtgttttcaaacctcttttgaaacaactagtaacctatgctttgaaaaaattgttggttaaaataattgtaaaaatgagtatattctgatctattttgatctgattttaaaaccagggtattctgattcattataactttttctagattgctgtgctaaggagacagcaacgtatgataaaaaatcgagaatccgcttgtcagtctcgcaagaagaagaaagaatatatgctagggttagaggcgagattaaaggctgccctctcasaaaacgagcaactgaagaaagaaaatggaacactgaagcggcagctggatgaagttgtgtcagaggtaagtgttagtaatasggctgagtcgagatgggctaaagtatyctctggattaataaatagagaaacttttacattttaaattaaattatgtaaaataatagtgctaggaaaaggagggtataataagtcctaaaacatttgcagtaaggataaagcatttgaaggggaccctttgaattgtactccccaatctacatagaaaagttgtctccttttcctaggtttckcctcattcattgccttagcaccctcttttctggctaagtgaatcacactgaggcttctaaagtgccctgccatattttcccttttaaaaaagaaaacaatataaaagtgtttttattttttctcagtccacctaacaactaatgtgatttttgcattctgttactatgctgactccaagaggttttaatctcctcagttctattcgggaaatttgctgttttcagaatttctcactgcagtgctgaaccatatagatgcctactgaatggggcttcttacactctttttctcttggccctgagtacatgggaatactcctatattttactgaaaacaatgatttaaaaggttagggaggcaaactatagaagtgactcaaaattctttggggatccgtaaaaatataaaaaatgttgaattctggycgggcgtggtggctcacgcctgtaattccagcactttgggacgctgaggcaggcggatcacaaggtcaggagatcaagaccatcctggccaacatagtgaaaccccatctctactaaaaatacaaaagttagctgggtgtagtgcacacctgtaatcccagctactcgggaggctgaggcagcagaatcgcttgaacctgggaggcggagattgcggtgatccgagatgatgccactgcactccagcttggcgacaaagtgacactccgtctcaaaaaaayatatatacatatatatattgaattctttcctcttgggtgaagaggcaactgcaatggagtggctgctgtgtttttttctcttctgcttctctccttttctctccctgctggaaaagggaacctggaagtctctgctctagtcttgaaaagtgttatttcctcacctttgattttttttttttttttaaataagacaaggtatttgtaagacaagagatttacgtaaccggtaaagaggaaaattctaatcttaagcgttgctttttctgaaatcgatgttagtttaattgtatttaatgtggtcatttcctttagaaccagaggcttaaagtccctagtccaaagcgaagagttgtctgtgtgatgatagtattggcatttataatactgaactatggacctatgaggtaagtgaatagatatttattttggacactaatgctaaaaacttaaattctcattattctttagcttttgtcataaactagagaaaaaatgatttgtttttcaagatgtgtaaagagtaatgagacaggagccatgccttcaaagatctcatgatccagctgggaggagagacaagtagaaggatgactatggtataatgtgatgaacataataataacagtgtgaatgagtcctaacataatatagagtacgagttccttgaggtgaaggttcttgtcgtattgatgggtactcgatacattttttgttgagtgactgagttataagggagatacctacgaaggaagctgaacattgaactgtaatatcagtttgccatgtgcaaagtatgagaaaggcatgccaggcaaagggaacagcatgtttaaaggcacagttatgaaatggcatgacatgttcataaaaaagtgaaaagttcagtgtatcttgtatatgtggggagtgtgcytgaggctagatatatggttagaagtataggtgctgctgtgtacaatgaggcatccctagcttttaggtggagggtaacataatcagctttgcatattaggaagaggactttgtgtgttgtattgagtatagactgcagtgaggagaaactattggcagagaaagcattagaagactattgaggtgtttcaggtaataaatgagagtctgaacttacactatggttataaaaaggatgagcaatcttagggtacctctctgatgtagmttttgtgggatttgttaactggtataatgtgggacatgaggaagaaaagagggaagttaaggataattcaaaaatttctaccttgagggaccgaatggtggtgctgtcatcggaggaagcaaacatagacagatggatagttttatgaagaaagacaatagtttttattttaagtataggaagtttgtggcactgactagatattgagaattaacattatagataggtaggtagactgacagacagataatgttagtggtgtagatgagattatccaaggagaacaagtagaggaaggaaagtaacaagaatctgggggacaccagtatgaatagtagatagccttgggaaaagaaactcacagcatattaggggcagaactgaaagaaagtagctttttgaagccaaagtaaaaagagcttcaagcaggtcttgggcagtggtatcacatgctgctgagagcttgggagaygyagaaagctgaatttggcaattatcaggtcagttgtaatcttggaaagcagatttagtaggggtaggcatgaagtctgtattaaaattggttgagaaattgaaaggagttaaaattgaataatctcttttttaaaaaaaaacattttttatgaagattttcaaacatataggaaatttgagaaaataatatgatcaaccccttgctctcatgaaatttataatctaatataggtgacatatactaatcaaaatgatcacacaaataaatgcaaaattgtaacaatgttaggtgccatgaaggaaaggtacatgatatcatgaggccacataatagggtcacttgacctagttagggaagtaaggcaaggtttctctgagaaagaggtgattgtgttaacatctaaaagaagattaggaattatttaggtaagatacaggaagaacatttcatatagaatatataaacatctattcccacatttgtgttgtgtctttgtgtttatatgtatttagtttaaaaattttggttttacatgaaacaattatatacaaattgtgctttctttaaaatatgtgaatacattattctcttttaatactacatagttttttgtagtgtaaatgtgccataatttagcaattctctttaggtcttgggaacccctttgtacccttaaaagttaccaaggatcccaaataatttttgattttgtggtttatatatactgatatttattatatgagaaattaaaactttaaaaataaaaaatttttaattcatttaaaaataataaaccgtaaaccattactttacatgttaacataaataacatgttaatgaagaataattatatctcccaaacctccaaaaatttagtgagatacagaagagtggtactactttatagttttgtaaaaatattttttttggggggaagctcaaatacatcagttttagtttttctctatatacacatttatttgctactaaaaattgaaatagcatattgaaatttccttttgttgcaatccaaaattttgaaaaccagaaaaccaaattaattattattatgctgtggccagactactcagtattttctttacattctttcctccaagttactttccttcaaattcttaatgttgggttttatctcactgacttcaggcttctaaaacacatggggatacttgagacctattgttgcttctttaggtcaaatcaatagtttcataaaaatctttgatgtccgacttaacaggatctggcaggattatctgttttttcatgtaatctgttatgatatattgtttgggttgaaataaatgaagaaaatttagactcacatcggtatgcagttggaaaagggagaactttgcagactttgaaagacttttaggatccccagarttccttggactgcttaaaaccccagtgcacacttgcccaactgctgccgtaatttatttaaccatcttttgataggcagctagggtatttccagttacttgttgatatgtgtacataaaatgtatttccatatatttatgtgtctgtatgtgtatgatagaatctagactagagctagaggttacgattatctgaaattgtgatagagtttgccaaattgccttccaaaaagactgtatccgtttacattcccactagcaggagagaggagtatccattttctcgcatttcctaacactggatattgtatttttaaaattcttgcctatcttgtggatcaaaaatgttattgttagcctgtcacattggcctgtgtgctcttcctcaaacactctaagcctgctagcacttcatggtcttcactttcattcccactgccggcagtgcccttccctcagagattctttctgtcaggtgttaagctcaaataccatgtacccctgagcttcaaataaaagttttaaaaaagtgattaaaaaacatcaagtttttttggtcaaaattaaaaaaaaaaaaaaaagctcaaatgccacccctgtgaggctttcctggactaccttttctaaatgtctatcccagctcctgccattgcattccctatcgcctttctttcttcatttttctacatagcacctctccccttcaagtatgctatgtaacttayttattttctttctctccctggaggtatttttatctcttttgttttccagtgcttagaacagtggctggcacatagtagttactcaataaatacttgtagtatgaatgaatgtctccctcacccaattagtaggaattatatatgttcataaactatttctcaaaaaactgtgtgttcttttagttcctcatttcttatctggtatacgtggtacttatttatttagtcagacatacagcaaatatttatagagcacttaatgtttgccaggtactgagcaaggaatcaaggatgcaaatatgaataaaagtacagtctagtaagagaatcagatatgtaaacaactgttgtatgagaaagaattatatggatgtcatataaacatataggcattaaaaaaatgaaaaactttttgtttacacacttctgacaccagatatgtggattttctacactgagcaattctccaattctctggacaccaactggatgtcctacaatttgactcaattcttttttaaattttaattgtaaaatattttttattgagacagggtcttgctctgttgcccaggctggagtgcagtggtgtgatcgtagctcactgcagcctccatcttccaggcttaagcaatcccccgatcctcagtctcctaagtagctgggactacaggtgcacctcaccacacctggcaaagttgctcaggctggtcttgaactcctaagttcaaatgattctccttccttggccttccgaagtgctgggattacaggtgtgagccattatatctggccaatttaagtcatttctgacactacctggagctagcacaggctcccacaggttaagggctgagtatccaaagactgcccctgacttcagtcaccagttgcaagtcccaggttgtgacctgtaacttctgactaagtggctataagttgagggttcccacaattccctcttgaggtttgataattttctagaatggctcacagaactcaggaaaacactctatttactattactggttttattataaaggatatgtggggcaarctaaatgggagagacgcatagggtaaggtataggggaagagtgcagagctttcatgccctctccaggtgcaccaccctcctagtacctccttgtgtttgctaacctggaagctctccaaattycattgttaggggtttttatggagcttcattaggtaggtgtgattgattaaaccattggccattggtgattgcacttaaactccagccccctctcccctacttggaggttgagggatgggactgaaaatcccaacccactaattatgtggttggtttctctggcaatcagcctccatcatccaagagtcacctcattagcataaactcaggtccagctggaaggggcttattacggataacaaaagatgctcttcttaccccctatcactcaggaaattccaagggttttaggagctctgtgacaggaaccagaataaaaaccaaatatattatttcttattatatcgcaaattcacaggcatattcttgagggaacatagaagtaaccagtaacgctgctagtggcaatcatgggaggctttatgcagtagtactcgatgaaggaataaagaggattagattatgctacaggaagtgacagtggggttaggggggacatctcattgtggaagccctcatgaatcaatagaattttaggaaagaaaagactggaacaaaaaaaattttttgagtgcccccacccaccagacaaaaaatttttaaaaatgaattaatgatcttcacagctgctgaagtaaaggtggggatggatctcatttccatggtagattgattgattatgaaaggaagagatgatggtccctattttatcaagaagtggtttgtgttcaaaaaggagttagtagaaagaggggattaaaaatcggagaaagcttaaatatttgaaaatcttgaggatcaatcagttaagatctgtatctttctctgtgtgatgctttaggaacagccagcgaagaagtagtgggaatattaggaactattcaagttaaaaaaacatgttaaaaggcttaacttgaagaaaagcatcaaggagaaaagctggaaggaatgaggaagtgtaggaaagtatcttaacaagtcagaatatctttgacaccaacaaggaaatatggaggaaactggctgtgaaatttataaaaaccaagaactatttcttgtagacaaaatttggcatgaacagtgaaatattaaagcccagagaacaacagtgatttgaaagactgaaatttgtccctgaatcaaatgttgggaattgagatgtttcatcatttgtgttattcaaaagaattttttgattggccccatttttttttttttttttttgagatggagtctcagtctgttccccaggctggagtgcagtggtgygatcttggctcactgcaacctctgcctcccaggttcaagcgattctcctgcctcagcctcccgagtagctgggattacaggcacctgccactatgcccagctaattttttgtatttttagtagagacagggtttcaccatgttggtcaggctggtctcgaactcctgaccttgtgatctgcccacctcagcctcccaaaatgctgggattacaggtgtgagccactgcgcctggcctgttttcagtctttttactgcaaggctatgatcttctctggtccgggagtctgccagaggagcaggaacttcccagttgaaccttattagtaaccacctggaagatatttattgaacaagtgtcacatctgtagtcttgtgtatctagaaaccttaagcatgcattattatgttttaattggaaaatgcataggctttaaaaaaaaagattgtgagctctatctgaacttttgttaagtaccacaaaattaagtttgtcagacaaatagacatttgaatcagagatttccaaagtattttaaatttaggaacctaaactcttttagarcagatcacattaccgagtaaagtgattaatgtggtttcagatgttcagcgtagaactgaatgtttgtgccttattggtatgggccaaatgaaaaaaaaaaaataaaacacacaagtttgccaaatattggtatgccttaaacatttcctgaaggcatttggtgatgaaatataaatatatctaatgtataaagtaagagagttttgtcaaaggtaatatgcagcaaagctgactagtttgaagaggtttgggttactgaatagacgtcacacaggaaaaaaaaataaactaaatggacttataagggttaatttttctgaccttatcgatattttgtggatagtaaagaagtcatctagctatttttggcataggattcaaggagctggcccactctgggtggtctataaatagtaactctaggtagcagggactggctaaacaggacaaatgtgaattggttaaaaagaaaatcctcttcttattactcattggggttaattctatgattattagtcatattttattgttgagaacctgaaatttaacccaggttttttttcttttttttaaattatcactacagactctgccttttctactatgctgtaaagtgttactttattttattttttctaccttaaggttaaggaaccttaaccttttgtttttggcaatatggtaggctaaaggtacaggaaactcattgcagtttagcacactaaaaaatgatggattgaaaaaataaatcaaaactcttatttcctggctccactggagacaaagtaagggcttctcagaggccagaaataataaaagataagatgagtctataatgataagctagcattggaagtggtgcttgttctggatatagttcctgatccttgcggcgtagtgtctggggatgggaaagaaagctgtggacccaagtgaggtgggaagtcacaactgaggcctcccttttcctctacccaaataaagccagaacttccaaagaatgacactcttggttgccaaaagaggggaacaaaagttgccctaccactcagggagactgttattaagtacctatcttggttttggctttagttagagtggaaacaaatgaaaagtctttcctgataattctttactcaaagcccctacctaatcaggttagagcctaaatttatactactagtgtgatccccccaaaatcaagacaaaaatgcagtttaggtgggcttatgttggtggtgcctgtaggcacctgagggaattgaatgcaaattcttctcagaagagacactttataaaagaaagtgtccatcctagaaaaactggagacccatctcatatgcagagacacacacaggctcaaaataaagggatggaggaagatctaccaagcaaatggaaaacaaaaggcaggggttgcaatcctagtctctgataaaacagactttaaaccagcagagatcaaaagagacaaagaaggccattacataatggtaaggggatcaattcaacaagaagagctaactatcgtaaatatatatgcatccaatgcgggagcacccagattcataaagcaagtccttagagacctacaaagagacttagactcccacacaatcataatgggagactttttttttttttttttttttttttggtgagacggagtctagctttgttgcccaggctggagtgcagtggcgcgatctcagctcactgcaagctccgcctcccgggttcatgcataatgggagactttaacaccccactgtcaacattagacagatcaacgagacagaaagttaacagggatatccaggaattgaactcagctctgcaccaagcagacctaatatacatctacagaactctccaccccaaatcaacagaatatacattcttctcagcaccacatcgcacttattccaaaattgaccacatagttggaagtaaagtagaccaatatccctgatgaacatcgatgaaaaaatcctcaataaaatactggcaaactgaatctagcaacatatcaaaaagcttatccaccatgatcaagtgggcttcatccctgggatgcaaggctggttcaacatacacaaatcaataaatgtaatccagcatataaacagaaccaaagacaaaaaccacatrrttatctcaatagatgcagaaaaggcctttgacaaaattcaacagcccttcatgctaaaaactctcaataaactaggtattgatggaacatatctcaaaataaaagagctatttatgacaaacccacagccaatatcatactgaatgggcraaaactggaagcattccctttgaaaactggcacaagacagggatgccctctctcaccactcctattcaacatagtgttggaagttctggccagggcaatcaggcaggagaaagaaataaagggtattcaattaggaaaagaggaagtcaaattgtttgcagatgacatgattgtatatttagaaaaccccattatcttagcccaaaatctccttaagctgataagcaacttcagcaaagtctcaggatacaaaatcaatgtgcaaaaatcacaagcattcttatacaccaatagcagacaaacagagagccaaatcatgagtgaactcccattcacaattgcttcaaagagaataaaatacttaggaatccaacttaaagggatgtgaaggacctcttcaaggacaactacaaaccactgctcaatgaaataaaagaggacacaaacaaatggaagaacattccatgctcatggataggaagaatcaatatcstgraaatggccatactgcccaaggtaatttatagattcaatgccatctccatcaagctaccaatgactttcttcacagaattggaaaaaactactttgaagttcatatggaaccaaaaaagagcctgcatcgccaagtcaatcctaagccaaaagaacaaagctggaggcatcatgctacctgacttcaaactatactacaaggctacagtaaccaaaacagcatggtactggtaccaaaacagagatatagaccaatggaacagaacagagccctcagaaataataccacacgtctacaaccatctgatctttgacaaacctgacaaaaccaagcaatggggaaaggattccctaagtaataaatggtgctgggaaaactggctagccatatgtagaaagctgaaactggatccgttccttacaccttatacaaaaattaattcaagatggatcaaagacttaaatgttagacctaaaaccataaaaaccctacaagaaaacctaggcaataccattcaggacataggcaagggcaacgacttcatgtctaaaacaccaaaagcaatggcaacaaaagccaaaattgacaaatgggatctaattaaactaaagagcttctgcacagcaaaagaaactaccgtcagagtgaacaggcaacctacagaatgggagaaaatttttgcaatctactcgtctgacaaagggctgatatccagaatctacaaagaactcaaacaaatttacaagaaaaaaacaaccccatcaaaaagtgggtgaaggatatgaacagacacttctcaaaagaagacatttatgcagccaaaagacacatgaaaaaatgctcatcatcactggccatcagagaaatgcaaatcaaaaccacaatgagataccatctcacaccagttaaaatggcagtcattacaaagtcaggaagcaacaggtgctgtagaggatgtggagaaataggaacacttttacactgttggtgggactgtaaattagttcaaacattgtggaagacagtgtggcaattcctcaaggatctagaactagaaatgccatttgacccagccatcccattactgggtatatacccaaaggattataaatcatgctgctataaagacacatgcacacatatgtttattgtggcactattcacaatagcaaagacttggaaccaacccaaatgtccaacaatgatagactggattaagaaaatgtgtcacatatacaccatggaatactatgcagccataaaaaatgatgagttcatgtcctttgtagggacatggatgaatctggaaaccatcattctcagcaaactatcacaaggacaaaaaaccaaacaccacatgttctcactcataggtgggaactgaacagtgagagcagttggatacaggagggggaacatcacacactggggcctgtggtggggtcgggggaggggggagggatagcattcagagatacacctaatgtaaatggcgagttaatgggtgcagcacaccaatgtggcacatatgtatatatgtaacaaacctgcacgttgtgcacatgtaccctagaacttaaagtataataaaaaaaaaaaaagaaagaaaaatttccagagatacagagccagttgaacatgagcacatgtctgcttctttccctcaaaagtcattaaacacaccaggaaaccataccaccatgaataagagttagaaaaaataaactacagaatcacactctgaaagactatagatatttgaattatcagatagagaatataaaatatattaaaagacagaattaaagtctggtaaaggaacaaaagactaccagaattggccagaacattttgaaaaaaaatctggaaataaaaatttaagttaaaattataaaaacaatgaccaggttaagacagcaaaataggtatacttggaataggaacagctccagtctacagctcccagcgtgagcaatgcagaagatgggtgatttctgcatttccaactgaggtacagggttcatctcactggggagtgccagacagtgggtgcaggacagtgggtgcagcgcaccgtgcatgagctgaagcagggtgaggcattgcctcacccaggaagtgcaaggggtcaggtagttccctttcctagtcaaagaaaggggtgacagacggcacctggaaaatcgggtcactaccaccctaatactgtgctcttccaacgggcttaacaaacagcacacgaggagattatatccagcacctgacttggagggtcctacacccacagagcctcgctcattgctagcacagcagtctgagatcaaactgcaaggcggcagcgaggctgggggaggggcacctgccattgcccaggcttgagcaggtaaacaaagcagctgggaagcttgaactgggtggagcccaccacagctcaaggaggccttcctgcctctgtaggctccacctctaggggcagggcacagacaaacaaaagacagcaataacctctgcagacttaaatgtccctgtctgacagctttgaagagagtagtggttctcccagcatgcagcttgagatctgagaacgggcaggctgcctcctcaagtgggtccctaacccccgagcagcctaactgggaggcaccccccagtaggggcggactgacacctcacacagctgggtactcctctgagacaaaacttccagaggaacgatcaggcagcagcatttgcagttcaccaatatccgctgttctgcagccaccgctgctgatacccaggcaaacagggtctggagtggacctccagtaaactccaacagacctgaagctgagggtcctgactgttagaaggaaaactaacaaacagaaaggacatccacaccaaaaacccatctgtacgtcaccatcatcaaagaccaaagatagataaaaccacaaagatggggaaaaaacagagcagaaaaaccagaaactctaaaaatcagagcgcctctcctcctccaaaggaacgcagctcctcacccgcaacagaacaaagctggacggagaatgactttgacgagttgagagaagaaggcttcagaagatcaaactactccgagctaaaggaggaagttcgaaccaatggcaaaaaagttaaaaactttgaaaaaaaaattagatgaatggataactagaataaccaatgcagagaagtccttaaaggacctgatgtagctgaaaaccatggcacgagaactatgtgacgaatgcacaagcctcagtaaccaatgcgatcaactggaagaaagggtatcagcgatggaagacgaagtgaatgaaatgaagcatgaagagaagtttagagaaaaaagaataaaaagaaacgaacaaagcctccaagaaatatgggactatgtgaaaagaccaaatctacgtctaattggtgcgcctgaaagtgatggggagaatggaaccaagttggaaaacactctgcaggatattatccaggagaacttccccaatctagcaaggcaggccaacattcaaattcaggaaatacagagaacgccacaaagatactcctcgagaagagcaactccaagccacataattgtcagattcaccaaagttgaaatgaaggaaaaagtgttaagggcagccagagagaaaggttgggttacccacaaagggaagtccatcagactaacagctgatctctaggcagaaactctgcaagccagaagagagtgggggccaatattcaacattcctaaagaaaagaattttcaacccagaatttcatatccagccaaactaagcttcataagtgaaggagaaataaaatacttcacagacaagcaaatgctgagagattttgtcaccaccaggcctgccctacaagagctccggaaggaagcactaaacatggaaaggatttataatcccaaaggattataaatcatgctgctataaagacacatgcacacgtatgtttattgcggcactattcacaatagcaaagatttggaaccaacccaaatgtccaacaatgatagactggattaagaaaatgtgacacatatacaccatggaatactatgcagccataaaaaagatgaattcatgtcctttgtagggacatggatgaaactggaaactatcattctcagcaaactattgcaaggataaaaaaccaaacaccgcatgttctcactcataggtgggaattgaacaatgagaacacatggacacagaaaggggaacatcacacactggagactgttgtggtgtggggggaggggggagggatagcattaggagatagacctaatgctaaatgacgagttaatgggtgcagcacaccaacatggcacatgtatacatatgtaacaaacctgcacgttgtgcacatgtaccctaaaacctaaagtataataataataataacaaaacaaaaaaatagatatacttgaagaaagaaatagtgaatgggacgatggatctgaagaaattatatagaatgtaacacagggagacagagagatagaaaatgtgagagatattggacaagaggttatgccaccataactaaggaataaagtaacattcccagtcatgagacatattgacatctgcagctcctgatgggatgcactgagaagggcacagtatcacttctatgatgttcttgtcccaaaaaatgtataacctgaattgtctttaattttattttttatttttatttttagagacaggatcttgctttgttttccaggctggagtgcagcagcatgatcatgactcactgcagtcttgaactcctaggctcaagcctcctgagtagttagtactctagatacacaccaccgtacctggctcatttaaaaaagtttttttgaagtgatgacatcttattatgttgctcaggctggtctcgaatttctgggctcaagtgatgctcctgcctcagcctccttaagtgttgggattgcagatgtcagccagcatgcccagccttactctggaatcttaaaaatattgctaactgagccctacccaagacctatgaagtctgatagggtaggtcaaaggcatttgtttgtaaaccaaacatttttcccaggagattctgaagtatgtctagggttgaaaactgttgtgtgtagttttgtatttctttcttcctatacattgttttgtatagttttgtatttctttcttcctatacattagccactatggaaattgtaaaagcacttattcattagattataagataatgtacgtaagggaagtttttattaaaatgtctctagacagacacctctgtatagataggtttgtctcatatacttgaggacatttatggacctctgttttggacagagtaggggccacagcataatctgtgaagggaacttcttcctggcacataggattgcagattatagattcctttgttatgttttcccctttctattttaaaggtcactatagtcatcctcctttgctgcaaatcataaatgaacatactaaggaggttttaaatatgttttagttaggtcttaaaaaaattaacaaatgtttggaattgacagtgcttttaccctgtttttgttctgggttaatgctgcgccctcactaggtctggaatctttatagtttgagacatcagacttggatgaggaagggtaaatcatgctactagtgggccagttactctgtggttttcttatgagactgtgctttaaggaaaagktaaccacggagcatatggcattgagtttgagtcatgtggaactggttagaagtaaaatgtttctattccagcattctctgagtttgtcagcttttcattattttataggaagaattctagcttcttatcctgaratgagcttgtctccaaatctggttccaattttttgttgttgttgttgagcacatttcgccatatgatatcactattggctgtaggttaaaagttaccgtgtaacttaaacgtcagaattcaaaccaccaagtatacacggttttgttcagccagatttttaaatgaaatctaatttgagtttttggctaaaagtactttccacatttatcaaagtgacacatgaactgaagaaatacaatgtatctgagtaccaggtgttaytgaatctggaattgcaggagggtaacagagccaaaggcagtcctttcctcaaatagtcttaacgtattcatstttgtcaaaaatgtgtctacacaaagtaattggttctcttttctctgtagatttcatcctttgttgaaaaagatgtcttagaacctatcaagtgcagagctgggttttgagggcatggaaaattctgttgatgcttttctctagttttggctttcatgtgagttgtacatagggaggcttataaggagcatcctagtggctttaccttgtatcacttggctactttttccccacacttcattgttgtaatgaagggaaaggcagctgaaaccagaaacctacatcccttgccaacttaagagataaaaggaaatttatctcttctgctttctacctagtgagaaggggtcggtgagaaactaggccaggtgagaaaactactatcagagtttaagttgagtacttcgatatgttcttcagaccatacatcttagttaacataaaacaaggactagtggatagtttgtgtgaaatagcattttcaaccaccattttcagtacttaatatagctgggtggaatcatgctgtgtaagtgctgcagaacataaataataaaggaaataaacatcttaattttgtaacaagtgaaggtctaggctaatattaagggtagtataggatacttttgaagcttttgaatgtacagaagtacatatgtaattattatatattgcttagacttctaggcagtttgccattcatgtcttttttgtctccagattgagctgttttgtcacattagtgagcatttgaaacataattttaagtgtcattctacaaatggttcttaattgatttatgactaatgtcagtatgaactgcaggtgtgtgccgtgcctttggactttttggtgtctgtgtgttctgaacataaattggccttagtatgttatgcacactgtcagtttatcacaatccatggcctctgaggagccagaagtacggaatgtacagacgatctatgtaccttatattattttctgtctcagccctttcccagaattcccaataaagcagatttctcaattacttgcttttatttttcctttctcccatttttttttttttggtaaattaacaatgagagataaatggaaataaggcagttggaagaaaagaggatgaaaacaggtgaagattcttagttgtggaataagctaggttggctatgggttgataccatgtgtgcttgggtagtaaaggtagctagttttttctgcgtgttgtattaagccattatttatcaaatactaattacgttttatgcactaaatactagtccaagtattctatttgatatatggattaattcatttgttcctcctagtgccatgaggcaggtattattattcctgatttacagatgaggaaaccgaagacacagctaatatgtggcagagatcagaatcacaatctgcctctggagccttggcttaatcactgacagagcaacagccactcaggcagagaaaaaggagttggcatttacagttagaggagttaggactytagtaactctgcccgtttccctaaagcttaggattggctgtgataggggaaagtagcttatgaattgactggattgatgtaagtataacagaaaagagagattgtactcaaatttacagccatgttttttgacatttagaataatcagaggatacttttctgtagtgagaaatatacaaagagttgttcacacacacaccttttatattaaacactgactcagtgatgtcagcaatctaattactatagagtatcagttatctaatactgtggaacaaaccaccccaaaacctaaacgcttaagacaacagcagttattattttggtaaagaaatctgcaaattgggcagagttcaggacagacagttcttctttgcctccgtggartgttagctggggtggcttaggttggaggacccactttcagattggctcattcacatggccagtaagttggtgacggctttcagctgggacctgagcctgggatgtgggccagggttcttggtttttcttcatttggacctctccacagctgcatgggtttcctcacagtttagtgkctgggttccaagaataagcatcatctattagaatagtgcttgctttataattgcttattgaatgaatgaaagaatctcaggttgttttcttgctcatgttggcccatttggcaaatagccactgtaaagtgcaggtttcttcccagagcacggtaatccctggctctgagaactgctatttagagggttcttttatcttgacttgaaggtctatttcttcatttaaccacatttatgtttctaataaattacccccagttactactaggctgcaaaaatcatctctgaaccattcaataaacagagaaaagaaaacctttttaaaatttggaaactaccttgaaaactccccattttttcctccttttagtctcagttgcattgaaagttaacataatgttctgttcctggatctggaaatggtgtaatagtgacttcaccacctgccattcttgagttgtgggttagtttccctaaaatgtagatcttgacaagaggcagatggtgcatgaagtttatttatttgtttattttttgaaaaaggaatacctcttatgaaccaggaactagaacaccccttagcttacattctaacaagaagagagacaataaacataagtaaaatgagaaaattataaattctttggacaaagggataaagtatagtagggtaaatggttttacatgttgaagggtagttgttgggactgtagttttatttacttatttttaattttttttgaggcaaggtcttgccctgttccccaggctgaagtacagcaatgcaatcacggctcactcagccttgacctcctgagctcaagcgattgttccacctcagcctcctgaggagctgggaccacaggcacactccaccacacccagctaattattgtattatgattattattatcgtagagatgaggtttcactgtgttgcccaggctggtctcaaactgctgggctgaagcagtctgcccaccttggcttcacaaaattccgggattacaggtgtgagccactgttccctgccaggactgtagttttaaatggtgatcactgtaaggcaggtgtttgagccaaggcttaaaggagaggagagggttagccatatggatatctgaggaagaacagcattcttggcagaggaaacagccattgcagggatcctggggtggaaatgtgtcttgcatgttcaaggaaaaacaaggtggctttgctaaagagagagtagtaggagatgatgtcagagaggtgagatacagggagaggtcaawtgaggtaagacttctgtcgttttaaagatttgggcttttaccatgatagaaatgggaagccatcagaaggttttgagcagaggtgacataataatctgacctagattttaaaaggatcactttagttactatgttgccactagcctgaacctggtaggcaggaagacaagtgtcctgctctgtgtcatctttgggctttataaaccatgttccatctgttgtctcatttgaatctcaggaaaaccttgtgaaatatttgttatttttcatgttttacatgtgaggaattggaggcttagagaagttgaccaagtatcccagacatactcaagtgagcagtctcagagtaacatcttgaacccagatctcctgtctccaaattttgtgctcattccactatttcacattaaaacctgaagatctccctgctcttttcatcttaacrtaatttcagctttttgtgtgtggctctccaagycacagagcagcagcagcttttgaggataagaagcagtttcttttaaggataagaagcagtatggttcttacctggtaagatggcttgaattcaaaattgacctacttgtaccataagaaagcaggtttgcaaggagtagaatagacttggagatatgccattttttgttcagctacttggtatgaagactgagtatctgaaaccacactgtaaggattaagtggcttcataaataatctaaaacagttgttggcttttagaatttaataaatgaaaaagtaaggtaacaattcttataatactttttccagactttcggggaaattgaaatcatttgtgttttattaatccatgcttttcaggaccaatggcccataatgtgagcaaggtttattggtgtaatgattattttgtggcctaaaactactgtgactctttggactagcatgtttctgatcatagagacagctagagacttcttcttttttcttaatatttgtagcttgttttaaacgtactgagtagaacctgatttaagcaattatacaaagtttggttagattgctttattaatattatgaactagaaacagtcaccaaatgcgcattcattatactaatccttactatgattgagtcatttctttgagttcttggaaatctaatttttctaaaattaacaaaaggggacatttgaatgatgcaaaagcactcatggcaagaatctaaaagttcatataaataataattttctcatactcttttatacatttgaccattacaagatctgtcaaattcctttcaatatttgtgatgtcacagtcgtactaaaacaatcttgaattctggcagcgaaatgaagttcttacctgtctttcagatgttaataaaaataagggaaatacaaacctgtagttattcagatggttaaaattagtttctgtgggtcatttcatagagttcaagtatttaaatgtttttttagctgaattggacaatcaacttgtctgtaatttagcttaagagaaattccattttaagacaaaaaaactacagggaatgtaggccaaaaaataataacaaccaaaaacaaacaagtgaaaaacgttaaaagattcttagcagaatttattaatatattacctcttcaaaatatattctagccaatggatagataataaaattgagacccacagactatttggatcctaaattttgtttcatcatgactcccttgttgaaaatactttattgactctgtgtaaygtaaataagataatttttgtgaagctcattgaatgcgtctgagctccttaactcaaaaaaggctaaaagttactgaaatagctatggttaagggtatattgtcatyacaatgtgataatcattaccaaagtgggcactkggaaaaatagtgaccacttatgagccaaaccaatcaacattaaaactgatttccagtaagtacagctgccaagtgattatagagcagcctggatacagatgggatagactacaaggatagttaagctcaaagcatttgcctgttaacagccatgaattgtgaggtgaaatgccagtttacatagtgttagtaaaatcattaaaagaacaatgattagtagaagaattctttacaaaccttaaagtatcaatagttctgaattaattcaatttataaattatccataagtcatacaaatagccactttgtactttttcatgtccctccaaactcccccagtccctatttccaaactgtccacttctgttgaatctattgtaaaaatgtgtaccttttagggaactgagataggaaagatgtgaaaaacaggattagtttagaataatggttctcaaacattggtaaagtcacctagactagtacaaccactgcggaaaacagtgtggagattccttaaagaactaaaagtagaactaccatttgatccagcaattccactactgggtttctacccagaggaaaagaggtcgttaaacaaaaaagatatttgctcatgcatatttatagcagcaaaatttgcaattgcaaaaatgtggaaccaacccaaatgcccatcaatcaacaagtggataaagaaactgtggtatatatatatgatggaatactactcagtcataaaaaggaatgaattaatagcattcgcagcaacctggatgggattggagactattctaagtgaagtaactcaggaatggaaaaccaaacagcgttatattctcactcataagtgggagctaagcttgggatataggtgcaccaaaatatcacagatcaccactaaacaacgtactcatctcaccaaatgccacctgttccccaaaaacctatggaaataaaaaattttaaaaaaagataattattaatccagtttttggtgaatcagtgagtgacagtggttatagtagtggtggtttaaatcaaggaataaatgttttcaaagtgaaaggagcacatcctaccacacagttcaaaaacaatcacaaatatggcaggcttgctgagagctttcatacatcatttattgtcatgcacttgtatgattattgtatactgtacacatttttattttacaatgatttgtattttccaatgcrtttattgcagttcagtgtggtagatggctggagcctatcctggtagctcggcgcacaagtcaagaattaaccctggacagggtgccatccctttgaagggtgcactcacgcatgttcygcacactcattcagactggagccatttagacgtgccagttaacttaacatgcacatctttgagatgtgggaggaaactggagtacccacaggaaactcatgcagacttggggagagtatgcaaactccacacagacagtgaccttggctgggaattgactttttttttgtcatcagtgttatcacaaaatgacattgcatgaaccagcattgtttgaagacttgctgtattctgattttttttatctttcatctttgagtcattagcaccaaatatagttcttggaacataataggtatttactacatgaataaattaatggatgaatcattcattctgggaaatgttgtcaacatagtgcagtgatggaattccaatcctgaatccaaatcctgactttcttagttatttagagcataaacttgggcaaactgtttaaactctttgagcttcaacttcctttgagccttcatttccttagtacatagtaggtactcaaaagtggtagctactgttaaaatatactgtatttgcatcttagaagagcatttaacattcttgtgatatctttatggtcaagatgggaaattttgayctaggtggtatttcagttaattcataagtagataaacctacgtttttacagatttagaaggagctttttattttaataacaactcagtacaggatattgatggcatgctgatactttcttggaagaatttcttttgctaatgaggagcctaaaagttcttgattgattagtaggtaagtgtttttaaaggaattgatataaattattcagctggatcctaaaactcagttacacaaattcagagttgaggtgggataggaagagaagcaaaagtaatggttcaaaatcgatttgtgtgaaaggacttagggttttaattacactgggctcaatataaatagagtgtaatataactgccaggaaagcctatgcgatattagactgcatcagtagaacaacagtgtctagaacaaatggaggaattatccttttccattctgtagtggtcatactacctaagaagtactgtggccaattctggacattacctctgagaagcatgttkataggacagtgatcaaatatgctaaaggaacttcagactatgctgtaaagaggagcatgtgaaagaatcaagaaactataatcttgaaaaagaaagcctggggtaagggggatgttagatgtctttggacattagaagaaggcttacttagacttgttctggatagccacagaatccagaactagtatcaaaaggtggaagtttttttgttttttgttttttaaaaaggaagcacatttctagttaaaacaaggggaaactcttaataattagggtggtagagatactggagggatcagggagtgagtacttccaccaaacaggaacattagtatatggatatttcactaataacaatagcggggtcagtaggggttgaattaattgagattctctaaacttaggggaaagttcttaactttgattttattcatagcttactttcataattagaatttttggcaccatgcttgaaagaaaaagtaaacactttttttttaaagttagtttcctaaagaagaaataaaatttcttagttgtcatcacactcttcatttgacttccctcccaaattgctattgttttctgcttctctcatgttttctkaaatactcatcagggtgacttttcttaagtttagacagacattccactaggtctcttacctcatttgtggcaaggtttatattgatgtgtgactgctcaggtaaacctttagtctgaatgatacagctatgacaaaatatagcctcagttgtagcaaaattaaatgttacacaatggctttaattggtggtacacctttgaagagtttgcagtatgcccaagtgctaaagcataccatgtgagaatcactgggtagcaatgatttctgggggtgaagaattgaggagaatggaaaatatattaagggatcagaaaaatattctagagaggtgtgtctgctccccgttttcccccaacactgatttccccaaatttggagacaaactactattatctcaaagaaccgcttttcctttagaaccacaggctccttaactaccctttttcattagccttactttcctcttgcattttatccctccaaatagaatcttttgtgcttctctagggagattccctttgtgttgaattttatgagtagtgtaaattgtgtgggttgcatcataaaacaaagtgcraacacacacacaaagtcttattgatgagccaagttcctaagcactattaatgagttaaaagtgttaattaaggctgggcgcagtggcttacatctgtaatcccagcactttgggaggccaaggtgggaggatagctttagctcaggagtttgagactagtctgggcaacatagtgagacctcatttctactaaaattaaaaaaaataaaaattagccagatgtggtggcacatgcctatagtctcagctactcagaggggctgaggtgggaggattgcttgagtccaggaggtcaaggcttcagtgagctgtgattgtgccactgcactccagcctgggtgacagagtgagaccctgtctcaaaaaaaaaaaaaaaaaaaagttaagtaggcagtatttgcttatatgtatatattttgttgttttctccaaatgcttatgcctctgaagaggatatacattgatgagtgaagatattagggagggtagggagaaagaatagaagtttttacatataaatacaaatagaagtatttaaaaaawttttttttcttagctttatctgatagcctgccttctggaattgtgaaaggctaacaatgaatttgacttttattcctacttcatttgaagtattctctcattgaaaacaccagtttgcaccatccaggaggccttcttatttcagttattattggagtttaaaatttgtttttaggtgtgtcgtatttatttctacttcatatatacatgtaattatcaagtttttaaarcatatagaacactactattgtttaaacagtttataaataaggtacttttatacttagaaaaattgtttttgatrtgtgcaggttaccatgctaaggatttgaacaccttcagtaccctatttgtacttgcktctatgcctagcatttttgttacgtgcatggatctgcaaaggaattgtggtttgtttcacagctgcatgtagcaggcatatgtgtgacatatttttatttcagctattatttcctgttttttattttcagcatgttggaacaggattccaggagaatgaaccctagtgtgagccctgcaaatcaaaggaggcaccttctaggattttctgctaaagaggcacaggacacatcagatggtattatccagaaaaacagctacaggtaagatggcatgcatctatcttttggcctaagtgatttaatgaagctgaaacaagagaattatctgtagtataacattgcatctaaattgttcgtgtatattttgagtagtagaacacataaattactgaaaccattaatacattttacttttaatattgtaaaattaaatttactttgaaaccttttgtagttttaaaattcctatagagatgtaatcttaaaatctcagtttgtgtgcattaatatacatattgaaatatatacatattatatataatgtctttaataattattttatctatcatgtgtttatacatataatacatctaatatttgttactgtctcacctgtggatggatatgatatggtggaataacatgattgaacctatttgcagtcattaggtaaaatcatttatactcatttattgtgatctttgttgaatccctcccttgttgcaatttaataatgacttgataaatttccatattgcttgtcaatagcaaaaggctttaattgtataaaaatgcaatttctatattatgttaactagaagaaggtatagtggacatttttatagttgtatactttttgataaacatttccctgtgttatttagaatttgtattagagccaaatggagccaggtccttgactaacaaggcaaagggaggtcacagtatggtaactattgcacagtataatgcttgaaaattattacagatttgtttacttttatctctttaaggatttgtaggttgagggcaatctttcttcctgatttttactgtgttacatccatactgttgaaagatgatcaccacaatcctgcaggcttgtctccacttagccttcctgaaaaaactgttatttttgtggagtacagtatgccaagtcagtggaggacccaaaggattttatggcagtagctgcaacgcaacatagcaatgatagatgtcataatgttggaaaacatagcatttcctgcttttttacatgccaaaattcatcatacttcttaaaatattcaccttgatgatctcttaacggtgcccctgaatattggtagagtttaatagtatatttaattttcataagtaatttgtgcaggtttgccctacgtgttctataattttgaattctgttagtgtccacataagatccatcaaaaattaaatttaaatctaatagcctttggatttacgagagttgagatagcgtcttgctaaagaatagaacaagttatggattgaatgcttgaaattacagttcaggtaagctttacaagaatattatttattctgcactaactgcagcaagtagaagccttccacattagcataagataacatggtggctcccagaaagcatagtagtctgatcatactagttcaaactaaaagtctgaatgactttctggctgaaatttatcagctttcagagtagtacatgggatgcaagctattttttccctcccttctccaaagtcaccattgagtgaataatctgggttactggtcttggggaaaaaaaaaaaccaaaaaacaacccaggaaagattatggattcttgattccatgcaagtcctttgaaatatttttcagcaacttgagagatttaaataaatgtcagtccattaatttgatgttcttgmttttatcagtataaatactgaataaaagataccaaaaaatgtttgtgaaacatttgaaagcacctaatattactttgttctgtgttctgaactgaattttagatgttttatctattttcagccgtgatacctatacattttttttaatgcagcttactttatgtttctttttctaaggagagctatgagacatggttcaaataaaaaatgagtagattctaatcccatagtttataatattgtattagcctatcatttagtaattaactgcttatattttttcagtcatagaaatgtgtggcatataaatagtatgaccatataatgttctatcaaactgggacactcttaagaaggaaaggtagtgctagtaataattacatcagaataccagtactgctgtcttggataaatgagaaaggatggtcaccctatataagatgtcacccagaactgatctttactccaagaattctcattaactctagctccctagcactgtcctttactttatttactttaatgatttatttgttgaatttttttctcttggcataaaatgtttgcaagcagactcgaactctgactgttcctgggctaatgttggtctaattgtctccagattgtatgttggctgattttctctctcctttaactccacccaatccttgtcctggtatttctcctatcagactttttttttttttttccaaagaatatttttggctgatagaacaaagccagttagcacagatgtgcagaaatcattactagagttcagatcacaaatatattttcaaaagcagttttggacttttctcatggactacagtgtttgtatttttctaagtatgcaggcatgatttttaaaataatgcgtatgtcatagatttataagaagaggtgttaagcagcctcctcttagaggcattcagatttatcaaacacaagacagatactttttttccttctcactcaatgcttcattttaggctgatccttttgtgtttgcattcattacctgtgcaccaacatgtctgttttattccaaacaacttaaacctacttaacccttacagccacaagagaggacattgagaatattcctggtgcaagttgcagggaagaatgttctatatatcctctgctattgtttcttttctctcgtgtgtggcataaatagctatctctaacttttaacttgaagttagccttccactctgccagagttatttctgttaaggggccagtgctttctgccatcttacttgccctttcctcagcatttggctgtgtgggtcatttgctccttgaaagactttccttttgtgttactatggttttttagtttcctttttttattggctgctgcttcacagtaatctttgtgggctctttttttacccaactctcaaggtttggaactgtaaactttttttattttctttctgcctaggtgactcatctataatttcatgcacagttcatatctatatgtcctgatgactctcaaatttatgttttcagtccagacttctcttctgagtctccagagtcacatatccaatagtctctttgacatctctgttttaacatttcaaacttaacatgtgcactgtggaactcagttcctctccctgttttacttccaaccaattttctacaactgtgttttttcctttccattgcttaagccagaaatcctgattcctgtctttcaacaagtgttgttgatactcttccccaaaattgtcttgaattggtccactcctctccgtctctgctgccacaaacctagtccatgccatcatcagttcttgccaggattgccatagctctttcctaatcagtgtctcagcttccccttttgcctccattgagtccatttttggtaccatggcaaggtatgaatgtaaattgaaatatatcacttctttatttgaaacacttttatgacttcttattacatttagtaattccttattatgacctggtcttttattatgaccttattatgattcctttccagcctcatcctgttccctctctacctccccacttgcttgcaactcttcagccagtggtctttttaaagttctttgagcccacctttcccccacctgcctcttttatgcctagaatgctcttaccccagtttctatagaggcggcgtcttctcatcatttaggccttgatgtaactaccatctccttctcggaccattttatctaaagtatatactaccattgcttttccatttcaaccatttgtttgtttctttcatagcacttactagagttcggattattttatgcatttattttcttctatttggtccatcttccccattaaggtctttggggacagaaactttgattctctcattccctactggattctcagcacctagcacaatacctggtgcacagttggtatgcagcaagtatttgttgaatgaataaatgaaaagtgtgagtctcactatgttcagttttatatgtttacatgttttcttttgagatattagcatatctagttttctaaatccagatcatcctatataaagaaattcaagagagatgcaagctttgttagtgagagagattaagattgcagactgaagagcataaataacagtaatatccccatctcaaattctaactttcaactccagttttgctccctacgtcacaccttggatatgaattcacatgatctacatcagtgcgatggctaggaaagtatatatttttgaagcaaatggagtaactagttaatgtcagtcactctgttgttttattagtgattcacattcttccatgatcccatagtttatattcggcttttcaactctttcacttttctcctgccaagcattttatgtctcaccctatccttaacatacacacacacacacacacacacacacacacccctacctgttttacagatactatccagttttatcatagaattgtgtctcaccctatccttaacacmcacacacacacacacacacacacacacacacacacacccctacctgttttacagatactatccaattttattatcatagaattgtgaatgacccctaaactttagtctggtcacataataccacttgattttcgcctcaattaccccgttactgtgttactacctctgtaccagcagcattgtgcatgtcttaagctcattgaagatatgatgaaccatgtgttattgtatcgcttattccaaattaattgctcaataaatggtgattagacaaatgtgaattaccatcctgtctctgtagaaaatcagaaaatgacatttcatgtaaaataaggttttgtattttatactttatcttgcagtatattctgtttactatatttttgtttccatgaaaagttaacactaatgatgattttcttatagcaaacttcttaggaatttaagatacaaggaaacaaattttgtgcatccatgtttcagatatgatcattctgtttcaaatgacaaagccctgatggtgctaactgaagaaccattgctttacattcctccacctccttgtcagcccctaattaayacaacagagtctctcaggtgagtgttgtagattattgcagaaacatctgagttggttcccatgtttagttttggaacctagacaagtaattggtcaagttcactaagtgactgagagaatctctgaattatttgtggataactgtaggcatattagttgtccagtttctccaccaacctcatggagatggtgatgggtctattttatgtgatagttgcttacttaaatatgtcttctttaaaaactacagaatgaaattaatattaaaatttcatggtgttaggcttacagttggtaacattcatagcagaaagtacctttttcttccaattaggaagataataatttgtgggtatgtgattctggagatactttaccgttagtacacacttctttatcaatttttcccttgaatttttttttcctgtgattttggaccttacccttaaaacctcaaaaactacctcagattttttgtgatatgtagtaatcaactacagttaaacatagtttaacatcttcacagctgctgtaaaaagtaagcaaaataagggaagttatatatgagctatgcttttatttcgtgtgttgaaaaatttgaatttttttttaccccaggcaattgagttcattctttttcttctcccaaaagagcatgattttcaagaggttttaatgcatctatttgttgttaggggtcctatgacttgttaagttctctacaatgtgtctcaaatgtttgtgtttatatagcccaagaacagaaataggaaatactttttattttgttttgttttattttattttatttttagacagggtcttgctctgttgctcaggctggtgtgcagtggctggatcatagctcaccgcttccccaaactcccaggctcaagtgatcctcttgccttcgcctcctgagtagctgggactacaggcacatgccaccatgcccagttaattttttaaaaaaattttctgtagagacagggtctcactgtgttgcgcaggctgatctcaaactcctgggctcaagcagtcttcccaccccagcctcccaaagtgctaggattacaggtgtaagccactgtgcctggcaaggaaatactttttttggtggaaaaaccttagcatccagtgtttatatttgggaggtatttagctgtagttttctttgaagtttgaatgcatggttgacaggtttaccatgtaaaaatgcatgtcttattaaaaacaacgttaagtgtcaactttttcaaatcaaaaagcaatattgagtcatcaggcacttggaatgctctttggaacctacaaatgattagattcatttccacccacagggtgaaacattcatttctatgtttaattaatttctatgtttaattaattaaactatattttawaggttaaatcatgaacttcgaggatgggttcatagacatgaagtagaaaggaccaagtcaagaagaatgacaaataatcaacagaaaacccgtattcttcaggtatgtttctgtttgtctttgaacaatagttggcgtatttgttggaaggcttctcccagctgggttactctcttccctagaaggttggtaaacttgagctttagcctcttcccactgtctcctgctgcttccgatgcagctatcattgccactgaagtcctcctcccaggttttatagcactagtttaggttttatagtattagtagttccctgatcaggcatcgtgctatttcttgctctcaccttcaaatttgctttcaagccaggagttcctatgcatggatatctatatcaaatgtctttgtcacaatggtataataaataatactgcttatctcctcttttcttagagcttttcaaaaagagaatgttaagacctggggcagtttggaaatgaagacatccatttctgaacttagacatttactactatggtttaatgacaggtcttacttagaatctgttaagtgggggttccatctcaatgttgtttgccacaaaacrccattaagtcattccgtcattcatcaaatatttgttgttagaatttagactagcaactggcatctgcaagttcccaataatgagccaaggactgttcttgatcctgaaataaagtaatgggtatgataaagtccctaccttaatggagcttacactctagtgcagagctaaacaataagcaaataaataaatacacaaatacactgaaaattagagctaagttctctaaagaaacacaaagcagcataggaggttagaatttgaattgagaaatgagtgactagactgagtggtcagggaaggcttctctgaagaagttccactttaagacaacattgttaaggtaattaatgctagctgttataacagccccaaaatctcagtagcttaatggaataaaattttttcacttgcacaaaatttgacttcactttctaggattgcttttctccaagcagggagtaagggatccaggttccttctattgtgtagccccaacaacttgaaattctttgcttcttgcttgagatgttagggaagaaagagtttggtggattgtgcaaaatgttttaagaatcaggcctggcttttagccaatgtttagttggctaaaactctgtcactttgcccaaactactgttagaaagactgggatcatgtatctttctgtgtgctcgagaagaagacaagggtttggtgagaacattgcttttgccataggcagaaaagtcactgaaataacaatgtaaagatttaggggaggctgggcgtggtggctcacgcctgtaatcccagcactttgggaagctgaggctggtggatcacgaggtcaggagatcaagaccatcctggctaacacagtgaaaccccatctctactaaaaaatacaaaaagttagccaggcgtggtggcgggtgcctgtagtcccagctacttgggaggctgaggcaggagaatggcatgaacttgggagacggagcttggagtgagccgagatcacgcagtccagcctgggtgacaaagcgagactccgtctaaaaaagaaaaaaaaaaagatttaggggaaaatctggagaaagagcttccagacagagggaacagcaaatgtaaagaccctcaggaaggaacatgaagaagctgagtacgactggaatgcaggggctgaggggagagtggtagatgagattggagaggcagcagatgtaggctcatagcaaacttcataggctttgatgagaactttgggtttcatcatgggtttgaggggatgccattgaaaggtttgagtaggggagtgacttgatatgatttatattttaaaaaattagtagttgctacataaagtggaccatggtggggagtatgactggaagtagggagacaagaagccattttagtgggctaggtgagagaaattgttgtggtccatactggtgtggtagtcgtgaaggtggcagaaagtacctggatgccaaatatattttgaaagtaaagctgatggaaattgttgatataatgataaatcctatgcttaggtactggatgattggtgataccatttactgagaccagtactggggaaggagcagttagaggtggaagtcaagaattttaagtatgttaagtttgttatggctattaggcattcaagtggagaagtcaagtggacaatcaaatatctgggtctggagtttaggagagaggttgaaactggaagtttaatttgtggtgctactagctagagagaaataaagaggaaagaaaacagagtgaggtaccaagttctgggccatctccaacattacaggttgaaagagaaagaggaaccagtacttgaaaaggaagaagagtagctggccagtaaaataggagaaattgtagggatagtggtgtcccaaaattcaagcaaagaaagtttttaaagaaggggatgtaacagttaattacaggggctaagagagctaagagatgctgattcagataaagagtgagaaattacttttggaattgaccatcagaacttgttagtgaccttcgtgaaagttctttcattggagtggtgatggcaaaagccaactgaagtggattcagggaagtaataatagagggggaagtgaagaaaattatttcagggtgatccctatacatgggaatagagaaatggagtagctacaggagtcaagaaagagttttatttttggatgggaaatatttcaccaggtttacatgtttacatgctaatggaaacatcttaaactatttaattatttcctgactaattggaagcagtatgtgttatgttctaaagtacattaaaaggataacaagaaacatgggtttttaaccattatggaactgttttcatacataaaatgagggctagtctaggtgagctcaaactctgacattctgaaattctgtaattatctactgtgtgcttctcttggcctctccaacttttttcacctactatagtaggcaactttattggttgttaatactaatagaggctgcagacagtcattaacaatgtcacatgtaccccaaagtcccaaagctgcttattggcattggtatgtggagcctagtacttcaaaaattcatgtctgccaaagcctacacgtcagctgctaccatggtcagaggaaaaatggaccctctctcccttctgctttccacatctgaagcaagtgcatcttattggcagaatctaaattatatccagagctctggtggcaaaatagtttgagcgatataggtttcaggcttccatcctttgctacacagaggaagagcacaggagtcaggaatagatcattgccagtaggtaatcccacacagctagtataattaacttaatgaaaaattagattaaaattcttgccctaaatgctttttttttggccttatcattagatggaacttgtcatgtttttctttcctagtcattaaatgaatagagcatttactgtgraaggggtgcttggtattctttawtcttaaaggaattccaatgcaagaaaaagaattttgttttaattttactgtctttgttcatttggagatgtgtagtttaaagtcttatttcattctgtgctattttgggtacacttctttctgtagggagcttagatatgctcagaaatgtgagaatcttagctactatagaagggaatgatggggaagaatctgtatttgtcagtagtatttgtcagtagtaaagaagttcctggttagaggaaggagaagaattattctgcttttatgctgttgtcaatgccaaagcatatcaagattttaaaaaaattctgtttcttrgtgtaaagagcctgtaactgctctcctttttcttttctcatttcaacctttttttcttccggttacctctttcagttgctaagagtatcccaaactcttataaaatattctgtaattttagtgaactgacatttctttgaaatatctgttgtatttaagcattatgtcttataaaatattctgtaattttagtgaactgatttctttgaaatatctgttgtatctaagcattatgtctttgatttgacttgtcctgtttcatagttctaccctcttcctagactttgagtttttagagaaggtaaaggggaaaattaatgaaatatctttcaaaatgaaggcaaaataaggacattttcacatagagaaaaccaagggaatttgtctccagaagacctgtgctataagaaatgctaaagatattttttaaaagacttgggtaaatgataccagatagaaccccagattagcaggaaggaagagcatcagaatgggcaaatatttgggtaaaaagaacaggactttttaaaaagaaactatatttatcttatgtgtgtgtatttaaatgtctttaaaagactattgtctttttaaagcaataataatggcaatttattatggggtttacagcttatatagaagtaaaatataagacaataagaacacaagggggggagggataaatggaataatactcttaataaaatttttatgttgttcgaataatatttcaagattgactgcagtaactgatatcaaagtataatctctagagcaactactaaaagctaacataaagaagtacagctagagccaggcacggtggcttgtgcctataatctcagctactagggaggctgtggcaggaagattgcttgagtccaggagtttgagaagctgcggtgagctgtgatcacatcattgctctcctgcctgggcaacaaagcaagaccctgtgtcttaaaaagaaaagaaaaaatatagctaaaaagacaatgtaagaaataaaaatggaatactaaaaaatatgcagttcagtgaaaagaagacaggaaaagagaaacacataaagaacaaatagaataaattaaaaatgcataccaagatggtagacttaaatccaaccatattagtagttaaattcagtgggctaaacacatcaattaaaaggaagaaattttcaaactagatttttttaaaaaggaaagatccaactatataktgtttataagaaataacactttaaatatgaagacactgacagatggaaaataaaggtgaaaaaggatgtatgccatgcaaacatgaagcattaaaaagctgacatggctatattaatcagaaaaagtagacttccaaacaaagattattctaagagacaacaaaagaaattttttattgataaaaggagcatacaaggaagataaaacaattctaaatgtctaggcccctaataacaaagcttcaacgtacacaaagcaaaaagtgacagaacttgagaaaaagatctacagcataactggagattttaacatcctctcatttctgtgtaaatgcctctcacatttttgtcaattatgatcttttgctaaacccatacagctgaaaatgcaaaagctcatgactagtttttcagaggttccttagttaattggtataaatcttggataggtaaacggaatatctgttttctgtttgcctgatatctctgtaacttggcttttcctaaggcctacccattgctttctgagackagggaaataagtctggcttctttcaaacttctttgctcatttcatatgggccaaagtagcactaatcatttaaaattcaccagttaatctgttcattttcaaccttatatttatcaactagctataatttagttttggttttatttactacttactggataactatgccagtaagtatagtattttattatttaactgtgttcttcttttcattttattggtgatttttttcatttgttgttaaacagagcatttattgaacacctacaatatacaagacccacattagatttttataaaatgagatccttgacttgttacagagccagaagtgggaacccctatattcatctctgcatattggttccatccaccaaacaaaattgtttccttttcttttctcccttaaacttctgtacatgcttctgttttagcgcttatcgcattgtattgttttcctatatctgtcttcccagttaractgcgagcttcttaaaggcagaagtcaaatatttaattttgtagcttgggcacatgtaggtgctttgattactgaaagatggatatatggacacagtaatgaacaaatgattaaaaaattatttaaaccattgtttgacagggtaagattactttctaatgaaatagaacttggtartatgcccttgaagtctgataccctgacaaaccgcttctgaaaatcagcttacataactaccagggagaataaaaaggcatagtgcaaagcaaatgctgtgtgaaagacaggtttccagtgtagcatatgtgggccactaatgggtgtagattgaactgttctcttgccaagagtcatcaataagaactctttaatgatggcttagttcatagatgtattttggcatgaagatctctgtgtttaactcagtaaacaataggatctagtttcattatggacttttcatacttcttaggaacttgtcattgggaagataattattttagacaagcagacattgttatatgttcagtaacacttatatagcttggtcataaaatttgtggtgcttggactagcttttgggctctttctttaaacttaatggaaagtgccttaaatgccttaatctccataagacacttctcccagactagaatggacctaaagagttctaatatctgtcagtgtttaattatttgaactgaatatgtcagaaatcttagcaatggaagtttaacaaatttaagtatagaatgaaccagtataggaagatttcatataattttgtgatacagtattaaactttttttttttttaatattccagggtgctctggaacagggctcaaattctcagctgatggctgttcaatacacagaaaccactagtagtatcaggtaagacagtgcagaagctcttggccaaggaatttaaaatagctggtattttaagaaagttgaaattcacacttccctttcaccttaaatttgttctcatctatgagttttatattagtcatatactctaagatatatatatatatgtatatatatatataacatactactgagcagttggaataaagccagataatttcaaaagttcaactctcccaaatcccttaaatacaaatttagtcagaatgctgttccatcataattttgatgaaaatcttgaatacccatagctttcttgcccttgatttgcatctgtttcatgaacctagggaagggaatgttattttttgagtgctctgtaccaggtgtcctgctgagtgttttacatgtattttatctttaaatccatgtaataactaaaagtttattttatatatagaaaaactggtcaaatcatttattttttttgtaattttcagagtcataagacctagtggtagactcagaattcagatcatagctgttttacttacaatgcatttttcactacacaataatacttaagattttgaaagatttcaaagagaatgctgtatctacaggtttaaatgtcttcaaagggaaatataatatgggaagcaatatggtgtcatggttaagatgctagctttatttgccctgttgggcagagttcaaattataactctacctcttactttgtgggctcaagcagattacatgcmattgaagttttctcatctacaaaatgctggctgcacagagttgatataatggttaaattagataatatatttagagcacttagcayggtacataagtgccccccaaaatggtaaatgrtaatgatgtgatgtcattgacaacagtatcactgaagtgaaatttgaggatctcagcttctatctgtagctctaccacacatttgcagttcacttatatgaatttaacatttacttagaatatactgtgtgccagtgttctaggcactgagaaaaaaatatagatagatagatagatagtaaaaatgaagtcaaaagctattttattcattatactaataactgagaattcctattaaatgacaatgagcagcatatcagcaatcatgaatgtttaaaatcctgagattgtattatcctgttgaaattgataattcaaatatgtttaaataataactaatcattctctgctaaccagaatatatcattcaattacatttattttaaaaatatatcaatttttggatgcatggttataatggcatggtatttcttcattagttaaaatgttttagtgaattacagccaattttcattatttgtggattccatatttgctaattcacctactaaaatctgctaaaatgtatttgtaacccctaatattagcagtgcttttgtcatcatttgcaaacatgcgtagatgctccctggtgaggttgaacaaggcagtgttctgccttttagtctcagctatataaacaaggtccttttcacagtccacatttttcatatttttgtgctttttgttggtaattttgctgtttgaaatggccccgaggcatattgctgaattgctgtctagtgttgctaagccgaagcgggctgtgatgtgctgtgtggagaaactacgtatgttagataagtttcattcaggcatgatttatagtgcagttggctgtgagttcaagttagtgaatgaataatatatgttaaagaaggtatctctaaacagaaacacataaataaggttatatatttatcacttaacagaaatattgtaaccagaggcttgcaggaacctaaccctrtatttcccccaggaggatggtttaggattcactaattcattgctggcagtgactttttagaacataactatcacaaaatagcaagaagcgactatatattcaaaatattgtaatcagaaatggcctagtgaacaaatggagttatttcaaaggaaattcttatgactcatttattacttccatttaggtcagtctttttctcctcttaataatatttgattgatacatacaagttttctctttgaggaaaaatgaagcatttttacaggatccctttaactcttccagatattggtcctaaaccctagaaaatcctgaacacattaagaactctattagaatcatttgactgtattttttggggcatgatgtggtttgaggtattatcattttagtttttaattttagtaaggcacatacatggtacttttaatatcaatgactagcagttgttgagtgactcctatgggacaggatccatgcttggcacttgacwtataacatctccagtaacagtcctacaagggttgtgtggttatactctttttattgaggaggaaacagtttgttcatggagggcaatttccccaggagtgcccacttgagaagtgaagcaggaattctaaaccaagtctgcttgttttcaagtcctaagctttttccacctttttgcacagcctcgtaggcaagcataccttcatatattcgacagggtggtgaaaaatgacttttcctcagatttaatttgtattactaaaaaaattaaaaatcgttcaaacctatgcagaaatctctctattttctgatactttcattatttttacatgctttgcaatgtacttgaccatctagtacattttagagccttgattcagaaatcagaattttagcataagtgaatgggttcttataaaatatcctgatccttgggctttacaaaataktgttataaaaattactgccaaagtgcaactaatattttggttgagagagattcttagaattcagacatagccttagaatgggaagtattttgggaaaacaggaaactttttattttagtaataccttatatttttcttactttagcaggaactcagggagtgagctacaagtgtattatgcttcacccagaagttatcaagacttttttgaagccatccgcagaaggggagacacattttatgttgtgtcatttcgaagggtaagttcatcttgaaagaatagagcaaatatttttgagtgcttgccgtacacaagacattgggctgaatattgtggaaaatacaaagatgtgagaaataggaagcaatataaaataaattatgtgagtggaacagtctaagtactgtaatatatgctttactttgagctgttgagtattataaagatgaacatggaattggtgtcagactatgagtttgtatttaggaaatataaactacttgttgatttttattgtttgtaatcctgatagccatgctgtttataaaaaaaggaaaagtaaaaacataaaaatattctatttaggcttttcctatttaggcttttaaaccaattcccatttggttattgagaaacagacttctgaaatgtaggtttgagatggatcatgggctgattattaattgtggaatgtttggatctatgttcctaagaatctctattcctcttttatctcttcttaattaaacatttggttggtgaagaatgtgttagataatcagttagcttatgtaaaagtaaatgtttatactagcacttttgaatgttatgaatgttaggctaaatggaaaaaatgcatagctgtttatatttcatctactttttctataaaatgaaaatattttcttcatagaattgccatgtgaatatctctgttagagtgctgtaggttaacccaggagcacatgaatgaattagaattcctcagtggtggtttctatcccaagctgttttttctttctttctctctgtttttaaacaagagaagggacctcactgtgttgcccaggctggactcaaacccctgggctcaagtgatactgagtagctggctttcttttttttttttaagaatacactgggtatggttagaagtaagtacagttgacccttgaacaacacaagtttgaatgaagcaggtccatttatatgtggatttttctcaaccttagcaggatgccaaacccacttatatgcagggccaacttttcacacatgtagattccacagagctaactgtgggacttgagtatgtacagatttggagttatacaggcggctctgtaaccagtcctccacatatacagagggatgagtgtctatactaacaatagaatgagcaaattcattctctgattattaccactcactgtcactgaaattctcagttaactagttaattcttttcctaaggtataaatatctagcagctcaggtttttaggaccagagaactttgatacttgaaaactagggagatcaaacatcttatatattttcagttattaatcaaacatgctaagagatttggaacactttagccrtagcgtctcatgatcactgccttttcacaaaattccctgtgttcaccttactctatcagacataactggtatgtttctgtacaggaccagcctcaaagtttcttttcagcagcaagggggcagctgagaacaawgtttcctgcaaggctccaactgtactggtctatgaaaacaaagtatttcccttactattgacacaattatgttcaaagtaggagaaaaaaagtaaacttttaagaagattcagtactatgaagaagaaacctgctgggtgttaaaatgattgtgttgaagtatattttatggaagttactgtaggagaatgtttttaacaytcaaatagacagtttttctgaggttcaggataattactgtattatttgatcaaaacagtataacagatattagaagtaacacttgtcaagccatggattgaagtcatggttagtaatgtttttctaagggaagagaacaagtattttttatagagaagacaatcctagcttttttttttttcttttgagatggattctctctctgttgcccaggctggagtgcagtggtgccaycttggcttactacaacctccacctcccaggttcaagtgattctcttgcctcagcctcctgaatagctgggactatagccgcatgccaccatgcctggctaatttttgtgtttttagtagagacggggtttcaccatgttggccaggatggtctccatctcctgaccttgtgatccacccgcctcggcctcccagagtgctggaattacaggcatgagccaccgcgcccaaccaatcctagctttaaacagactgtatttttataaaagacagtgaatggcggtttaaaaaatatatatgcattgcatttttttgcatttgtaaaaagtgatttctcattagtttgctataaaagtgctgttagaaaattattgatttccactcctccctagtcccttgatgttcattcaggaagactgttaggactggctctcacacaattactattaggagtatgtctaacattctgtttcgatttttcattttcaaattactgatttatcacattttggtgttttatatcaaggaagagtaaagacaaatgaactgaattagataatagtaattaagataacatcctttttattttttttgttttgtttcaatagtagggaaaaggaagttaattttatcttgatgactgtaaactatgttatgggacaggaattttgttctttaatacctggattgttctttttgctcttgctgaaatgaaaatgaaataataaattacctcatgcttggtcttctttcatctttcaatataaaatattctaacagtttcattaaaaaggtgagtggcatcatttcttgtgcagaaggatgtagactttttctcccacttaggttcttaattttattggcagaaattattataattgatactacattggaaattcagaagaagattccagagccccaggtttcggcttagcatgaaccagacatttataacaaagccaataagcaagctatgttattttattttatgaatggacatgtatttaacaaaatattttaatatctaaagatgtagaagtagccattgactgtttcgtactgttatttaagccactctctcccaaacttacactccctcacaccctgcattcctgtaccttttaatctctttacagttgagcggttgaaattattttctctaaagcagacacactcttggataactactgagttcctgttatagctcagcaagaaaaaatgcttatgatcccagtactccagacaaaggtccaaagtgcttctgttcttttgactctccttaaagagtttttaccaccaacatagtaatctattcggctttctttgcttagttccagttatttgtagcttattttcctgtaaatactttgcctttttctcctctctttgatttgtttgttttagtatgatttggagagggaggttggagaataactttttctcaaacttccaagtcactttgagtgtagaataactgatacattaataagaaaaaaatccaattaagtttaatgccttttttgtttgtttgtttgtttgttttaagagacaaggtctctgttgcccaggatggagtgcagtggtacaattatagttcacttcagcctccaactcctgagctcaaacagttctcctgtgtcagtctccagagtatctgggactacaggagagtgccaccacatccagctaatttttatttattttttgtagagatggggtctcactttgttgcccaggcttgtcttgaactcctggactcaataatgcttattttaaaaatacttttgtggccaggcgcggtgactcacgcctgtaatcccagcacgttkggaggccgaggcgggtggatcacgaggtcaggagattgagaccatcctggctaacacggtgaaaccccgtctctactaaaaatacaaaaaaattagccgggcgtggtggtgggcacctgtagtcccagctactcaggaggctgaggygggagaatggcgtgaacctgggagacggagcttgcagtgagccgagatcgcgccactgcactccagcctgggtgacagagtgagactccatctcaaaaaaaaaatgcttttgtatgatagtctatttagggagggagggaggaggttgattaaataatataacaaaattaattcaagagctaagacagaaacaaatactcaggaaagctcaaataaagttaagaagaagatgattttaaaagggcagaaaagaaacattgagaagaaagattgggaaatgatattaatttattatttcaatacacatttaaataccatccttacatgtagctgtctcatccactaatatataaggaaagaatttcttcctggggcagtttttcattaaaaacaggttctctttgaatcagatggctgtgaatgtcagtttgccatattatctctacttgtttaatatttttcttttgcaaatgagatggatgcctactttgggaacattttttatttctattacattttctgttttcagtacctgtctcaaattgtaagtaaacacgtaaagtgtcttttcatcagtttcaaatacatacataatattacagaagaatctgagctatagccatatgactgcctgagagatgtctctttctcctctctttccaagtattttatatattctagcaatagtaccatatttgggtatgcaccccttactggtcccttataaaaattattaacactgtcatatatacggcatggattataagggtagccttaagtaatagggacttattgtaagttatgtgagattaaagaagcacaggaaactggctcagaatccaaataatccctctgtgcttgtgcttcattgggtggaatgtatactagtcttcatggagaattggaatagtggtttattgtcatttctgatttgacagcagctccagtgattccactttagtcttttttttacactttactgattcatactcctcaaacacaaagatctgattgggtagttctggtcaccatctcttacgcagagaattactatggcagctttggcttatgatccacagttattcatttgtgacaagagaaaaacctggggccactcttctgagaaaatgactttggyaggcactgggagcttcataaactactataccacacagcctgttttttttaattattattcttttttccccgttcttagtaagtgtgcattaaattctttcttgtattggttcctaattgtttgatctaaaaggcccatcttctcatctatatgataagccttttgaaggcaggaaatatcgtatgcttttgtgactacccctgacactcagcaatgcctaccactgagtgcttactgaacagaatggttttagacatgagccattgagagaagtcacagtgatggaagtttgttgtttttcataatcatttaaaaggtttttttttttacattgttttgcttaaagaaattggaatctattttactgatctaagaagtaatataagctgtgctgaatgccagtagaaagtttagttaaagatgatctctgttttgtccatttatgatttgcactagccagatatcatcagcttattcttgtctctgaatctaagctgtagagctaaataattcacctgagtgtagtgtttaacagctttctatgtcagtaagtagaactttgagatacttgcatcttcatttaaaattatttgttggcagcattttggagtagattgttgttagacctcactgatttcttttttggagaagggatgggttctactatttgtacagattcaagcagtaggagccagaaacttgaaactttggaaacactgtaggaaatactgtgattattgcaaaaaaaaaggttgactagtggtgttatttgttcaaaatgtttgccagaggtttagtcccacggatgggcataaaaacgaatttcaaaaatagcaatgatattttctaacttaatacctagattaatacctaacacatgaagaatggcatattttcttaatgcctgttatttatttcttagaaatttatgtttagtttatatgcatatataaaaattcaacatatgtatatatataaaaattcaattgtatgtatatatataaaatcttcagaggcaggaggaatttctttagtatcaaaggaaattcatttataaagtctacttcaaaagggtacagctccttcttttgtttctgagacctcaaaacttgagtgtacacatagatgttggagtttggccattttcttatctccactttcatggcctttgagccaaattctagctggaaaaaaaagtgaatagatgagtttggaaagatacttgcattttagaaaagggtcttatctcagaagagagatgttttaaaaaaccttcttttagaaggctttttaaaattaatttttagctttaaaatatattctcattcaggtctaaagcacattataaaaaaatagagcagagttgactgagtaccctaggttaataaacttaacctagatttatttaatcattatgccaataatgttctttttatatgtccattttctatttcactttattrtatacaaatattaacacttcaatgtatactacctttgtagtttacaaacctctttcacatacataatcttagcaattccttacatataatcacaagtattcttagtcctattttatggctgaaaaagctgaagcaaagagagattaagtagcttatctaaggacacaaaaatggtaagcattagaactagggcaataattgatagattctaatttaatacagtgatttttttttctttacattgtkgtgcttttttctttatatctggcacttttagatgtattacagcatatgtaaataaattaatctaaccctccaaaatcaagatatttcattgaaaaatctgctggacagttttggcagattcattacacaacttcaaaaattgtttgtttgttaattacctgattatgtttgtttgttaattacctgttaattataattatagattaagtactttaatagattatgctttcataatgctggagaataacttaatggtttgaaatattatagtatagcttcagatttcaagtcagggaatagaataaataggccttgaaagtttctggtttctttttaaaacagtgtctgaaatttccaacatggtggaaaagaaatgtctttgctttgtcttaaaaaggaagtagtttagcaaaaacagaagctgttttaattattggtattctagagcttctcatagaaaagagtggggtttttgtgtgtgtaaatacattttattatggattctgtatatggcgtgctagatctttgagatcagaagcatttgatctcaaactccttgttaaatgtgagttactgttgtgtggttttagaggattcaactatttgttctttgtctctataacattgctagctaacataaaaacatgttttttacttacacttttcaatcacaaagtctaaaataacttgctttatgtttgagaaaagattgttcagtagtctgtaagtagacttgtatatagccacaaacagagaacttataactcaagaataatacgaagtcttcaaaattctcagaatggtgggcagatccatctgagtcatgataatttttcaatggttcttatttgtttgctctatttggtagtcttattattatgaaatgtgtttttcatatgcatttgtttaatctccccttttcaggttgtatgctttctctgtgcagggataaagtctattcattctgttttgtcttttacaagatctattgcaatgcattgcaggctcggcagagtaagtcctaaataaatgttgactactcagaccactaactgtttatttgtgttgtttacccttattttttatgtcctactcttcaaaagattactagaggtggggtttgcagaaacaaaggaggacatttttctcaatgaatgtttaaaattacttcggtgacttggatagcaatgaaatttttaagaatatatagtcagctttggtgtgggtggactttttgctgtggaatagaataattcctgaaagacttctaaagttactttgaaaaaaggcaggaattagggtgggaggtgggagaggagcagaaaaaataactattgagtaaccaggcttactatctgggtgaccaaataatccatacaacaaacccccgtgacatgagtttacctataaaacaaacatgcacatgtacccctgaacttaaaataaaagttaaaaaagaagaaaggtaggatttaatgattgatagcttaaagttctcatcaaattttttgtaatgagggaagaaaatatttccccaaagcagaactgcattcccagaaagaacatttcttcacatcatgaatatgtgaggaaaaaatgtattttaaacaactgataggtacagaccctaggaacctgcattctagccccaatgttgccactcagtgacatctgctatgtgactttagacaaatcacttagtccctctcatcttcagtttccttatatgttaagtgataaagttaatgtagatttgcttttttccttctggctccagaaatctatagtttttatctgtgtgtttgtgtgtgtgtgtgctttcctcttagaaagctgtagtattgctttaaactctttgaagttactaagtgattcaatctagtggagtcagtgtattttaagagttttgaaaaacagccataacaaaaacaacaaaatgtgaagttacaaggtggggctataaattaatgagtttgttttttgaatagctggcagttttgtaatttatttaataacacttatacagaacacaatacgataatctttaatctttataattgagataggtgcagttatcatcattttacagatgaagaacctgaggcagtcgtgtccattgtgaactccaataagaaagattaaaaagaaggaagaaaaagtccgctgtagaaatgaaaaaacaaatttatccattgtgacatcrtttagaaatagcagtcagaatttaaccaagaaagtctggctctatgttcttgatcatttccctctattgcctgtttaagatatccaaatatcatatctttgaaggtagtcaacttggagtttaattccgttgatctctcttttcaaaacatattttgagttgtttcrggatcattttccagagactaagacaaagccctgtggaaaaccaagccacatgttactcaaagtaatagtgtaggaggaacaagagccagcagggaaacacagaggaaattattagaaatataggagaattggaagagtacagatgaaggaaaataaatcaacttgtttatgttattttaaaacctagaggtcaaggaagagttcagaaaacgaggctgtcagtggtatcagatgttatagcgctccctaagaatgagaaatgaaagaaactcatttgtcttgtgtaaacattaaaatcattggtaacttgagattacatttattgtagagtaatcagaacagaatccagaaaagagatagaagagaatgggaaagaaaaacaatggtttggtaaatctgacactggaaggaaatggagatagcctagatatagataaggagaagagaactaagagtgtgtatgtatgtgtttgtgttaaggacaggagagatatagggatagggtataaggtaaataaggactattgtagttagtttatatacatataagaatagagtttatgttttatgcttgacagatgttctaaaggaaaataaacaagtcattgttcctcctctgtattgttttctgtttaaagtaaaagcatggagaaagttgaacagtttttgtttatttgcagtaggactacagaaaagaaaaataaaagagcgtatggaattaaaaccagatttttgaaaaatcaaatcatatttaaagtactgcttgagatatcaaaagtcttttaaatcttaaatacagagctggtttttaataatggtaaagagttttcaaaatgttaaagtttatagaactatttctcatttaattatatgtaaatggttttataattttttctcacattaagttagaaaactagcaaagtaacctacataaaatttggtataacctttcttatgatgtcacaaaacttaattatggaggaagcaattattataattaggaaaaattgatgacttatgatctgactcaggatcaaggtctgaaacactcatgtcatttcctcccctctcctatatagtatacagtgatttgttcattttggactcttaatattttaacttttgacaccatcagcaaatctaaacactgacagttggtgttttcctgaaaaatgttaaggctaataattgtgtgatatttatttcaacacattgctgctagtcttctataaagatctcattatgggtaggctttgaagagatatccagttcataatatgggcatcacactggaagcctgcaagatggatgattggctgagagtaggagtgtagtttctaaataataataagtctgtttcccctgctaggaagtaccctgagggcaggaaccctctatcttagtcatgactttgttcccaatacatggtatatcaggcatgtagcaggtattcaataaacattgaatgaataaatgaacaaattaattagataccaaatccatcagtttgacactatattctaaattagtttatatagtcaccgtaatgtgataaagaaattgtgatagtctagtttactgagcattgttatcaggaccatctgtgtctcatgtttaagtctagaaatcagtctttgaaaatgagtgaattcaaatgcatttttaaaagtctaagtgccattttgcatgagggaaattatatacctagtaagaatttctctgggtttcaaagtcagaacactgatcttggtaatacatggacagaaaggattatttttcagttagggtgttaaacagattgtgctatcattttaacctctggaatgaataagccccagatttaataagctccttatgtataagatgcctgttataatgtgtctgtaatgtcctagaaagatgagactacccctgcatagtgcttatttcttgcatggaatgaatttaagataagcttgtcaaattttaaatctgacatagactatcttttgaataatttatttggagtcatctctgtctgattataatatgccctaaaataaatcttgaaaaattaaaatatatcatacagaataaacagtctacatgtaacagttaacagttacatgtaaagtgttattcagattacattttacaactatttcttttctgattccattttttattgaatagaagttcaataaattttattctgttaagaatgagtctgtcttggagagggtcagtgtcacatatttactttgaagttccttaaagaggttagttgaattctccccccaaaatgtgctttgaattagcagcttttgaatatctattctagtagaggtaggagcaatatgaactagagagaatgatatgcaataaaaataataatttttctttgactttggaatgaggataatctaaaccacagccatgtaggcagacattttctgatgtatgtaggtatgtttgcatgtctgtctatctatccatctccttgttttctatatatttgaccctaacctttcaggctcctattttgccatcaggtccaaaaccaaactgagcgataagagagtggagatccttaaatcagtggttctcaaactttttggtttccacattcctttatgttttcaaagaaacattaatgagaagagtagcattttgttaacattaagaaaaacctctttaataactggcttaatagaaaccagctggattcttatatctgttctttttggtcaaaatatatgaagaaaatccagcctcacacagagatgtaattggaaaggaaggactattttaaaagcctttcagataattgtgggtattctttgatgctacaccaaaatgcaacaagaggtagtttcttaaaggttagttgcaacacggaagccaaatctgtgaacttttagtactctgaaattaaaatccattggttgatcttgcactttgaatggatcttttacctgtgcaaggttttgttacatcatacattggtcatttgaaaatactggttcactgagttatgcagatcttccaaatgttgacacattttattatgtattaaaatgtcacattctttaatactatcacaaatcttatcagaaaagtctttaaatattgtgagcagttcatggtagcagatagaagttttccaaaattctagttttcacttgagggttcaaattttatcattgtcaaaaatatgtcagttttccttgaagtggtagattcactaatttattttcaagaacatatctgtcagatacccaaggctaaacaactataatttatcagtctttcaagtaaaagtggtgttccatgaagaaagtagctagtgcagctcacaactcagttacacaagtggttttcctctagacaacaattgtactttgatatgcagcagaaatgctttatgtgtatttcccattttgtcgtacagaatattaaaaagacttctactcaagggtcaagatttcataaaattaataacttttattgcttcatcaaagacttccttcaattacattgactgtgtgtggtatgtgcatgtatatgaacatagggcagtaatatgatgaactatataatacagtttgatgttgctgtcttaattcatgctagggcaccatcattgcttttgcatcatcagtgtaaatatcaacacagttgtttcaagataaatgatgagatttaagaaagttattcaacactgaatatttcagtactgttagtgtttgttgccaagcattcctataaaaggtctttgttgttgattacttggggctcatactgaataaatctaagcaaaacataaagtttatagattcttccatttgtaaaacaaaagcacaattctgtagttgagatattaactcagccttcgtatttgcaactaagtgtaatttgatgaattaacatatggttggaaagtgtcatgatttcttatactgacttttcagcaggcattgagcaaggtcgattatccacaattttattagtctctcagctattatatgcactttttcagtcattgcattatattaataacttacaatgtaggatacttccgtggtcttttcatttccagtatgataagctgtaatagaatttttttttagaggattcttcacacctgtgtttaaaatatccagttccattttctttgaactctacatgattggtttcagaatgacatcacaacttaattggcaccattatagtatttgaaagattttgttgcataagcgacaagaagatagattattcatatgtctgaaacaagagaaagatggctttcaatgtatggtcattttttattaacaattttgaccagtttctttgctagattccacctttccgtgagtcataaaattctcaaatatatcagttttatcttttctgtatcttatatgtagacagtatagttgtgggttaaggaggcaagttttctaatctcctgtcttttaagccagcaattcattcttaaatataagaaaagtatgtaatagatttttatatgaaatattaaaatttaagaagctgtagatagatttagaaaacttttccaaaaagatttaaaaataatattataaaacaaaacaaagtatacattcttctttgttgtatttagatagaagtttcagtagtggagtccatataactaagctccataataatgtgtttcataactttctccattattctactactagatcatagaaggcttgtttctcttaaggtttagttttttcatgcactcagaaaatagtttttcaggaagtatgtactgagtattctgaggatatgcaaggagcatgggttccagtgataaataatacatagtctctgtgctcagggaacttatagtttagttggtgctaaccagataaattagcaaaataattgacagatatagtaagcatgatgaaaacacacaatggactcagagaataacaaggatgctctcctgagacagcgacatttagctgatatctcaaacatggggggaattcaaggattccaggcagaggaaagagcatatgaaggcagttaagtaaggcaggaaagagctttatttgaggcactgaaagaaaaccaatgtgacaggagactagtgaatgggaagggggatgagtaatgaaaatgaggtttgggagattggaaggggctagttctacaaagccttatgagctatagtaagtagtttgggttttattctgagggccagcaaagggatttaagcagcagaataacacgaatgatttagttcgtagaagatgttcactgctacatggacaatgcattagagagagacctattaacagtaggagcagagagagcagagataccaattagaaggctttttcagtagctccggcaaaatgatgatggcagcaaagtgatgaatggattctaaatacattttgtggatagatttagtgagaattggagagatattagatgtgttcagatttctgtcttgaattactaggtagaaaggactatcattttttactaagatgaaaatatttggggggcacggtaatatgtttggtataaatgtggagagttatttttggatacatttaaatttgaaatgtctgtgagacattcaagggaatgtgtgcaattggctctgtgaatctgggactcaagagaggatagatctgagctaagaagagtaattaagaattgtcagctcatacacatttatttatttatttggagacgagtcttattccatctcccaggctggagtgcaatggtgtgatctcagccccctgcaacctctgcctcctgggttcagatgatcctcctgcctcagcctcctgagaagctgggattacaagtgtttgccaccacacctgactaatttttgtatgttttagtagagatagggtttcaccatgttggccaagctggtcttgaactcccaacctcaagtgatccacccacctcagcctcccaaagtgttgtgattataggcatgagccatcacacccggtcagcttacacacattatctcatggatttacatgggaataatggagtcatcaagaagagagtatatagagagaggagggttcaggaccaaattagattttgaattggagaaggatgagagcagcaaaggacggttcaggaccaaattagattttgaattggagaaggatgagagcagcaaaggaggagggttcaggaccaaattagattttgaattggagaaggatgagagcagcaaaggagactaaataggagcggtcagcaaatagggagaaaaccaagagaagagacttttgaatggggaaggagtggtttattcttgaatactgttgagacgttagataagatgaaggattggttttcactggatatgtcaacatgaaagtcactgatacacttgacaagagccttttagtgatgacatgaaacataaaagttaaagatggattaagtagtaaggaagtgagaacagcataactatttaaaaatgtttgcctataaaagaaaatagagaaaaggtagggttttgtcttattttcaaactctagatatcaattatatattttaaaggaatgaacccatagataggaagaaagcaatgttaaaagagaagtcgagtccttgagaaggggcaaaagggtggaattcagataacaggtggaaggatggccctttgctagtaaggcaggacattatggtagargcaagatgagttcatagataggaccttaggttccaggaagataaagagaagacacttctaacagtttctgttttcccagtgaaggacatctcaactgatgtcatcagctgaaagtaaggatattagaggaggtgtagaagatttaagcagagaggcacaagtatgaagtagttgtcttggccagtgggatagtgagcctactagagacatttggattgtgaggccttggtggggtgtcagtatgccgtatgctttaaagtcaaatctctgcaacaraatgccaggtgtagagttacagttgattaataagacacagcccctgtactcaaggagtttgtaatctagagaatgaaagacatataattacaatatggtgtgatggttgtgatgaacaaggtaaatatagggtgtcataagagcacacattaaccaatcttggaggggctgtcctatgcaaggaggtcttcatggagacctaacagctaagctaagacctgcctgttctgcaagtaccttacttaaagctattacataatagctgctggggatgaaaatattctagaaggtatgatagtcacactgtattattatatctttatgcagtagcttttatttctgctgacatcatcaggcatctttgaaatttcttttttttttaacacttcgaaatgctgtgaagcaaagtatcatccctctctttcctcaccctcttctcttccttaacacctttcttcagttctagctgttggcagctagatgcaacttaataatgccattttgttttcatttggcatgtcattcatcattttcaaaataaataaactttaattttgtgctgccacaatcaggaatatttgaacatttagtgcttatcttgggtatctgcccttattactttctgaggagctgccctttatagcaatcagggaactataccacttggaagactaattgtctttatacaaaaataaaatccttgtgttcagatttctgtcttgagtggctggtttgaatctaattttctgttatatgaagcaaagatttattatttaacatagtttcaaaattaaaattgatagtgaaattttatgtgccatgcaatgtcatgtgtgttcttttaaggtgaagattcattttttaatagctttattgaggtataattgacmtataataaactgcacatatttaacaccacattttatgtgtgatatgtakgtgtgtgtgtgtgtgtgtgtgtatatatgtatatacttatataggtgaaatcatcaccatagtcaaaataatcagcatccccatcagtcccaaaagttttgtttctcatgcccctttgtaatttttccctgccctctcaccagtcaactgatctttctgttactacaaattagtttatagttttaaaaattgtatataaagggatcttaattatatatattttccttccagcagaattattttgagattaatccatggtgttgcttgtatcagtagttcgtctttactgctaatattctggtgtagggatatagcacaatttactaatatattcaccttctactgttagctactacaaacaaagcaactgtgactatttgtgtacaagtctttgtagggacaaatgcactcacttcccttgtgtaaatacctaggagtgggatggctgggttatatagtaggcatatgtttagctttttaagaaactaccaaactactttggtacaagtggttgtaccattttacattcccaccagtgggaataagagttgcagtgcctccatatccttggcaacacttgatacagcctatctttttatttttagccattctaatagaggtatgtagtggtatctcattgtggttttaatttgcatttccctaataactatattaattttgaccaactttttatgtgcttatttgccatccataaatcttctttggtgaagggtctgttcaaatctttcccgattttttattgagttattttctaatgattgagatttcattttgaggattttgtgtgtgtgttgttttgtttagcagcttagaacacacacatttattatctcacagttactatgggtcaggagtccaggcatagatttgctgggtcttctactccagggtttcatctgaaagtaacaatcacagtcttggccagggctgcagttgcatctcaaggttttactggggaaggttccactcataagttcacatgattgttggtagaattcagctcctcgtgggatgccgaactaagggtctcagttatttgctcagttggagattcccctcagttcctgccacatgggcctcttgatatggcagctcacaacatgacaacttgcttcatgaaagccagcatggaagtgtttatgtttactggtttattatgattaacaaaggatacagatgaatagcccgatggaagagatgcatagggcaagctatgtggaaggggtatggagcttccataccctctccaagtaggctaccttccaggcacctcctcatgttcagcaatctggaagctttgcgagttctttatgtattctatatacaagtcctttatcaaatacatgacttgtaaatattttctcccagttttttgcttgtatttaaatttcctttttagtgtttttcaaagggcagaaattcttaattttgatgaagtccaatatgtcagctttttattttatggactgtgtttttatggttttaagaaatatttgcctaactaaaggtcacaaatattttctcatattttttttcttaaagtcttacaattttaggttttacatttaggtgtatgatccattttgaattaatttctgtatatgtgcaaggtgtatatcaaagttcattttgtgtgtgtggatatccagtattgtatgatattcaatgctgtgttttcacctaatagcttttaaaggaagaattaaagcaaagccaagttaaataggttataccagactgttagttttctttgtgttatccttgactttgttaggttgcacattttgctggaacttcttaaaacagtatcctatgattgaacttcttcaacctcaaatttccagtctttatacttaaccaatgaaatgttatttatatactctttggaaacataacatatactgtagataattatarcaaaagtgtaatgggtagcagaagatattgccaaaccaaaattctggagaccagatgagacaaacacataatatgtgcctgtatgggtcacagtgctaggaaatacactgaaaagtgaacaaagaactaaaaataagcctcttataagaaaagctgctacttctgggctaatctattagtagtttgttttccttaatttgaaaaagagcttcagaatcagactctagagtgaatcttttaaaactatatatattatgcatgtatacacatatacatactctatgcattggcttagataatataaaaacagcacaggaatagtttatgctgtagtattgtgcagtcttattcagaaataagaaaaatagtttttccatttagctgtgagtcattactttttagtttcgtggagaaattaagttttagtgggggtcgatacagcttttttttttttgtagaaaatcaggtagcatgggctttggagtcagacaaatctcggttttaattttcagtgtccttatctctaatatagtaatattaatagttacctcttcctgggttgttgagaggtttaaatgaaataataagttaagtactggcacagtgcttaacacataataggtattcaagatatgtatacttctttatcatcaggggattgaccttggaagcatatgggtacatagaaagaacccataaaaggatatgacaaggggagaggagtttgttttcattagatttagcaaattcattctttcccccaactccccagaaaaattcattttaatgctattattttccttatcacccataaacagacagaaaattggcatgtttcgaaagagtgttaaaactgcaagagtattacatggtatcattacactaccatccattatctaactgggtttatttatgaaggttagatttagataatttagacttaccctttttccattttgtggggaaagagaatcagaaacttgaaaggaagagctcttccaaacagaaagatagctagaatctctctcaatagtctatataatctcttctaataatctttagcaaaagtgacttttgagttcttttaaatatttcctgtattgattctaattcagtgctcatttcatgtgatgtctatagaactacagacttagattacagtcagaaaactgagtaacagcagacaccaggttttcagctgtttttagggtttattcagattgactacatcacattcatttggatggatttagtgacatcaattgataattgtaaagaaactagcctttaatctgacattttcatattgatattagataggagccacatgactatgtcatgggttcattcacaagatataataaacattattttcacttgtagcataaaagcagtctttagtgttatcttagaagcattaaaacacacacatatataaaatcatatagattaaaaaattctatcagcataggttctgtaattgttaatagatgtaattgcataaggtcgctatgcattatttctcattttcagatgaagcctgtcaccttgacatttttatatataataggaatccacaggttgttaaaaacataaggaaattaagataatttgaattcagattataaaatagttcaggtctattctgatgaagcaatgtcacttaggtctgaggcttttgggtcagcttttaaaagtttatcttatttttcattaaaatatgtatgtataatactctatcatgcaaagagaaatggtcaacagaatttctgtgcatatatggttgctggttatttgaaagccattctcctcctaggattatttgaccaattttgtattcagcttagattagggagaatatagtgtctccttaggtaaaatacttactagaaccaaaaagtccagattaaattgtttttatttttattttactgcagttttgtgcagttgacctgattttaaaatataaaactaggaaggcatatttttcatctaccaaaatgtgaatcttactttcattttgaaacaaacacctctgctttaagaagatgaacggtagtgataaatacaaaaacgttaaaattttttaaatgaatagcgtttgttgatctttaaagaaaacataaatgtgaaataactttagagcttaaaagttttcttcctcaaaccttttaggaattgattttattatccaaaacaactttattcatactaagtgtgactatctgaataattaccttacttttatagttttttttttaaaaaagctcttctaactgtaattatcctcaaagaattggattaagaaattcaataattttctgtcattagtccagcgagatatttactgaatagccattacgttcctggctgttaacactacaaggactccagcaatgagcaaagcaaacaagcccttgcttttccagagcccacattctagagtcagatgctaaacaaatacacagatacatatataataaaatattggtttaagtgttgaaaagcaaaatcagagtaagaaggcaggtagtcattttaaattaacattgagaaatgtttccattttaagcatataaattctttggcttctctttttaaatttgcttttgactgtttgttgctggcgaaaattatttaaagtaattaggaactcatcgtaaatattttgtacactactctaaaaatctaaytccaactagtgaatttagcatttataaatggaggtgtctatagaggaataaaatctttggttaaccactactttacttttagcagtaaagtctgcagctcatgaaatttgtaattctggagtggtttcagtttgcaccatcccctggggagcctgttgatacagcactgagctacagattattattcagctgtagaagttttatgcttaggcattttcttacatcttcttctctcagtcagttgaaatcttgtatttttgccaaataaaacaaatcctatattaataagaagctataaataaacagtaggagcatgagtcagagccagcatcaccccattccttgtgtgtacctctctagtactccccagtatgttccttttgcacaaacatgtagtactgcgtaactactgttctacagatgaactccagttatttaagtgaggcctgttttttagaactaagtaatactgtaactagtagaattctggcatgttaccacagtcaaaagcagaatgtgaagctgtatgctattgatgggaggaaaaaagaaatatatttcctacctttcctgtataaagcccagaagattcctgttagatttccaaaatgggtttttatataatataatataattcaacatttttttcagaggaaaaaagaaaaagataagttgcttgaaagtcccatctcttttgctagtcggcttctgtctgataaaattttattctgttttgcttcattgtttattcattcagtagatgttcattgaacacttactgttaccaggcactgtgctaccatagacggtataaagacaaataagctaaaatccttgttctcaaggaatttattattgtagagaaaagtgacttgtaaatccaaaatttcatactgggataggaactataaaagagacatcctgcagaatactgagattataaataaaactagtatgtttgaagcatttagtgtcctagctgttttatagaagtcatttcatttaatcctttcaacagctttatgaggtagatatcattacactattttacttgtgccaagagcactacattcatcaaggaaggaggaggtagtatcaaatttttcagaaaacaagagagttggttatagaaggatgagtagggtagagagtaggaggaagatgaggcagtgtggcatttcagacagagaggtgaatatgtaagcacacaggatgagtgagagaattgttggaatgtagtcagttctaggaaataaaagatggcagggtccagatcatgaagtttggttcttaacctgtagaagacagaaatatgatcagacttgcatttcaggaagataactctgtaattgtttgcaattcctgttaaacgaagaaattttctccagcattgacttatgtttattaaatacatataaaaactaaattctagaaacatcttatacagttatacatcacttagcaatgggatacattctaggaaatgcattgtcaggcaatttcttcattgtacaaacgtcatagagtatacttacacaaacctagatgtatatctttgtttatatttattttttcatatggaaaaccaaatttcttagccatgttactgaatgtcagtcatttcccttacttgatctgcatcaccaacattaagtgccatgtatcagatttctatatatgttccattataatctcatgggaccaccatagtacatgcggtccattgttgacagacacatcattatgtggtgcgtaagtgtacttatagttttacaactacaaagtgaagcacagagaggttacataacttagccagtgtcacacagctaataagtagcaaagtcaggattcgacatgttaagccaacttcatggacttaaccacagtcctgtattgccactcctcttcatttaaaggcatgcatgcacatattagatttggagacagttctagagacactgaattggcaactacagtcgacaaagagacattgcagcaagtacctctacgttgtttgtttctgtacccttaacttgcagtggtctacaagaaagaatgaaggaagggaagtgatatatttgtcaaccctaactacattgtaaaatgaagctttttttttttctttttttgagagggagtctcgctttgtcacccatactggagtgcagtggtgcgatctcagctcactgcaacctccacctcccgggttcaatctgttctcctgcctaagcctcccgagtggctggaattacaggcatatgccaccacacctggctaatttttgtgcttttttttttttagtagagacggggtttcaccatgttggccagtctggtctcgagctcctgacctcaactgatccgcctgccttggcctcmtaaagtgctgggattacaggcttgagccactgcactcggcctgaagcattttatgatgctcactaccaagtgttcataagcggtaaataaagcccttgggctaggtaatgtaagatccattgcaacctggagatgaagaactttgtaaaggggataattgttatcacccatcagagcatcagagttttaagatgatctagatttagtcccactaattatatttctcctaacttttatagacagagaaatcagtgaaaaatatgtatttctaaggattaaatcccaatccatagctcaaggctacctttatgtctaatagttgtgatataatatgttgcttagaataggttctataaatggaattcacacataggaccccagaatcgcttcttcacagggtttcagagttggaggacatataaaaggataaatcaatccataaatctctaagtattcctaaaagaagagtggtgtgtcagttattggcaccagtacatcatgaatcctgctgggctgtggagaaaggagaaactaacctgaacaagactatactctacacagctgtccctgacattctaccacctgttagcattcagtattaatttcatggatcaaatcaaggcatgcaagtgcattaaataactttttaaaaaacaactgctgattgctgacgtctatgagggaagaaaaattaggggctgttattttcctatcaaccatcactctcattaacaagaacaggaaacattacgaataaataaaactcttacatcataccagaaaaaagaacagctgaatcccctaaaggatttcatattctatcatcagacaacgaaagaaaataattccatataaatggctgcatgaatcattgaaagaaacttccctgcttttttaaaagagcaactagaagtatttactttttgaaaatagagtaaccatttgttaaaccgtatataccattgaagatgttttgggtataaaagggaatttccataataattacatagtaatcttttatagccaaagttatgaagaagatcaggatttgggaaaattgtggtcaatatttgattttccttttctgtttgatagccttatctaaattcccctagcttgaatgtagtaaatatgagtgtgtaaaaatgtgtatctaattcacctcttgggggaggtttaatgtaactataaataaaaattctttccccaggttaaaaaaaaagttacatagtgtttaattctaccttttctcatttctctatatccaaaactatcaccaagtactgttaattttactttataaagctctcttgatatgtctcttcaacctcatcaccactgctttaaatgaggcatacttcctcatttggattatggcagcagtctctcttcctttagtctctccttcaaatccacctccatccttcatatcatccatcatgtatttttccctgcctaaattccttggttggcttctattaaatccaagttccttaagcatggcaaacaggggccagcttccacgagctggtccatacctctcctgccttatttcctgacactttcccttataccttgagatccagcttgccagtatttccccaatacctccaccgcatatacaaccacatacatatacacccttatcccctccctcatgtaccacccatatataattctctttaccgcatcctttatcacactcctacaagccttgaagcaatctgaacayagaaaccatctttgattttcaactcctaattgggactgaacatacttgtcttgaacacagattgctgccttgttagtataggtatcctaatatggcacatgtgtatagttgaagctataatgcattccccaagttccctttcaggactaaagggttatttcccaacagctggaagtcctgctgccagacagccttcttcaggaattgccttgtccccaactcaagacaaccctgaaggacctttcccagttttccatggggtccactgaggccttgagattgtactgaagtcaacttctccctctgctgtcgcttcccttccacaggtgtttatcacaagaacaatccttaataaacttcctgtaagcacactctcagagtcagcttgctggggaacccaagctataacaacatgtttatcttgttcacactttcttctgagttctaaatcatgggaagttacagttatccaaaatcttactaattggaagatcatttcatcagacgtgtattgagcacctgcttcatgtcaggcattgtgccagatacaatggaaacaaatcaagacttggcctctgtccttgagtttacagtctgaggtgacagttacatatgaacctaactgtattaaagcatcttgagaatctttttgattcaaatgtcaataattttagtataaaattcaaaagcatggattttgtggtgttacaaagaacaaaaggaaaatatttcaggggaaggaaaatgaatataaataagtagaatgaaattttagaagagcacagaatttgtctttataattctgaaagcctttagggaaaaggtaattttttcactttttattttgacataatttcaaacttacagaaaagtcacatgaatactgaactcccatacaccctttatgcagatatatcagtttttaacattttccctcattctgtttctttacacacatacaaattatttttgtgaactctctgagaacaggttaaatactacattatatcacttcataccttaaaaatgtagtatttcctagaaacaagggtattcacctccataaccacaatgcagttgtcaaattcaggtaatttgaccttgatctttaatctacagtccagattcagattttgttaattgtccccaaaaagatgagtttaggaagagtcatataacttaacatttgtaatgtaaattaaagatctcggaagtttgctaacctgatttaaataccacagtgaaatgaaccacttctgattttctacggagaaagcaagggttaggtccaggttacctgtaaaggtgtgacttagggctccccagaagtgaaccttgctctggagaccccatttggtgaggttcttttcaaaagagattgtatatttttgacccagggattgtcgatttgttgagctcccatgtaagtatgccgccttgccattgacaggtcttcacaatgctttcttaaacgacattctttggaactgtctttcatagtcaggcgacccgccagccaggccgccaggtaggtggaagggcggcttcgggaactagatccggctggttctctgctaacatgtggtcctcgatgctctagcggattggccccaaacctcagcacacagagctttggtagggctggggatgcmggtcagcctgctgaaggcgtctagaggacttgggcgggggcgtgacttcctgctgcaccacttcctttccagccacgtgggcttctgggaccctatgacataatttctggagtggtctgttgggagttgtggcggcggcgaggcccaagcacagctggccaaggcgggtgtaaaacgcgggtcgtgtccaccccaaagctcgacgcctctagaagccatggcttttctgctgaagctagagccggacatgcaggggaaagtagatttgtttcgagcccgtatcgcccaggaggccgaggatctcgtgtccaccttctttcctcagaaggtcttggagctgaatagccgagttcaggagctccggctgcaagacctgtccagaatccattcggtgccaacctcggagcccctggccaccccaggcaacaagggagatgggcccaaccaaaatctgccagttctgctgactcagttctccatcaaggtcccagcactgcttggcagcgagggacagcttctgcggagcaaccagcatctggtggagttgactgagtgggtgaaacctgagatcaagctgctgagagagaaatgcaacacagtgcacatgtaggtgcacccgcttatcctgaaggtgsaggacggcaacaacttcagggtgtctatccaggaagacactgtggaccagctgtggaccgtggatagcacagcggcctcctctctatgcggcttctccacctactacaacacccaggccaagttggtatccaagatagtgaagtacccccaagtggaagattatcgctgcactgtagcagaggtcgacgaaaacgagtacctgagtgtgcgccagatcctgctgcacctacggaacgagtatgccaccttgcgtgatgtaatccttaaaaacattgagaagatcaagatccctcggagcaccaaccgtgataacctatactgatagcctttctccaccccatttgccttcaggagttggcggagctgtttaggcacctagaaggctggttattaatgactctacaggtcatgaaattactggaaatgtgtgttaccatttagaatttcatacagcttatcctcatactgaatcatcttttggtgtaatttttatttgattttccttttgtgaggagaatggggacaaaccatcaaaaagaaaagactgccatttttaaaagcagctttatagataaatgttggcccaaggtttctttattatggccttagcgacattgaatggttttaggggctacttaaaaactaaatcttaaagttaaatgaagtttttcctaaagttctgctatccgttgaactttgttcaaacttacagaaatgctccttttacagcatcatttttctttttttgcgaggaacggagtttaaagggatatgtttaggtcattgtatgcctccagtttaacagattgaaataaaacttggttataaaattttgtgatggcctgagtgtgcttatctgagctttaattttcrgatgtggacaattcagatgataatttcctacttcaggtggactcatacacttgatatttttcaactctgatgggtaagaaaagtaagcaaagagtaatgtattttaattattctaaacaaatggacatctacttcccttagaatgaaaagaggaatctgtggaaaatgacttccttccataatcttctatcatctcaggatcttcatttctttttacacaatttagaattccttctgtatatccgtttgtctctttaagtctctgctaaatccatcaagctgtgtatcctataatactttttcccccagttgattttcattgccctttctttttgtctcttagatatttcttaaagtccctcattagcatttccctctcaggttatacaggtcattctttttttttttttttttttgagatggagtcgcgctctgtcatccaggctggagtgtggagtgcagtggcgtgatctcagctcactgcagcctctgcctcccaggttcaagagattctcctgcctcagccttccttagtacctgggactacaggcgcatgccaccacacccagctaatttttgtatttttagtagagacggggtttcgccatgttggccaggctggtctcgaactcctgacctcaggtgatccacccgccttggcctcccaaagtgctgggattacaggcgtgagccaccgcgcctggcgggtcattctttaaagacyctaaaatgtggctttgtgttcttttgctacgtcgttgaggggaagccattgtcttctcaacagtaagctatatggttggtatttttaaagttcagcatttccagatttcatttgcaggtaagataaattactgcactgtgagtctattctaacctatgtagattagaaaaatcatacactggtttagcggaaactttattttctttctttctttctttctttttttttgagatggagtttcgctcttgttgaccaggctggagtgcagtggtgcgatctcgactcactgcagcctccacctcccaggttcaagggattctcctgcctcagcctcccaagtagctgggattacaggcatgtgacaccatgcccagctaattttgtatttttagtagagacggggtttctccatgttggtcaggctggtctcaaactcctgacctcaggtgatccgccagcctcagcctcctaaagtgctgggattacaggcgtgagccactgcgccccgccacggaaactttattttcaaagtaaactcctgaaaaatgataacaagtgaaactattcttttgtcgaccttctgaaaagcctgagtctttcaaatctgtgcttaaaaagcaacaacagcaaaaggtattgcctaatagaaagacgtcttacttccttccccttcaagtaaaaagagttctttttattttccctgtaaggtgttctatctgattcagaaaagtgctgggaaccctaaatcagttcataccatttgacaggctttaattgcacacaagtgtataatggacaatgtaagggaagaacaaatgttgcttaatttttcaactaatkttaatcatctaagacttaacatatctgttcctcacataatataatcatcttttgcttgtttcttttactcaaactgtcaagctttatgacagattgaaataaattttctccaatccctggcatgccttttactgagaaaatatgtcctttgtagttaaagatttctggtatatgcatttttcacctttttccaactctgtatcaaattaagttggctctggaatactttataaagtccctacttctgcaaaaattaatctctttgtgattttcccctttcttgcaaatggttggaaaaacttttataataatraacttaggaactggtgttacaatayggtatccaatgtgaatcatttgcctgttattagtacttgttacttgaagccacgtttttgttccttttaagatggcagctgaattgagcaggtgtttttttttttttttttaagaaatggttttaaaaacttattttggaattaagtaattttagttttaaattctaaaactaaaacatgaagaccactaaaatttgattggaagttgaaattagtagatctaatttttatgattgagtgaaatgtcttaaaccacataaatgatggagaagagtcttaaagttcttaaacttcaaacttcttaaacgtttgggcttagttttaaaaaattactgaatcgtttataaatttttctttggttattagaggcaacatttgttttgtagtcttttttttttttttttttttttttttttttttgagacagagtttcactctgtcacccaggctggagtgtagtggcgtgatcttggctcactgcatcctccacctaccaggtttaagcaattctctgcctcagcctcccgagtagctgggattacaggcgcccaccactaagccgggctaattttttttttttttttttttgtatttttagcagagacggggtttcaccatctcagccaggctgaccgggaactcttgacctcgtgagccacccgccttggcctcccaaagtgctgggattacaggcgtgagctgctgtgcctgtcctattttgtagtctttatgaggtttacatatttatatagaattcttaccaagtagtctcaaccattaatagataactgtgtgatcaatttaagtgatttttaatttcaggccagatgcagtggctcatgcctgtaatcccagcactttggggggccaaggtgggcagaacacttgaagtcagttcaagaacagcctggccaacatagtgaaaccctgtctcaagcaaaaattaccaaagttagctgggcatggtggtgtgtacctgtagtcccagctactctggaggctgaggtgggagaattgcttgaacccaggaggcagaagttgtagtaagctgagatcatgccactgcactccagcttggctgacagagtgagaacctgtgtcaaaaaaataaataaataaaaagctttttaatttcaaaagtaccatctcaatggtcagaaatttgaaaagtataaaaggagaaatcacctatggtttactagcctaacaaaatcattactatttgtgtgtgttttacttattttaaaggatgcatatatgtttttacatcattgcaatatagtatatgcctacttttatagaggataaacatctgcatttaaatccaatctaatattataacttcgtttgatagatatcccctgattcagataacagatacatccattcccccaaatatttttaaggctctgtttcctaattgtgaaaatgatacttgtctgaggcaggaattgtgattagagtatggaacatagagatcaagtagctgggaggaaatgtgcctatatgactgtgagaatgtctagatatttagaatagggttttactctgcttttaggttggggcttcataatagctttagcaacatatctgatcattttattactcagtgctttttccctccccctagagcatttaattacctctaaaaatatgtacaagaaagcattcatgccttatactgattagatgaactgtttcagctttcatgatttggtatgagtaggagggaattctacttcctctgtcagcacttaaacatttctggaaaatgctgtagtgcattgacatcaggcatttttaaaaaattactgatctttgagaaaaaataaaggacmcagtgagttacagaaatagatgctggaccatccctgttctctgcattagaaaactatactgctaacacatagaaataactgctcaccttgaactgaaattatccatgggaagccaaatacatccgtctatctatccatcaatcgatagatagatgtatttgtctcattctgtcgcccaggctggagtgcagtggcacaatctcggctcactgcaacctctacctcccggtttcaagtgattctcccacctcagcctgccaagtagctgggactacaggtgtgtgccacaacttttgtaattttgatagaaacagggtttcttcacattggccaggctggtcttgaactcctgacctcaagtgatctgcctgcctcggcctcccaaagtgctgaaattacaggcgtgagccaccatgcccagcctccatattggatgattatacatttgtatatatttttctttgcttgctttattttgatgagtcttcaagtcagtagcagaattttattagtgaagtgtagtaatcccagttactcaaatttaaaatgtttcactagtaaactgaatttaacgaattctctttcatagagaatgttgtgttatttttmcttattggtgaaaacctagctggtgcagatgaacaggaatcgaacctattatcagtaaaattagattccttttacaatttggccatttattttagctttattatttaatctcatttttacaaagttatgcaatagtatattggaaaaataatattgctttgaaagtgtgaagtatttagaatttcttaaataaatatatagtttccagtttagatgtttgagatttagaggtgtacttttagccccttgttttatagatgaagaaatttagaatcagagatatatatggcagcacacaactcatctgtgacaaaacaaggtctagaagtcaaatcatcttccatttcaggctagtgcacttttcactgcactttactatgttctaatcagtaaataaaattacattagaagagagttctttcagaaatacgcaaaccagtaaaatttcaacaaattaacatccctttcaagttgtgtgttatttttttctgcaaaatgtaagagaagttgaaatgtttccaactcagaatggactataatatttttactgaattaaatattatgtaaagagctgggctcggtggcacacacctgtaatcctagcactttgggaggctgaagcgggcggcttgcctgagctcaggagtttgagaccagcctgggcaacacgatgaaactccatctctactaaaatacaaaaagttagccgggcatggtggcatgcacctgtagtcccagctactcacaggctgaggcgggggtgggtggatcacttgagcctggggaaacagcgatttcagtgagtcaaggtgccattgcactccagcctgggaaacagagcgagaccctgtctcaaaaaataaaataaataaaaatattctactggccaactcctcccccaccttctaaccttcagcaccaaagaactgctacatagatttgtcatggctgctgctcctaaaaaacctacagaataaaaggggaaagaagagctgtagttttctgttcgggaggaagcctgaaagggtcatttcccaaaagaagtttatcttttagagctggactggtcagtacagtagtcactagtcttgaaatgtagctagtcctaactgagatgtgctgtaagtgtaaaatacacactagattttgaagacttagggtgaagaaaaagtaaaatattttaataacgcttatgttgcttacgtgttgagtgataatattttggatacattaaataaagtagattattaaaattaaatttatatgtttccttttacttttttattttgtgtgcccgaaattttaaggttatatatgtggcttgcttatatgcctcacagtatatttctattaaacaacactgctctggaactaagatttctaaggtaactgagatgatccttggagttgagcctaaacctgctcttgtggtatattttggagatgtgggtttccattaagtatagatttttttgactcctagtaaatttttattgattcgtcatctggttcataatgtacaattcagtaaaagccattcagagagaggctaaacattgtaagccaaaccttcttacagtgcaacttggtcttggaacttagaatgcttacaggaatggatggctagcatgtgctttatgcaagccttttaaatatcatatccaggcttttggtgagagactagagtactaatattctgtattgctaattcagggctgctccatatgctttataaaccaaatagagggtagatttagcatgaatattgagacatttacccagtgtttttatctggatgaaagaataacgtacctctggtgcctcgagagtacctataggcagttaggctttttctcaaggagcaatatttgaacactcaattaaatccccatgatttcattgaattcccataatatagttatatagtactcattgtattctgtgtgtgtgtgttttttttgtttttgtttttgttttttttttgagacagagtctcactctgtcacccaggctggagtgcagtggtgtgatctcagctcactgcaacctccacctcctgggttcaagcaattctcctgccttagcctcccaagtagctgggactataggcgcacgccaccacgcccagctaatttttgtatttttagtagagacagggttttaccacgttggccagaccggtcttgaactcctgacctcaggtgatcctcccacctcggcctcccaaggtgctgggattacaggtgtgagccaccgtgccaggcctgtattctgtatttttatgtatatcctcactaaataagtttcttgagaatagtgtagggttttttattcaccctttttccattatggtgttttgcatatggtaaaattctaaagtattctgaattaaattgagctaaaccaaacctggatgaaactaaagaaaatcgtttctcccctttcttattagaggaggcactttgttacaacagaggatatatgtggataagtgtacccaggaatatgtaacaatgttgagacatctacaaatctgattcagaattaaacaaaggccaatgaagtttctacactgttttctggcttctaattaaacatttttttcatatcacaataatataaatattttaaagtactccaggcagttctccttcagtattcccaggatgtcattaagcctattcaccctgcaacagctgcaagttattccaaacatttgtactgaatctttacactctacaagcccatttgaaatcaactgtgtcaccctattaacagcttcagtaattctctattacttttctaaccaagagttagggagaaataagtctagtatatcagaatgaagaatcctgaaaattgcttttcaaaaccgattctctgtggtcacgaacataatgtttttatttacccttccagattttggtacttaaaaagttagtttcttaaatgtgtaaaatttagatcatttgataaatgattaaaaagaatttcccttaagtttattaagtcttatttggtagtaaatataaaagacaaaacattccatgtaaaaattatttcatacattttaaacagtttaaataaagtaagtgtagtcaactcaaaactccactgccttattcctctgggtcttgcatatttattggtggaaatttttctctgctatttttttacattttacattgtgggataggcacagagttattgaacctatgacctatatattccacagcttacttcaatgcttctattaggcacccgtccagagttgaagaaacgtctcagatcacagcaggttctcaaaaaatgtcattttgtttagcttcatttcaatataacattgatgagaaaaaaaatcagttcccagctgggaccactgtctgtgtggaattttcacgttttctccatgtgtctgcacaggttttctccagtttcctcccacatccttataacttttgcttcacaaacatttattgacttaacttacatcactacgaccaccatcacttactgattcaccaaaaattgcataaattatcttacttgtttttattagtttttattaaatgtatagctcacatttatttcaatatttaatattagaagtgcttggggtctttatttagaagtttggtgatgtttttatagccagaaatatgctgtaggaacgtaactctcatttatatcaattaggctatcataaaactggtttcctttatgtcatttcgcttaaagaatttatggacgacgtgaggaatagtactcaacttttgcttataaataattaacagatggcatgaaaaataattaacagatgacatgaaaagagacctcttaggaagcaatttttacgagcctgctgaactgggagttaacattttcaataagaagccattaagtcaaatataatcttttgcatttaaactctacatcattatattactagaagtctaaaaaccaaacagtatggtaggaagaataaaatgttacttatgaatataatttctgattatacttttagaaagaggattaaaagtattgacaacaaatgaagtcagaatagcttgattaaagtagtttatttaaagtatctccttaatgttatagtgtatgctaattatttgctttgcatatgtacacatcatgacatacatttatgcattagctgagacatgttcattctgtaagttttgtacaaaactaatgatcttcagttacacaagaacatttaaaagttttacatttgaaatagataattaagcaatgctgtgtgaaactgaaaaatgaaaactttgattaaaaaaagtattttcaaatataggatagtacatgtatatgagaatacttttttgggtataatcttagtaacatcattatggtgttatgtaaacatatgacatatgacatataaaattatagtagatagatcactgtgttacccacttacacattcttctgtcgtattaagcaacaaacattattcttatctataataaagcagatatttctgtctgtcatacatatgaaatatttgtatgtatttattggaagtaatttttaaggctaktctttttttataatttcaacttttattttagatttggggtagatgtgcagatttgttacattggcatattgggtgatgctgaggtttagggtatgaatgatcccatcacccaataatgagtatagtacccaaccagttagtttttcaacccttgagtagacattgctccaaaggaagatatacaaatggccaatagcacataaaaatgtgctcaatatcattagccattagtagaaataaaaattaagaaatgtttaaaatatttaatgttttatttgaaaaaaaaaacaattaaaattttaaataacatttttaatggaaaataattatatctcccaaagcaaaaaaaaaaaaaattagtgagaagagtagcactgttttacagttttgcagatttttaatatgtgatttaatggaagataacaagattcttatatatttctgtattcagtctgttgcaatatattgttttagttgaaatatatgaagaaaatctaccctcatgcaggtaagtagttgcaaagggaaggagtactttaatagccttttcaaataattgtgaattattgttttgatactacataaaaactcagcaagtggtaatttctttaaagattagttgcactatagaatctaaagccatatcagtgatacttttaccctctgtaacattaaaaatccattgatctatcttgcagtttgaatggaacttgtacccatgcatgattttgtaacatcattcactgctcatttggaagatactggttcactaagagttaggcagatcttctaaatatgaacatatttcattatacaatgtcaaaaaatcacattcattaatatcaccacgaatcacatcaagaaggtcatactcatggtggtagatacatggtttccgaaattcggattttcactcaaaatcccaaattttataatttgcaaatactgtcaagtattttctttgaaatatcaggcttactgcatttttaaaaagtgcttaatgggttacccttgcctgaataacaataattcgccattatttcaagtaaaagtggtattgaaaaaagtgggttgttcagcttgtaaatcattcacccaagtgctttttcttgagatagccattatgcttcagtaggcagcaaaacagttttttatgttcttgccctttcatcacagagaatgttaataatttttactgcttcaacaaggatattctaaactgaaattggctttaaaatattttattcatttattcatttgttggctgattcattgttactgtatgtggcggtgaagaatacagtgactgctagactagcttggtgccactacatagatttatactaaggcctagcagtttggctttgctttttcaccaacagagtaaatttcaacaaagtgcaaaaaggcttgaaaatagtttgacctgaaagggtcttagagattcttgcctccttagggaaaaaactagttaaaaatctattataatagctctcctttagctagtttacattataaatcgtttgtggttacctactatatgaaaggttgtagtagatcctggggattcaccaatgaacaaaacagatgaaaatgtctgctgttatggagctcatggagctcatttataaagggtaacgatatataataggtgttagagagaaaagtaaagcagagaaaggaaaggaggtgtgtttggtgggaatgtgtgtgtacaatttaactaaggtggctaggaaagacctcactgagaaattgacatttgaatgaagatctgaagtgggrgcaggtaaaggtgtgtgcctctacaaaggccacagctgaggccrcccttctttatctacctcttttcatctttccaacttccagaccttttttttctgctgataactcataccttttaattaaactttaatttaatttaatttaatttagtttcttccaactckgctctccaccacttccttgcccctagcacacacacaattaatcagcacttacaaaaacaaaaatttacctctttacaaaaggtacaggsatagagtagaggctttgaatacttgtgcttcaattatttttctcctgtcatcttttatattaaaggaaataaaatataggggtgtctccttttcctggttgaattggtagagaatatctatggcagttagtgctaatgtttataaaaaggaataaacacaagtgagatcatgatggagagagaccaaatcagtagggaccaaattataaagagatttcatttctaggctaaagagtttggattggtcatgtgtgcctgtcatcctttatttcattcagtagtggaacaatggctctcaactatgtggttgagggaataaacttaaacaacaaatctaaatttcctatatcagttgcatttaactgttgcgtttcctcagggacttcactctcctcaaactttttggtccctttttttaaaaaaaaaattattgaacacttataagtgttgaaatactaacttgtctaatctttataaacaatcggtgcaataggtgttgttactgtccctattttactaaagagaaaatgaggacacagattaaggaacttgctctatatcctacagctagaaattaagtgatggaagcagaattcaaacccaggcagtctagctccagagtccatccttttaatctctgtctgtgccactctggccagtgtttgtgaatgcagagtcctggaactatctgcatcagaatcaccagggatacttgttamtagtgaaaaattctggcccacctcagacttaccatgtaagaaattgtttttcaagagttgaggaatgtgggtatttatattataaaatcctgcaggtgattctgatatgtatcttttgttaagaacttctgttttagaaggacctaccattggcactgtttttgcttctgatcccagcttcctatgattaaatgctttctgaaagatacatagttagtacagaacttaatactattatactattctatactattttaccccagtttgacttttaagctgttaccacctgaaatttaaatgaaatcctttttagaacaatacttgaccaaacaatttaaaaattgtatttcctacaaatgcatcataccttaaaaatgcactttaaaactgaatggaagccaggtatggtgactcacgcctgtaatcccagcactttgggaggctgargtgggtggatcacctgaggtcaggagttcgagaccagcctggccaacatagcgaagcactgtctctactaaaaatacaaaaattagctgggcatggtggcgggtgcatgtaatcctagctactcaggaggctgaggcagaagaatcacttgaacccaggaggcagagtttgcagtgagctgagattgcgctactgtactccagcctgggtgacagaatgagactgtataaaacaaaacaaaacaaaaaaacaaaaaacaaaaaaaacaaaacacacacacacacacacacacaaaactgaatggaaactgagaacttactgttctatttatgatgaaagaaaactggtaggctttagaaagtacaccctatgtgatatgaaaagtgaactcttctagattgtggaacagctttatatagtatcatacctccatctttaactaggattgcagctggcaataaagctcagcttctaatgcgagcaagtgttgagtttggctattttgttaacccaagatcctgagagaaaatttgttcactgatgtacataaagcatattatggttaaaatttcttattccactttgtagtttgccttgttaagactagtctttcctaaaatgtgctttaggggcattttatagtcctccatatttctttatgtgacgccaacatcaaaattgctttgaaaaggatcaagatctggagtgaaggctggaggaatagctagacactgaggctcatgcaaggagagttaactttagaaatatatattacatgaaacccctttttttctccccttccagaaatttgtagaatcattgatatgaaagagttggctagtatatctccctgtgttcccttcccaccctgctgtgctatccacacaaacacaagtggcatttgaggtaacttttgagattctgctgggttaaaaaaatatatattttttgtctcaacccaatatgttcctttttttcaacaaaaagtataatgattctcctatatatctatgtttagctttttgctagaagtgtttcctaataacttttctcaggaaacttgttgactcaatttactgtagtcatagagcctcctacctgaccccctgtggtctgctttggtaacacacctgtaggaggcaatgtaatcttcaggaaattcacttcctaccagtagtcctgagtaaagtgaattttctaaaatgaaacatcttgtaaacattatatatgacaaactcccaaatggttaaactctttatgcatttagtgtttgatctttttccttaagaagacttttttttggattgctgtcctgttggcactcaacaaattacaattgctaataagtttcagaggccctaacttattttcctaaatcatatacttcccagtttttgaaaaggctctctattatagctaacaaagttttgaactttgattaactcaagtgtttttgttgttgttgttttgttttttgttttttgtttttttttgagacggagtttcgccctgtcgcccaggctggagtgcagtggcagcgatctcggctcactgcaagctcagcctcccaggttcacgccattctcctgcctcagcctcctgagtagctgggaccacaggcgcctgccaccacgcctggctaatttttttgtatttttattagagacggggtttcaccatgttagccatgatggtcttgatctcctgacctcatgatccatctgcctcggcctccgaaagtgctgggattataggcgtgagccactgcgcctggccaactcaagttattgaatgaagtaatatgaagcacatgggcagagacttcctggtcctatacctgtccaaggcatgtaaccaacattttgtttaagagctttccctagggagatcaatcctgacctggtttagaaacattttttcctgaaactctcatgaaaagagaagaatgattttggatgctactgtcttatcggaaagtatttacaagaaaccattttgaccaagaaactcaaaattaattctggtttttaaaaagagaggcatatattactcttagattgaaccttatgaaattactgatatttgactcaccaaaatgacagttttttatggtccaacctaatactttttggtgttaataaaaggggaggcagggttagttgggcagtttgtgggggacatcctacagagtttgacatgaaaagtatatcttaaatcaaaacttgaatttgtacttattaggatttcaagctcatttttcctctggtgaccttgccagcattatcagatttgtattaagtgwcaaaagtttcctcttgtcaaagtgtaaaccttggctcattcttgggccatctgttgtacactaatagttttgatttattcttctggctgacatgcgtattaatggtacagatgcaagctttatatttccttttatgggtctgtagttttattgcatacattagtggcacaaatacagcattcatattagctatttatatgaactatttctagttttggggtgactaatatactttgcttatgtttttactatgctgagaagccctgtatcgtagacattttaatagactttaaatgattacattctacttaattttaccacccctaattttgttttttgtaatttttattttcaggatatgtcatgatgtatgtctgtatatttttatgatttcaaattcccaaattgccattgctttaatgaatgagcacatttggtttttgatcaggaattactataactactagaaaacaacactagtgcaaaatgtgaatttagataaataactctgaaaggcctacttctagttgatgctttggctctgatttttgagggttaatatgttcttcaacttctttgacagcttgaaagttatgaaatagagtgatagaaaacaaaagctctctaggacagggacataggttagagaaaatttaatacaaagctgtttttgaaataaggctaggtgctatttttatttttgatctgcttttaacagtttcctatattggaaaaccaaacccatctctggaatccagtggatatgggccaaatataaaatgttaagaggctggtgttactattggtctgctatgcaaaactttttccctaatagaggtctgtgttgatctgtgtgaaagctgctcagtgtcacaagtgcagcctgagtttcattcatttctaggggaaattatgatagaaataacattcctttctattaaagataaagggctccaaccttgagccagagttttctaatacagtagaagccatcttatctatatagtgggtactagtagatagtctgttaataaacaatactggctaaaataattttttaaaaagatatgtatctttatttcatttgattatattaatgtgcactcattggctagttttgtatgcagggccaatttcttttctttgagtccaaatccactcttcagagttccatgttgccattcttgcataaactatactcacaaatcagcaaccataatttccagtcttggttacagttactgtatattggaataagaacttaaaggtacttgttaagcaatctgagggcagactattatgatttttatggttgctttgcaaggagagaacattttaaaacttacctttatctttttgctctcttttcacactattagtttatgtaatattttattacacaattatactaatacaattaatgaaagtagtcttgaaaaaagacacaactcaactagtcgtgaatgttccctgtgctatgggcaccagtcagtgagttttatagggggaatgggaagggtcatttaatcagtctgtactctacatagatacgtagaatcaacatttgataactctcagtagggcctgaattttattgtgagttaccataattaatttcagtggagcaaaatgtggtccttttcttttgataagccagtctccaatgcttttgttttcttaaaaagacaagaaacgtaactttgaaggctgtgttatacactaatattctgttggtttctaacaaattgcttggaagagggaattgggagaactatatgaaagtagcatattttctcatgcacaatattgcacaacattagaaaactgatgctttattttcatggtgaaatgttttgatgtttctccccgccccctcccctccatgtttctctaactttttctgggaataagagtaacaatacattgattataatatttgtccacatgatttcattccagaggaaatcctatagtatctaagccctacggaaagcctcataaagacatttcaggagtccattcgaagatgtcttaaaattaatgacattgttttgagtgacagtgccgaaatatatttctttctatggcaacattcttattctactatcctttttatttttaagtagtttcatttttgtcactgttgggttattttaaacratttaattggagggaaagaaatacaaattcatcaaattttacctccagaattgaatttccttcactagttccttaataagtatttaagtaaaagggggtgcaatatcaagaagactaaattataaatatggtttctatgctgttaaaaaataacagtcctgtccttaattaaccattatggagattcctcttgaccaaatacctttagaactgtttcacagatttataatttaactagtaatttggtttaggtttaggtttaagtgacagaaaatccaaaataatagtggcttagataaattataagtttatttctgtctcatgtataagtttcagagatctaatgatagctacttaatcatcgggatccctgtctccttctgtcttcttgctccataatcctcaacttgcagcttctgtctcatggaacaaagacggctactccagctctggcagtcatatctgccttctagctagcaagaaggagaaagggaaggaggagggaagccttccaccattaccaccttgaagaagttgccatttcttcttacagtccgttgaccagaccgtgtagcyttatttggttgcaaaggaggctaggaaatatagtctttattctgggtggccttgtgcccaactaaatatcacaagtcctgttgctattttaatgttacagaggaaggagagcatatattgggtaagaaaaaaaaaaaggctgtttctgccacaattcagtttccccaacaaaataaaaacttggatttatattctttaaaagaaaatatcctctgtagcacagtgctgaatacatgacaggacactgtgctcagtaaattttttttaagtgaacagtaagggccggtcacagaggctcacacctgtaatcccagcactttgggaggccgaggcgggcagatcacgaggtcaggagatcaagaccatcctggctaacatggtgaaaccccgtctctactaaaaatacaaaaaattagccgggcatggtggcgggcgcctgtagtcccagctactctgcaggctgaggcaggagaatggcatgaacccgggaggcggagcttgcagtgaatggagatcgtgccactgcactccagcttgggtgacagagcaagactccatctcaaaaaaaagaaaagacagtaagaggccagtaaatatttattgagtgattacagctcctttgtttctgaaaatgtgactcacagtactaatgatctgaaaaagagtaagatgaacacagagagaaagtaatgattcaggattcattgttgtgaggttcaagaaacatttattttgaggaagtggaggtaaatattcaatgaagttaactacattrtcccagatatatagataagatagataaaatgtatatattatatagacacttatttttattataagatatgtactgttagagttggtagtataccagctttggttccctgcagtctgatttttgggcctcttggtaaacaagtacttaaaaactgttaccccagtttgcaaacctttaataattagagacaaggcaggttaactgtaataattcgtatgcatgcaagatatgattcttctttttcataaatcatacctagtttttagctttctgctgcaaaagtaactagtttgttagaaatttagtgaaaagaaaaagtaggagacattgtgttcagaagatcatgtttaaaaacaacaattagtatggcatctgtatcttagcaggaaactcagaattaagtctgagcctgaccttaacccatgaccagtggaatctaagtttgtttatttttacaatagccttaatttggggcttgcaagttttttggtttgttttcacattcaatttagagaccctgaarcagtattttaatgataggaattaagctatgtataactttcatggcttgaagatcagmaaattctgttttttcttggttataatgttatcttaatcagaaatgtgtgatctttgtgtctaacaatgcacttaaaaaaacaaaacaaaaaattcccttgctgcaatgctggaattctaacagaatttactcatcttctctctcctccccaatttttaaaaacatgttctcatggaaatgttgccttgaattacacaaaatacaagcagttactggaaatgttttctacacagttctgttcatgtatatcaatttcaatttgtttttcactttttagatttttttcttagttttgctgataatcacacttcataatcatatcaactttgaactttgaagttgtgttgaatttttattgctctcagctgtatcagatcctactttttgatgagttatttcatatagtaagtttgttgaatgaatggtgaaacaatgaacacaggaacaagaaaagaaagcaaaatgcatcaaacttaggtttagttttatctccagtttaaccatgctcccttaaatggaaatgctaatatacttctttttttcttttttctgtaacagttcatatgtttttgctaggaagaagaggagttactgaaaacagtagttaatatcaaagtcataagtcatttataatcagccttagaatgcctacagatgtatatacatttttcaaaacacttatactctgccttttctgaagccaagcttctcttggcttattcttacttttagtacttgtgtgctggaaattagaaacctcagatgccctgcacagtgtaggactatacaattgtgctaggcatgtatttataattctttaactcttctaccaaactgtgtgctttttaagggcaaaaactgtacaacttctttagcatgcacctgtcacttgcaaataaatgtctaattctgtggtcccttcaaagggagaagaggaggctaagcaggcaaggctctaggccttggccctgcttcagtcagaatctttcttgtacatgttgataatttctttcttctacagatagaaaattcctgggataagaattttgatgggaaaaagagtttattgcctttaaaaaaaaagtttgagaatgactgtttaggggagatactctcagtatcttgtgacattatctagtctagcccccatcattttacaggactggaaactgaaacacagaaaggatacgtagtcttgtccagattatacagctatttagtggcagaattagaattaaaatcccttgtcttgactgcttgaccagtattctttatagtggtgctacagcatatgtgttgtaaaaacctaggagttttccaagatcactgcatagtgcctgacaacggtagacactctgtaaatgtgtattacattaatgaatgaatgattctaagctggtttgtagttaattaagccaacttcaaataaaaactataatttttcatcatcccaacgaaatattgacctcttagaagccctgaatttggcctgttctaggactaagccaattgttatatrtaacagattgttctttgttaattttaggatcacctgctgttaccagctaccacccataacaagaccacaagaccaaaaatgtcaattgtgttaccagcaataaacataaatggtaagttgaaattctgatgtatgaacaatatgagatttctttgtttaaccaggattctcttcattagttcaaagacatttaaaatgttcagttaaatgagtatatatccgtacattatttctgaaacatttttccactgttttattatttttaagatccattattcttttaaaaaaaattactacatccctaaaagaaaaagtagctttcttttacttacaaaattggaaaagctagcatcttgactgctctacagacttgcatctgcgacccttctagtcataaatgtagtgtaagaagcccctgctgtgttctgacagtgaatttgtaaattagatttttggaactcaaagcagtttcctgtgttacctaaatgttgatatcatcctagaccatgccacagaagcctgtttatgtttaattgataatactgatgagtttgacactgatagtattactattgcattttgttatattactagccctggacattaaacaaaatacaaataataatataatgcacagatgttaaggcataatatacctgcttatagtttagaagaaaaaaaaagacaagcacaaaaatcactgtactccaaagagaaagtcacgtaagtaatatgtgaggtactaagaaatctagtgaaaagagattactttcagcttgattcttcatggagaagtgaaataactcactcccattaccagttgtggattataaatgagcacagtgtatgttattgactaattgctttctctgacacattatattgaaaatcggagagttggccatctttttcaagtttgtgtatctcacataatgtaggtactagtaaattttctgtctggtagcaaaaacctcagtatatgaagaagatggaaacgaaaagccctttgaactaacctgcagtcgaaccagttcacattttgattgataaatataattaaaccttcaaatacaattataaaacaaaacactagaattttggggggattccagataagtttcaataaaatttagtctttaggggaaaagtggtattcatcatacattttaagaccatagaggaccttagaatttcatgatctgtatatagacagcttattagaaatgcttaggaagtaacttcatagacataaacataaatgggctttttgttaaagcataaaaattacaatatttacttagccttacaaagacattcagaataagtttaagaaaaacagtaacattgagaagaacatctctttcttcagtaaagacatacctttgaagttactcatggaataatcatttactacctgaagaagaatatattccaaagtgcattttattacattccaaagaatgtatttaggaagtctcacttatactcaatctataggtacctaagtttctctgcctaaactagaatagaccaaagggtcagcttatgctcagaaaggctattttctaagctttatcaaggcagaattcacttaattttgttcttctgatattgggttcttatgcaagagaatgcctggtcttattttgtaacagtgagctatctttatattaagccaaaaccaacaagatgctgtttgactatgtttatcttggccaggtgactgatttttgaagaggagcctttcatggatttggaaaaatccagtcattagaggatcattgtctttttaatctgtttcagactctttgtaaatagtctttttaaaaacttccctttttaggataagtcctattaaaaaatcaaaattcaaattcaagaaatattgattgaatatataccgtgtttcaagtaccatgctacatcctcagccttttctcttaacagtcttgctctgaggatacttcttaaattagagcctgattttttccccttcctcatgtacctcaaagtctgcagcagggcaggtggtatccttgcttcccactacaactttcaaattatttctccttcagtccccttaacatcttgcaaatctgtcacatcacactttactcctctaacccttatttgttgctgccgtctactccaccttcactgacgactcctccactgcctctgtcatcctgctgtctaacttcagcatccgcatagaggagtcattagtactctagccttttttgatccagtcatcttttattccgcgccacctcagcctcccatccatatggtcataatctagaccttatcatcatcaacagcagcactctctttgaaatctccttttcaggcatcccactctctgactgttacttactctcttactttaaaactcacactccaactactctcttaacttacaagtctacagtcctttgaccctgccacttcttttctgtgtccatcacatccttaatggccatacattcctccttacccagcttaaattccatggtcctgtcaccactctcttgtgaacaccccttacttcctggctcctttcttaggtcccactttcttggaaaaactgctttctaggtaaacccagctcttctctctatgcctgctctcaagcagctgaaaattgctagaaagtaccgttcagtgagaacaagtagattcacttcaaatttgtgaccattaatttcaaagggatatttaatatgccagtcattactagtaaattcactttccctctctctgaaaaaaagaatttctcaccttctcttgtcaaaactccaacatcctctctccccaccccctcagctgatgaactcaccaaatactacactgagaaaatagatgtcatcatgcaagagctacatcatgtttccactaccaccggcccagctgcatctacacccacaaactctgccttccctcttgttgcactgaaagaaaagtctcttccattgggttctaaatcccagctttgctacttgctggatatgtatcattgggcaagttaattaacttttctgtacctcagcttcctcatctgtaaaagaagatattagtaataccttcctctaagagttgatgtgagaatgaaatgagtaaaaaagctttaaatagtacctgactattttggggttagctgctgttttactgcaataatcatcattgccattgtccttaagacatcattgccaacttytaaggtaatttcttccttttggaccctgactcctagcacttctcacagtgctcaaagactttactctgcatttatamcattcgtcttttatacagtttcttcttctctactgggtcattcccatcagcatacaaatgtctttttttttttttcctcgagggagggactcattctgttgcccaggctggggtacaatggcgtgacccatggctcactccagcctccacctcctgggctcaagcagttctcccacttcagcctccygagcasctcctgaacacaggcacattccactcccagctaatttttaaattgtttgtagagacagagtctccctatgttgcccaggctggtcttgaactcctaggctcaagtgatcctcctgcctcagcctcccaaagtgctaggattacagacatgagccactgcacccagcccaaaatgtcttaatattactgttacctctggtgtagggagacttctttgacttcacatcctatttctctgttaccctttagagcagaactctcaaaagacttacactcactgcttctacttccttacctctgattctgtcttcttttcacccttaccaagcttttgccatttcacttcatgaaatgctcttgcccttccactccactgaaatgctcttgcaaaacggaagtcaatgacaaatatctcgccaagtcaaaggtcatgtctccatggtcatcttacttgacctctcaacagtatttgacacagctaactattccctcttttttttagtccacccaattcttatttttaaaaatttcaaatctatagaaaagttgacagatgagtgcagtaaatatctagagacccttaaatagataccaccaattgttaacatttttctatatttgttttatatctatctatgtacactcaccagattttaaaacctatttgagagtgaattgcagataacatggtgctttacccctaaatatttgaaaatacatctgctatagaaaggactttctcttgcataaccacaataaaatgatgatactaaaaaaaatttaacattgatacagtagagttcaatgtatagcatatattcaaatctctccattttcccccaaaatattctttataactttttgaatatatgttccaaagattatacattacacccactcatcatacctctttggtttcctttaatctagaaaagctcctatcctttttactgtctttgatgacatttacgtttttaaaaattagacttatttaggtataatgtacatacaataaaattcaccaattttttgtatacaatgtaatgaattttgacaaaagtaaaccattgtgaagccaccatttcaatcaagatataaatgttgtcactacttcaaaaaattccctcatgctcctttccagtcgttcccctcctgtacatttttgacatcccttctttcttgaaatatgttattttctaggctttcatgataccatgacttgtctaggtttcctcctgtatctcctcagtcagcttatccagcttctcctcttctgtcaggatggaatcttgtttgttatgttcgccacttaccaccatatccccagcccctggaacagtacctggtgtaggaaaccttgaaagatgaggcactttcatttacattaactcatgtcatgctgagctgccagttaagtgcaggctaactgttctttattcaaatgctgggatcatgtggtgtgaatccattggtcaaaaaggaaagataagaaggmcaaaatgcatgggaccagaattatttcagattttggattgtttcagattgtggaatatttgcatatacataaggagatatcctggggatgggacccaagtctagacatgaaatttatcatttatgtttcagatacaccttatatacacagtctgaagataattttatacacaatttttttttttttttgaaggcagagtctcgctctgtcgcctgggttggaatgcagtggtgcgatctcagctcactgcaagctccacctcccgggttcacaccattctcctgcctcagcctcccragtagctgggactacaggygcctgccaccacgcccggctaattttttgtattttcagtagagttagggtttcaccgtgttagccaggatggtttcgatgtcctgacctcgtgatccgcccacctcggcctcccaaagtgctgggattacaggcgtgagccaccgcgcccggcctttatacacaatttttcacaattttgctcatgaaacaaagttaatatacattgaaccatcagaaagggtcaggtgtggattttctgcttgcggcattatgtcaacactcaaaaggttttagattttggagcaatttggatttcagatttttggattagggatactcaacttttattctctttattttttatagataatgcctcaagaaagtaattcataccatttgcacaaccactatatagcagagccaagatttacatacattgtataaaatatcttctaattaattatattgttaattcaatattaaagacagatgtgcaaggattgaaaatatttgggactccaaaatttaagatagattttataccattttattcctacactataaggtgggaaagattcattgggagcagtataacataatacagtcatttgaatttgataggtatatgtttgttgaataaaagaataagtaaggtaaatgttatttggtgataactttgtgaccacttgaaaatattttactagtttaataatattttatataattaataatagttagcaagcacagattagtctaatcttttcaagtgtaaagtaattaaaacatatactaggctacctttctaccacattgagatttggacttcagagtgaattgaaattattagcctccttttcagcaattgttctataaataaaaccatgcaaaaagttgtcctataggaaactataattctataggattcttcaagacccagagataaatttctttggcttattagacttatggatttgacaaattatattataattacataatgtataatctgaagagtttaagttatgtaggcacaaaaagtttgagtacctatttattgaaagagcagagacattgtgaggctatccctaatatcagagttgttcattctgagcatataagggtttgagaaagttgaataaaatacattttctgtcatttctgagtttaaaagttacatacaacttggaaacaaaaatgagttgtggaggtgatccctctctctgactcaagtggagcttgtaaaattttggagagggtggcaaaggatagaaagtgaagacagaaattcagattttattgagcaactggtttatgtaatatgctggatggggatatttgtaagatgaatttgattttccaatttaagcacagtaaattacatttccaggtcaatgtctggtcttaaactgtaacgtattatgattatactttgtggttttaagccatggaagaaagtttcagaaatcgctaaagagagtaggatatgggtgtgaaattaatgccatttagaaatcacgtcatatcatctgtgttctccatgccagttttatttttgtaatttattgttttttactttgcattctgtttattatttaaattcctttgtttcataagagagytgaaaacaggttagtgaagctgcaagaaagtaagtctttctttgtctgaggaagttgtcacacaagattattgaaataaaaatagaatgctaggtatgctttgaaaaggcttttttaaaaaaggattgcatggttggtggaacagtggatgatggactaaaagctactgatttcttttttttaaaggattttggaagttctactagtagttactgtaagctaacatttcctgctttcaaattatttctacttatgttgtggtaaaactgttcatttcctttctttcactcttggtaaataattgaacaagatagagcatagaaaagggggtttttaatttgattttttagtgatatgtttgttttttaatggtagatagctaaactttgtagatatctttcataggggaatgaattctatgaacaagccatcagcagatatgtttcataatttggccaacatgttcattgatttgtttttactgtttcccttcccttctgtgtgccaggtacctgtttgtgtggtacatgtgtaataaaaataaacaactgtttataactgttacttgaattaagggcccacgtagatgaacaaatgactaccaggctaaactgtaattatatttaatctcaaggtaatttccatccatataaagaaaatctagaagagcttaatagcaatggttgcaaatactagtgccagcacatgcaacacatttttagttggagaggtcgtaacagaagggtaggaagcaaaccaaccaaataaatgtgttggttttaaaaataaaagaatattcatataactgcttttgatgatcacagttttttggactatcccaaggcaaatatatttggaaaccgtcctattcattctgctcaagcagcctggtttcctaagcaggtcgagagtttttccttttattcttctcaatatatttctccttaaaggtctgcaggttgtctattttttttaaaaaagtattatctaccttgcattttcattgtaattcatttcatttcagtttcatataattgcatccagacagttgaatggagtcttcacttaaaactatgttttaatttttaaaaaatacataatcatagttctctttctctctctctctctctttttttttttttttttttttttttttttgagacagagtctcgctctgtcgcccaggctggagtgcagtggcgcgatcttggctcgctgcaacctccacctcctgggttcacgccattctcctgcctcagcctcccaagtagctgggactacaggtgcccgccaccatgcccggctaattttttatatttttagtagagacggggtttcacgatgttagccagggtggtctcgatctcctgacctcatgatctgcccgcctcggcctcccaaagtgctgggattacaggtgtgagccactgtgcctggccatcagttgttttttgtttgttttattatattgagaagtccacagcaaagaatcacagtgaatgagccagttgctgtgttgagtcaacggcttaagagtggctaaggccgagattgcagaaattcttttggcctttcccagatgatcacaaagtgactgttgcagttcaagccatcatatttgtattacaggcagaaaaaaggaggtgtctatcaagaaagcagacattttccagaaatttctagaaagctctgcttatgtcttattgaacataaactgtgtcaactatttaggcctggcttcaaaggaggctcagaaagataatattttaactaggcacattatgatttgaaaaaaaatttggagtctttttagtaaggatccaccctcggcctcccaaggtgctgggattasaggtatgagccaccgtgcctggccatccgttgttttttgtttgtttgttttattatattgagaagtccacagcaaagaatcacagtgatgaaccagttgctgtgttgagtcaacaacttaagagcagctaaggccaagcagcagctgcttgctgcagcactccatcatatgctaaattggaattgagcaaagtgtctgggaagagacagtaaagagaggattcatgttgaaaagagaaataaatatttatttattgcatgggatgcagccagatgatttaggtcattaatgagttgaggaagtaactttaaactatcaaacataagaataatacaatgaagactctattaagagattattaatctggctaagaattgtatatagaaaaaaatgaagagcgaagatgagctaggatagatactaggatagatactttggaacaatctcaagatgaggtgattcaaagcttggaatgggaagaaaggaaaaatttccaaagaaattccaaaggaaaaatctatagcatttggcagctgatgatttataaaggagagagaaggaaaagctgattccatgattttgagaccagaccactgagagactagtactgccattcaaagaaatggataaaatgggagggacagtgtgagatttatgcatcttgaattagagatgtcattggtgggtatttttgtgtatctcttgtaacagattggtgtgtatttctgtgtrtctcttgtaacggaataccaagtaattcttgactgatgaatttcattttctttcctttttgttagatactaccagcsccctcacaagttagtgtccctttccatctgttgtattgtcttagacttctcctcattcaccaccttgatgcttttacaagataacaaagcttatggagataggcatggggcagcaagaaatatagagtgggaatctgcagagaaaagaaagatgagccctctttctttgcttgttttccctgtttgtttgtttgttttttctctgctttgccttgggcatgattgggattactgagattattcctcttgtctatattgttgcattagtattttaactggtgtccctaatttattatttttccatcttaattcctacaattcaccctgcatactgctgccaagatgagtcatccttacatactgcttttgttatatcattatccttcttgagaaccagcggtggattttcagtgtctatcagatgaaatccaaatgctttagcctggcatctaaggcccaggacagtctgtccccacattaccttttcaactcagttctaaccaaactgttctactaacagttccttgaatctgtattcattagttcatttaaaaatactcattcactgattctcctttatgcctaatgctggagataccaacatagaataaggtacccatgatttgtactttactgtagcctctaagtgcaagagacagaagaaaacaaaaaaaaattaacaacccaaacaaaacaattgcagcttatgacagtttgggagaaagaaagaaatatggtcccttcatgaaatatggtgggagtcaggggtagagaagacctttttgattgggtaatgaggggataacagttaaaccaagatctgaaggatgagaagaatcaactgtgaagagtcaaggggcagaagattccaagmagagggagcaacaagagagcagaggccctgaggctggaaagaatgtgttcgttttaggatttgtcagaagaccagtaaggctagagtaggacccagtagggagaggaaggaatgatacgagatcagatcgggaaggtaaacaggggccacatcagacagggaattgtaggccacggtgaagagttgtgatttatcaatatagtgggaaggtgctgaggagtttgaggtgggaagtgacttgatctgatgtacatgtaaagagatcactctatttttgcacatgtggtgtccatgtcttggattacctgtcctcttccctccaggctatctcctacccatccttcaaaatccagctgaaatcctaccacctctgcaaaacttttgctttacttctgtggaccactagaatacttctgtaggtcctagaataaatagtctttcctccactgaacmtccttaatgtaaccacctctcatttatggctttatctaacactactcaaagataattaccttgaaggtggtggtgytttttttttatttaactgtgtctcttcctcctcttcatcccatgcctaaagaaatgctctgatacttaatttttaatatatacttagagttgggaaatttttgcctttttatgattcacaaaaaatagctgttctatagctgtatcttacctccctcatttcctctggttggccttacttccctcttatttcttgaagtcattagtgtatccatttttaactcttcccaaaccattagattttctcccacttagcagagcctcttctgaactctctactataaggtaaacctggaaataaatagatttcttaagtggaaaaaatagggttaatggtagagctgcctttatatacttggaatgttattactttgctaagaatgattattgtgttgatgatttattggcagttgcatgggtaatttttccatgaatagtttatattcattgtatttgatttactaattaattatttagtttattagaaccttcacaagaccccagaggtttagattcaatcagcttgcattgatccttctaggatattagttacttctttgacccaaaggagccagttgctgagccccctgtacctaagtgaccttcagagtcctgttagctttcagtgagatcacattcactctttctgccttatggcaaaaatctgtttctactcaaacagatggtttagctttcaacaaataaaaactagagatcagcatctacttaagccaacagagttggtttgagcctcccactaactctccaaagtctgttattttttattttttaatgttaagctcctcctaatggatttatctttgtacggggaaatcaagaaccttgcactttgtcagaagatgagccacttcatataatctcaagtttctatgttttagaagaattgcttagtaagcacaggttcgactgctctgcgttctctcttttgcagttacaccaactggaaacattggggatcataactttctgtggagtgttacataggtgtgtcagcagttacatgatactttctttgttatttaagacatctgcaagctgaggatggccagtgtcatttcasagatgtacatgccaaagacatggtagttttcattgacattgggaaatactccttctcttgagcttttacaaataaaagttagagagtgctaagaaatccacatatttaaaaaaatctagaatcttgacattgaaaatataaatgcagattgttaattatatgttcctgtgttaagaaagcattcttgctttggggatcttgagtacatcagacaaaagttgcctttgaactcaaccaagtatccatagagatatttgcctctatatgtattattaattttacagaaacaaatgcctagcttaaatataatatttagattaaatagtgagacaaatgtaacctgcacaatagtttgctgctaggaaaggaattgttaggaaggccatataagcagtttctttgaagatacctaggacctatctctttcttttcactctattatgtaggacagaaccttgtgggaaatgtgatctacttggcatcattatggtatggattaggacaaagaaagatgcattaatattcctgtactcatgccataaaatatcatggttaaaaaggctttagtacaaagttatccatggtaactcccttcgagggattggattcctttctgcaacatgttgctctgtggccaaccagtttagatataatcaccgccatgtatagagactgcctgctttaaatagctctggcaatttgtaaattgttccttttctgtctcttaaatccacaggattatatataaatataatatttcttccacatgacaaaccttcagctgtgtgtatactatataccctctgagtcttcacatcccaagaccttccggtttttggaagctattcttgtgacctgggttcatggtgcctcgattctggtcattctcttctgaatgggctctggtttttccacatctgttaaagagggctgatgaatgctgagcatagtggaggatctcctaattctatatagtgtatttctattggtgaaaccaaggtgtttttttctagttacatcatacattgtaccttctgtcaaatatagtctttagctttttcatatatgttactaccaagctttttaattttatttgctgatttggatttttggcctgaatttagaactgtgtttttatcctgattagatacagtttttcattaagttccttactcaataaacattcagagaaggcttccctaagtccatggaataggttaggatcccttcccaactttatgtacccagaatactccaaactttcttatttttgtaacattcatcttacttgtaatcagtagttatcatcaacttccctgctaaattggaggcttcttaaggttaggaccttatttattcaatattctttgttattcctactgcctgacaagagtaagtgcttaatacatagtagctgctcaaaaatgtttgttgaattgaattaaatatatgaagtatctatataagccaggcactgtccattgtatctaagaaaaaaatgtaattaattaaatgaacacacagtgaaatttgaactgaatcttcaatactggccaagtgaatgaggcattctgagcatagggaacagtataagtagggatatcagagaaagaaaagtacttagtccatttggggaattaaagttggactaaagtgcacatggatcaaggtacagatgaagctgcagaggcaagcagaagccagttcatcatggccttgtgtaggacatgatacagagtttgacttaagcctctgagtaatggggaactattaaaatattttgagcagggaagaggcacaaacagagttacatttcaaaagatttccccagcagcaacataaaagatagatkagaggggattatgcttttatagggacaacagttagaaagttatcatctaggcaatagatgatgggtagttcatatttaaaaaaggattctttctgtatactatctattgtgtgtaacaaattactccaaaacctagcagctgaaagaaaacaaacattatctcagacagtttctgagggtcaggaatctagggccagcttagcagggtgattctgcttccggatctctcttgagattgaagtcaagctgttgactggggctgaagacttgattgggtctcagggatgtgcctccacattcactcacgcagcaggtggcctctttctggggctgctcacaacatggcttccccaaagcaactgttccgtaagagtgagaaagcaagtgagtaagagcactcccaagatggaagccactgtcttttaaacttaatcttggaagtctcataccatcacttctgctgcgtgctgttggttacttagaccaaccctcgtacattgtgggaggggactgtacaagggtatgaataccagaaagtggggatcatttgggggcatcctagaggctgccttccatgctgcttgtcaaagaatgtaaagagtaagtctacaagtccataatattttgatggcttatggagataagagggcagaacactccacctagaaactatcctattacctagagcaggtaaataaagtcatttgcttgactgaaaggtaagagggttaaaacccaccattctaaatgtcaagtaatagttacgttgcagtcwgcttagttttatactataaattatgatgatttggttccatgtttttttttagtataatgtgattgctgttcagctttatattcagcgcatagcactatgccaagtaatgtacaggtttcaaaagaagactaaaatgtgattcatgccttcagagagttaatttactggaaaacaaggcatacatagatcatagaaaatcttagaccccagagaaaacttaggggagtttaacacaacagcctcatgaaacagctaagaaaacgggttgagggaggtgaatggctgatccarcccagctactgacagagctgagaccagatctcagacctttaggtctgtaggcaagcattttatttaaatataaaatgtaatttgtttacgataccaagaacattcttttttaaatataatgtaaaaaacatttatagagacagggtctcacggtgttgcccaggctggtctcaaactcctgggctcaagcaatcctcctgcctcagcctcttaaagtgctgggattacaagcgtgagccaccacaccaggccaagaacattgtctgaggacttaaatcatttttctatttgaaatcagaatgacttagtatttgatgtggggaaaggcaagacataaatgtgttagaagacatttctgtcttctcttgaaagaccaactcatcctgtcactgattactgtgtgactttgagctaaattacaacacattagtaaatacagaagaaaataatgagcaatgccacatcccttgcattttttaaagcaaggaccascctaattgacagtgagatctttatattaattttcccatttaaaatagataatattcagtgttcgatgaagaaagaattatggggtagattatgaaataataattggaatactattactgttaatagtaaaaaatgtctgaactatactgttggaataataagagtagaaatgagtaaaattaagtatttacaaggtttaaagtattttggagttttgtttccttttttaaaaacaaaatgctttttaactgttcattgcctatattaccaaatagttttaagttgtacattcaggttcagctccccttttttgagtacccaccatttatgttaagtatattactgggttctttaacagatataattgcatttggtcctcataaagcctatgtgagataaacattttccccattttacagctgagataactgagaaattaagagaaccacaactgaactttctgcatggtcctttgaggtcatttttctgaaaagcaagtgctaacttttaatagtgtctttagcctttccctcaggcaacagcgtatgactaagtcaagacagcagaactaaatacgagtttatgttaccataatttcagagtaacagctactgttttatgttctggtcatctattacataaatatttaatactgagcacataatttggcatgatggcagcaaaaagatgtctatcctggagtttccatgataaaccagaaaggctttttttccccaccagtatgttaaaatatggagaaataaattaggagatggtaagctatagctttcttatcatcttaagtttacctaattaaagcactttaaaataaattcattccatccaaatttagcagccatctattgcaaagtttgcttcctttttccatgacatttaaatatacaaaagccttttttttwaaaaaaaaagcattttttagtaggtaaatgtcagtcactttcttaaactagcctgtcctagaccaacagaccagttctactttcaaaacaaaacatagcatttaatagtaaaaataaactgtcttctcactaatgaatttactgtctgcatttccatagatgtggccatgtgttttcccaggaaaactggcttgaactcaaactaagatagctactaagatccatttagacaaagtgggctataaacatgagaaatcttccgccccctattctgtgtttggttaattttgctgctctcatacattctagcaatgtaccattctgttctcccttttactccagggagcctcatttggcatatagttagtcatacgcatacacctttgaaaacagtcaatgtaactcccagttattaagaacctgatgggtgctaggcattgccttatgaactgagaggtacaaatatgaaaactatataaaagctcctgccccagataaactatgatacagaagaacatttgttagctactttttaggtgctgtgtatcaatcagttttcttagtttcaggtgacagaaactaactctgggtaacttaagtagaatttctaggagggccaaagaatctgacttggaggtacggtaaacaaaaacaaagtcctaaattacaccacagagctggacatagaccatagcttacatcagtgatagtgctgatcctgaactgtacttccagaaccaaagccatggctggcccttgcaactagataccactccttctaggccttctagggccacccttctttccagaagagtctcctttgcagtctggagctggtgcatctgtgtggcagagcctaggccatatgcctgtaccctagttacaaggaagtctgggaaataaattatctggtactttatacacttaactagtaggaggtcagctctatctcacaagataggaggttctgtaaacctaggtatgcagtcaggcactaagtggccaaaaacttctatcagcagcattttgaataatcagagaarattcaacacaggagatgagaaccaggaaacaacaaccaaaaaagaaatatggtgagtttggccttaatatcacaaaaagatgaaaaaacaatgtgttcctaaaccagtttacaaacccacagttagtgaaaggctaggtgatagcttatattctccaaagttataaagtcctaaagaatgtagcctctacttgagacccatttggtctgtgcaggtacaggcactatcatctctctctgtaaagggtcagtatgatgtttaggaaagcarcccacatttggagtcaaagccttttgttcttaccctgcgcagcccttaaccagatgtgtgacctgtaagcaaggagttcagttagtatcctcatctataaaatgagaaggttgaggtaggtgatctttaaagttcccccttggctctaaagttctatactttgtacatgataggccagtgacaactaatgtttttactcaagccgattgtatgttttagaaggcaaataaattatgagcttattttttgatgacagtacattttcataaacccaaaataattaaatctccacctcccacttagtttagttgttttgggttttttaaaacaattttattttcccacacagtacagtttaagcattcaagttgcagcaggggaaatactcattgaatttgtcatcattatttttggcttctatctttatgagagccattttagttttctagtttcagtgatctattttttagattttaagctacaatatattttaacatttgagtattaaattgcatttgtcataatgaattagaaccttacgtttctttcaaaaatagctttatctcaatatgaaatgcaagattattcacatttattataaagaggagaatttttgagacattctatatccactggtcagttactgttttgatttggtgatggaaaatcatagcaaattgtacatttaaagtaaaccaaataaataactttatgcagagatagagattgaagtagccatttggagatgagaattttatctccatgccttcaagaaagaccatatgtaaaccaggtcagaaaaataaaaattacaccatatttattttaataggaccatcttagaatacaagacataacacaagagaatttatttctggaatgacgtgaaggaatttattatacaaactgctccatctaaaacatgttcctaaaatgtaggttcgtagaattttttttttttttcccctggggacatagtttcactctgtcacccaggctggagtgcagtggtgtggtcttggctcactgcaaccttcgcctcccaggttcagtctctcctgagtagctgggattacaggtgcacaccaccatgcctggctaatttttgtattagtagagacgggagtttcaccgtgttggccaggctggtctcaaactcctgacctcaagtgatccactcgcctcagcctcccaaagtgttgggattacaggcgtgagccaccgcacctggctggttccaagaaattctaatatttgttctgtttttaaggagaaaaattattgaacaacttacctctaaactatagtcctttaatgataaacactactgttaaaaaattcttataattaacataatctgatattgttacttaagtctttgaagaaatagagaaaaactggctaacatcccttatgactgcatgtttttatatattaaatagcagtatcgaattgccttccactatctttttcagacgaaataatatatatttaaaccttgcaagccttatccttttttatacttcttttttctagaacagctttattgagttataattcacataccatacatttcacccatttaaaatctataactcagtggtttttagtacaattttagaacatatcaccccaaaagaaacccatccccattagcagtgactcctcattcacccctttccccactccagtaatgctgagcatctttttatgtgttactggccatttgtatatcttctttggagaactgtctattcaaaacatttgcccattttttattggataatttatctttttattgaattataaaaattatatcttctaggtacaagtcacttatgagatatatgacttgcaaatatttttactcattctgtgagtttgtcttttcactttcttgagcaagccttatcttgagcaagccttattcttaactctggttaaattttggttttctgaacattttgctaaattttctaaaggtctccagttgtggagtagcctgaaatgaatactttattttttgaaagtggaactaaactctaatttaagtctataatagaaaagagtaattgctataggaaccaacattttttttggttgtttaccctgtgccaagcattgtgctgagtgctttgcaaccctaaaatatagggttgttattcctgttacatagatgaagaaacaaaggcttgaagaagttaagtaagttgcacaaaatcaaaaagtgctaataaatggtcaattggaatgacaatgcaagttattttttttgaccaactttcacattttatgtggggtgtttgtattccactattgtactttttaagacaatattattttacagcctcattttccatccactacaatccctagattttttcaggcatattggaaccgaatcattcacttctgtctctttaaaactggaatttcttggtttctgaaccaagaaatttgatttgatttctatagccttttgattttttgactgtcccttccaaattggccctttttaaacaaattataacaattttcaaagctaaaaaaattctaaaggtaaacttgccattaaaatgattaaatgtaaattgcagaccattttaaatgtctttttgattagctactattaagaatttagctgatctacttcattaaaatgttatattagctcaatgaataattatatatttctgtgtaacaaattacccccaaaactttaatggcttaaagcagcatttgttatttcacagtttctttggtttaggaatccaagtagagtttagcaatgtggttctgctctaggtctctcatgaggtttaagtcaggctgctggctggtgctgcagtctcatttttggggaggatctatgtgcaagctcactcgtatggttgttgggaggattcagttccttktgagcttttggactgagacctgcaattcctcactggctgttggccagagttctccctcagttccttgccatatgcgcctctctatgagacagcacatgacatggcctctggctctgtcacaatagcaacacaagagagtgtccaagatggaagccatagtatctttgtaacctaatctcagagttgatatatcatcacttttcccrtattctactcattagaagcaaactattatgttcagcccactctctatagaagggaaataccaagggtatgaacaccaaaatatggagcttactgagggccatcttagaggctgcctgtcacactcagtgaatctattgtttaatcatggagaatccaaaagtcatggtgtttttatatagaacrttgatatgtacagttccatcctgcaaacaagtgataattttatctgaaaatatataaggaagtctctccatcctaaaatatgcatatgtgtatatgtattatttttaaagcatctttagtctgcatatacatttgctacttattaatctgttttatcaagagacaacattaaagttgtaagacacaattagaatagaaaattttatgtgtaactttatgttctccccttgacttataaagattgctattgaattttagtattggaaaactttggccaatgtaaagatgattttaatttgaacatgtacaacatgcaaaagaatattttttctccttaaatcatactttagaagtcaaccctaatttaacaaaataggtgatcctgaatggactttaattcatttattcagcaaggcttattgaattactcttctaactcatcatgagttacactcataataaaagtctgcactcctaattttggcctcccatagctcartcaatctctgtctatgtttccagtttcatttcctattgccatctcccttaaccttccactccagcacagtttttcttgctcctccccatgttgatgctcatgcatgcctcagggcttttccatcttcctgaaaacctcttacccagatcgttacatggctcgcttcacttcatttacttctctgctccagcatcactaccataaagaagcatcccaccagcactcttcacaatacagcagggaccatcaaaaagcaagagacacaataaaaatgatagttgaaaagattaatctcatgacagtgtacaagataacttgtacgtaaacaggctggattagacatggatgagtgggggccacaattaggaactttcacattcattcaggtgtgaattgataatgatccagttatgaccaccttgggcatgagtaaagctacacaaacattctcccaaaaccaggtcttccctcggatttgtgatgccggtaaattgttgccaccttcctccatcctcctctaacagagccatttcagaaccaaaactttttaaagaaaagtttgaaaaaaataagaagcaccaaagaattagcaggaaatggttaggttttaggactagaaaccacaatgcagtaggggctctgcaagaggaaggagtgagtgcttcaaagtgacatagcagctgtgtgctgttgtgcctgagactccttccaatcctagatgtttcctagtggtgctggcaaagcttctgttggctgtaccacattctttcccaatccaactccctctatgtaaagtctcataattctaaggatcctgggttcaaatgtaagtttcttccgtagtagttaccatttgggtgtttctgcttcttctaaactcccttctaattgtttttcctcttgtttttaagctagtgattttttcccctgtattttacatatgcttatggaaagaacagatatrttttcatggcacttagcatgttataaatgcattgttttccatggagtaagatcattctaccactgagagcattaaatccatgttcctaaggtaacccatgttttcctagaaacaggggaagagtcatgaccaactttcacattgtctgctttgttcttggggtatcatccattgtgataaccattcccaagaagtttcctccccaaaacagaattacttctctgcctacccttgattcaagtgacctttcattacagataatctggttttatagggaaatctagtaggttctgcactcagttgtaaagaaagacagatgcaaatgggtttcagtaattggtacaacattgtcacaaagctctttagattagcaagtacttataaactaggtggaatattttttattccatgttgttaataagaatgccctaatcctctttacacacttgaaaatatccagggaatgcagagagagacagacagagagatagactcgtatgtaatcatggacttttgagataggtaggtatagatgttcctgtaaactaagcgtttgtagcctcccaaaatttatatgttgaaatccctaccatactgtgatatggagcctttggtatgaggtcagaggcttcatgcatgggattagtgctctcataaaataggccctggagagcttcctcaccccttctgccatttgaagacacagtgagaagatgaatatctgtgaaccaggaagcaaaccctcaccagacattaaatctgccagtgctttgatctagttcttctcagcctccagactgtgaggaataaatttctggtttttataagccatcctgtctatacagtttgtcacagcagcctgaacagacagagacaagtgtaatcccatcttttccttagctgtattattaggttagtgcaaatgtaattgctgttttcgccattttaatggcaaaaatcacagctacttttgcaccaacataatatttgctcacttttctctgttgtaattttctcatatgagactgtaggaaagaatgatttaatatattctataaagtgcctagtaatataataggtccagcatatgaaagcattcataataggttctcagtaaagagtggcaatgctcgagcatttctaaagaaacggaattgattatattccattcctttttcagacagttataaatgttagaaatttctttctgttactgctccagaatctgtgcttttcaattattggttctaattcagtatttttaggcctcagagaaaaagccttaatgccgtcytcacgtggtaggctaccaggtctttgaagatggccattttgtatcccacatcttctccacatctgctcatagaaatacagtttcttcatttgctcccttatggtttaggttcgaagcaactcagaatggaacacaacgctactggtgtgttaattagcaggtgagaatggaactatcaccttttttgttgtgttcttaacacaaccttagttggcatgaatttgaggagcagttatatttcacctttgacttgtcaaacttacacttgactaaaacctacagatgtttttctttttaattttttttaatttttaatttttrtgggtacatagtaggtgtatatatttatggggtatgtgacatgttttgatacaggtgtgcaacatgaaataattacatcatgaagaatgcartatccatcccttcaaggatttatccattgagttgcaaacaatccaattattacactctttaagttattttaaaatgttacagatgtttttcaaacatgtctctgttctaccctatctctctcatcatatatwtgtatgggattttacattttgacatattaaatttcatcttgttggagtttgctcgttttcttcttacctatgaagctgttttgggaccctaactatgacagtaagtcacttggctatgcacttaatcagcatgtgtttaatatcyacactcacatttttataaatatttaacaggaagggaaatttatacctccaaacccactctaatccctgaactccaaatgcatgtaaccaactgcctgttaaatatcttcacttagatgattcctgtcagttcacacttaaccaaactgatttccaccctcaaccttctcctgtagtcttctcatcctrgtcacagtgaagcatatccgtccttcacattgcacagccaaaaaccttccttgcagtcatccttgacccattttgtttcctcccacatcccatatctaatccctcagcaaactctacttcacaatgcatcctgagtcatacctttcttacttcttaccttcttgcactaccactttggaccaaatcatcagaaatagattcctaacattttctgtatttacccttacattctttagtctttttaaaatattgacgctagaatgaacctgttaagacttaaattatgtcactcctactaaaaatacaaaaattggccaggtgtggtgaggcatgcctgtagtcagtccctgctactcgggaggctgagttgggagaatcacgtgaacccaggcagcrgaggttgcagtaagcagagattgtgccactgcactccagcctgggcgacagagtgagactccctctcagttaaaaaaaaaaaaaaaaaaaaaaaatcaccttaatgccttttatctctggttacttcaacaccataattaccataaataattcatctctgttggaatatttgtgtcccattaaaattcgtatgttgaaatctcttcactaatgtaatgatatgaaaatcagcctttatgggggtgattaggtcaygaaggcagagccctcatgaatggaattactgctcttataaaaagacaaaggactttgcagggacgtggatgaagctggaaaccatcattctcagcaaactaacccaggaacagaaaaccgaacactgcatgttctcactcataagtgggagttgaacaatgagaacacacggacacagggaggggaacatcacacatcggggcctttcggggggtgggggacaaggtgagggatagcattaggagaaatacctaatgtagatgacaggttgatgggtgcagcaaaccaccatggcacatgtatacctatgtaacaaacctgcacgttctgcacatgtatcccagaactgaaaagataataaaaaaaaaaatcacgccactcctctgttcagaacttaccagtagctttccatctcactcagagtcaaagctaaagccctgacaattgcctgcacaactctacatggttctgcctccccttcccacacatgtacacaaacacatttgcttttctgacctcattttctagccttctacccttgcttcctcctctgcatgcacagagtcctctttgctgtcccctgaacatgccaggcatactcccaccttagggcctttgcatctactgttcgcctgtctggagtgcactttcttcatcccatgcactatgaatcttccttctgctctcatttttgtttaaggtattatatgagactgtgctactaatagaaattatagggctcttttggctagtgtcaagtatagatttgcgttttggactcacataactgaatatgttagaattacatctaaagaaataattgcctataaatggagtattgtgtgtgaagagttagagtcctgccccatctcctttcctattaaatgatagtgattttcacagtatctgagatagccctttgaatatcagagaaacataagagtgtaaagatttcaaggaaatggtcatatttttcagatgagaaaagttcaccaaagattttacccattggtgccaraaatgtaaggcaggcaagaagttagtagaagaaagtcatcacactgtaacaawtattttttttaagttgtaggcactgatttccaaatgagttccataaaccactgctatttccatttgtagtatagcaataggttgtgatactaaccttaaaggtctcaagttcaacagcttattatgaggaaagctgccattcctttaagaaggtgagtttctattatctttttaaagagagaattactcctttataaaaatgtaacttcttcatactgtatttcagatctcttgctttttagtaaaacttttcattgcagtgggtttgataataatagtgctcacttttaaaaaattccctaaattttagtttcccctccagtcaccagctcacttttctgtgatcctctttagcagaactccttaaaagactcatctatacttgctgtttcctccttctctcctgctgttctctctataacccactccaaataggctttcatctcgtcgctccactgaaactacttatcaaagtttccatcaccgtcatgctaccatattatcttctccatcctcatcttattcccagcaacatttgacatcaccttggaacactttatttacgtgatttcactgagacctcctgtctggttttgtttttcatcttatttcattagatgctagttctcagtctcatttgactctttctcttctcccaaaccctatacattgaaatatcccaaggcctagaccctctagtctttggcctaggtgatctttttttatatatgtattttaagttctagggtacatgtgcacaacgtgcaggtttgttacatatgtatacatgtgccatgttggtttgctgcacccattaactcgtcatttatattaggtgatcttattcaatcacatggtatataaattacaatataggctactatgacagaggccccagaatgaaggtgcctaaacaagatgaaagttgatttctttttcctataaaagtgtgggagcttgtccaagactgataggatagcttgttagtactggagacccacgctctttctttcctgcactctgctgttctcaacatgctgtctccatcttctggtcccagatggctgcttcagcccctgcatcctgtcagtattctaaccagcaggaagaagaagataggaagtgagaacgtatcccttccctttaggactcagaagttaaacatgtttcatctgctctcatttcattggccagaactgagtcacatsatgataacttgctgaagagaatttaggaaatatagtctttaggtaggtagctatggcttccagctaaaatggagcagttcttttactagaggaaaaagagcgtgatggattttggaggacagggagcagtttctgctgcacatggctttaaatactatctatgagctaatgtctcccagatttgtagctatttcctgagttcaggactctttcctcagctgcctccctaacattctcgaacacctgcctgttcaaaattgaactcttcacttttctccccaaactcctacccatcttaggtctcccaggtgctcatgccagaaacttagaacagtcttgattccttgccttctctttcatccacttttgatccatctgccaatcctattaactttaccttcaaaatggactccaaatccaaccacttctcatcagatctatcttccacattaccaccaatgacttattttaataaaatacatatccccatcctgtttcttacttccttaaaaccttcctctgtctccttattgcctttgggataaattctaaaccctgtgtgaaccaactctttctatctctctggcctcattttcccattttccacttatattttgtatttcagtactacctagcacaacacacctcatgacttgatgtatttactaatgcttatccctctgtagaatttcccccacctcagacctggctgaagaatcccttagtctcaagtgtcacctccttcagatctttttttttttttttttgagacagagtcttgctctgttgcccaggctgaagtgcagtggcacaatcttggctcactgcaacctccgcctcccgggttcaagcgattcttctgcctcagcctcctgagtagctgggactacaggcatgtgccaccayacccagctaattttttttgtttttttttagtagagacagggtttcaccatgttggccaggatggcctcgatctcttgaccttgtgatccgcccacctcggcctcccaaagtgctgggattacaggcgtgagccaccgtgcctggccagaaaatgttctttgtcatctctccacctccccaggctaggtaggcaccttcctctttattcttgttgcaccatatgcatacccgtatcacacctatcctggatgataccagtttacatagctgcctcttytcctagatgcaagtgccttggtcaggggcaagggcttactcatctctcagtgcccaacacataatagctgctaagtaaatatttatgtaattgaatcatattgatcatgggaacaaactcccattgggagagcatcacctctgccttacatatctgagaaaagcccttgtttattgtaccctatcaactgaatctgctgggctatatattaaagtgggtattttaggccctgcttaaaaaataaaggttaaattgagcatattcattgctctgttaggattacataatgcctgatagtgcaaaaacatggttgttgactgaactttacagttgtctggggtttgtgaggcccagctatagtctaggtagctttgtgtgtttgaaggtattctgactagatgagtcagtagtttaaaagtaacaagtcactgttggtctgtgggagaagttgtgtggacttagacttgccttcactgctttaaaatcttgctttttaaaaaatcccaagaaaggtaggttctctttaaaaagtttatggcctgtatttgctgtcataaaccaacccagttttcagcctttagccgggctccactcccttagagatgaatggtaacccatataaactacatggcgattctagttgtttttagtcaggaaaagccccaaggtttttattaagaagcccagaaagaagagatgtcaaggattccggtgagaagtactatgttataagaagcagattaggataacttgtcttaaaaatgaaaaagggatgagaaacttgacaagtttttagtgctttcttagcactaaatgatgacttaaagaaagtttagtccttgccaaattttcccctttggaactgtttccactgtgtgatagagatctgccgctacgagcttgtcatcattctcatccactgtcttctttgtcttcttcgaagtcacgtcctactcctcttcctcttatcttttttttttcggcggggtgggggggttttgtttgtttgttttttgcactaagtcatagaactgaaaagactctgggtaatgttttcaaaataaagccacattgtttccaatacaacagctttctctgggttctttcactgcctccttaatgtaagtcttaatcacacttgtattaacagtagaaacactctgcagtatctcgtttcatacagtggtgttagaagcattaactcctcagccctcataccatcacaggaaaacagcaatcattgttaacccccatccattggggagatgaagaaaatgagcaaactatgaagaatgcagtttatttcgtctccataagactrtgaggcagtggaaggtaagggctagaccccaggatggctgattcctagggctcttttcctgtgctccagaatgcagtgacacctttcagttgttgctgtattcagaggtgtgtgttgcatgtgataggtacagtacttgacattattaactcttgcaaccaccctatgggttaggtattaatatccccatgttatagatgaagtctgtgattccaaagcctgatgtctctccactgtgccacacacactgactccacacaataacaattactcccatttcatatcacttgacatcctgaaagtcctccacaaacatcatcatatttaatccttaagaactttggaaatatcagtgattatcacacactttgaaataagcaagtcactaatcaatgtgatcttattaaaatttaagtcagttcatgatgctactactccgaccttccaatcatgtcacatctgtctagaatcaaggcccaaatctgtgtgacctgtgatatggtttggctatgtcctcacccacagcctcatctttttttgtttgtttgtttgtttgttttgagacagagcctcactctgtcacccaggctggagtgcagtggcgcaatcttggttcactgcaacctccrcctccagggttcaagtgattatcctgcctcagcctcccaagtagctgggattacaggcatgcgccgtgacacccggctaatttttgtatttttagtagagacgtggtttcaccatgttggccatgctggtcatgatttcctgacctcgtgatccgcccacctcggcctcccaaaatgtgggaattacaggcatgagctaccacacccagccccaaaacctcatcttgaattataattcccacatgtcaagattgagaccaggtggaggtaattcgatcatgggggctgtttcccccatgcggttctcatgatagtgagtctcacgagatctgatggttttataagcatctggcatttcccctgcttgtactaactcagtcctgcccccttgtgaaaagggtgcctgcttccactttgccttctgccatgattgtaagtttcctgaggcctccccagcaatgtggaactgtgagtcaattaaacctctttcctttataaattacccagtctcaggtatttmttcatagcagtgtgagaacggactaatacaacctgtaaggagagtggtccgctggtttcctctccagcctcatcgcctcctactcttcccttgattctctctgcttcagtcacactggtcaccttactattcctcagatactcagggcacgctcctgcctcagggcctctatacctgctcttccctctatatgtaatgccctctccccagacacctgcttgactagctcccccagttctgccaggtctcgaacaaaaaatcaccttttcacacgcacacaaaaagccatcttgctggtcaggacttgccagaccactctttgcaaaattccagtctagcccctaacatgtcatatccaccttccatgctttagttttatccttagtctttatcattttcaaacatactgtgtatttacttacttctctcgcttaccatctgctcactagaatgtgaatgctgtgagggtagggctttcatctgttttgttgttcacttctccactccagcacctgtaacatactgggcacatagcaggcactcaataaatatttgatgaatgaaaacagattagaaaatagaaagtcaaagaagctaagtgagtttccccaaaatgatatggtatagcagcatcaaagctaaaaccaagactggtcttctgatccacatgcagtttggtgctcagttaggccagaatccgaaaaagttgtaagttaagttctgaaataaaactcagccaaataaagtagtttggtgtaatttgcacttttaaaataatttttcatcagttactatatcatagaggatgaagagcagtccttcccttggactgtctccaagcagcaggaataatgagaataagttacagaacttaaaataaacccaggtgtttctgggcctgagattcttaatgtccacaatgaagggaccatgtcagttcagagctcttcacagctctaatcttgaatccatctcatggatgaatgaaatgcctggttttctttgtaatttgttcagttctatgcatacarggtatgcagtttgttctgtagataaactacacatgggtatttctgtaactctccttttatcatcattaccgtctgtttgattctttcccctacatttgtgcaaaatgtaggcttgtcatctcactgtgttgtattgcaggatcagcaagcatgtcaaggatctcatgtgtcttctaatctcatgcagcctctgctgcaaggaagctctcaccactgcctcctcagagttatccaatgggcaaagaaaccagaaggcaggacgacttaaggccagggaactaaatatgcaataatggtgtctgggggtcaggaaagcaagtgtttgtacaacatggcctggcattctttgtcactctgaattaaatctgcacatggtaatcagacctaaaagaagtgcaccaataagtcaggccattggttatccagctctatacaagttttggcaaagaaggttaaatgcagtgtttggcattgtatctcatcctggttcatttcttcattaaaaattccctctgtagagagtaaaatacagttattttgaggtggtgtccatatccttaggaacaggaggcaccgtcctaagctcctttacacataccagctcttaaatacacaacttgagtaaggtttataattctcatttctattatatgctgcacatggcttatgataaagtgaacctgcaaatgatagcaagatagaacaagtctgcaaaagtaagaatggcacgttaattacagaagttggatcctatcagtaatttaaaccaaagcatttatttgaaaacaaaatgaaacaaaacaccaatgccctcagtcaccttcttattccattcccatttgctccagtaggaattaatctctttatttctccttacccttgagcacttttatatatctgcacttgggttaaaggcagttctattaatttctttgtttggacagaagtttccttaatttaccataatcatcactgttgtcactatgccagtccagtatgtttggacttcacagataagtcttgcagtttccaaaacaccatcccatccttactgcgtttattcttgaatgacttttcactgggagatagtatacttatcttttwcaacaaaactacaaatgggatcctaataacaagtttactgtttgttaatttgtgttagatataggcatactgtcatattttcctgtaatttttcatatctggtcttgtgaactgttactagtatttttcttccatatgtattttacctaccaacttgattgtaaactgcttaaagatagaagctatgttatataagcatttcacgcatgctggctcaatgaatcacaaataattgggaatttggttagacatctcatctgaacagtccctgccctgataccaccctgggacattcagcccttggccacctgctttgatgagcacatttctatgtctcctgcttaagtacttacgtaagatgctactgagtacctgacttcagacctacagagtctgtttttgttttgttttgttttcttttgttttgagacagggtgtcagtctgtcacccaggctgtagtgcggtggctagatctcagctttctgcagcctcaacctcccaagctcaggtgttagcctcctgagtagctgggactacagacacaaaccatcatgcccagctaatttttgtatttttcatagagacaggagtactccatgttgccccagctgctctcgaactcctgggctcaagcagtctgcctgctttggcctcccgaagtgctgggattgcaggcgtcagccactacacctggcccctgcagagtctttatcaaacagaagtgaatattaggaggagcctggggaagaatyctctttgatttaccttggtgttaacactccagcgatacaactatggatcctccagaaagactatgtttttgctgtatcagtgccacctattaggaattgttccataaaagagcatgagaaactctctggagttcaaaaagtcaaaatgacatccttgctaaaaaatctctttatggtttgagttccatagttacaaccaggaatctctgggaatttggtctccaagctcttctcagagcatgtgttgcatacattctgcaaagcccttgggggatggagcaggcctagtttttggttttcagcagtgtttgttatcttcacagttaaatggaacactggaatgtgatatttactcaattttgcccatttttcattcagtatttataatttttaatgtggcaggtcttctaaaaaaccaacaaaaaattgctgattttgtgattttagtttctaaaacaaatgaaagcaaaaaacttctcgcccctgaactccatccctggctgttacccttcattctctgttcttactctttcctaagcaagtaagatatgacatttattcatcagagcattttatggttaattcactgttcaattttctaaaataccatttggcttcttacctacagagctatagcaccagaattcactcggtatatgtgtaagaatgactgcttccattttccgagagaaatagaaatagaactaagagcagtgatttccttgtgttaaagaaaaattattcatgacccttgttgaaaacaatagagaagactttattcaagggaggctatgggaacgatacaaggattacggcagtggagtcttgcagtgtgggagagagattgggctggagtctgactctgacaaggacaagtagggatttgtagccaaggagcaaggtgtgggggtcagtagatggaaaattactaagtggaaacaccaatgtaagggagattcttgctagatggactcaacagaattcttgctgaaggcaggccagggtgattagatgtcgagggtaatcagataacaagggtggaggatttttgttaaactttagccggattcttgctcaaactggattctgtaaggacagagagggaagcccagggtcaggcccatttgagcagggggcttatggagatctgattagagttagtttaatgagagtctttgtcacctgctgaaaagaattcgtttttatggctcagaataatagtgtaatcatagcaagagatgacttgtctatgtccattttataataattcaaaaatctcaataatttctgaaaaaaagaagcatttgttatcagagtcataaatgttgctatttatatgcttaagtagtagtatatcagaattcacagaaaggaacaattatttagtgtgcaagatagtatattccaaattatttcatattatagaaataaaaaatattccatagtccytaagccacgcctttttttttttttttttttttttttttttttgagatggagtgttgctcttcttgccgaggctggagtgcaatggcatgatctcagctcactacaacctctgcctcccaagttcaagtgattctcctgtctcagcctcccgagtagctgkgattataggtgtgcgccaccacatctggctaattttgtatttttagtagagacagggcttcgccacattggtcaggctggtctcgaactcctgacctcaagtgatccacccccccgtcagcctcccaaagtaccttaagccattccttttgagactctgaagaaagggtacgttcctaatgtttttggtttggattatcagttcatggcagagcagtgccttaattgtacttggtagtgaccmctactagttgttcaatcatgaatcctccagtactttttatctgaataatatggagatcctttcttagtactttgttagacagcttttctagatcggtttccaatagtagcgaaagagaaaatcctttatcccatcttttccagaattaatattttctgatcacttcatttgcaagagtaaagtaaatattgaaaataccaaagtgagcttcagtcatttataagaattgtttaaagaaggcagtcatcagttacttttttcacatgattgtattgctgagagtagtatctgcattagtctcttaagcaagactttwaaaaaatcctactgttgtccccacctttatttttgaaagataaacttaaaatttacatttttaaaaatttttaaaaagtaaaattttaaatgactcaacaggtgattagattccatctaaggatgagattgaattcacgatctcagattctcaacatatatttggccttacctattgttaatgaaacttgcctgcaaggagggctgcatgttgcagaacttaaacggagcaataaaactatttataaatccagacacctttatgaggatgtttccttggtttcacttatgtaagccgacaaaacgatcagttgtaaggaactgaaggaagtaaacacttgaatgtactcaaatgtctaggctttgctgaacattatatgattaaaaagcagccaagttcagcgtggactgagaactgctgacaatggagaacatgagacccagaatggcaaataatgtttcagacattgacttstcagactggtctccaccctgtacttaaccccattctcacccttttttggaggggaaaggaattatctagttaaaaactgaatctataggacaacctgtctctcctgaggcagctgacttatgctaattcttgcttagctcagtttcttgagtttagcagaggagatcactgtcacccacaccctctttaaatcagcctcctgtggggccatgtctacacaaccaaggcctcattcattcgtttattccaaaatatatttattgagtgccttctgtgtgccaaggactggggattcagtggtgaataaacagataaaaacacctgtccatagggaactgatattctagtgtgattactgctaggagtgtgtctgagttgaattgaggctcagaagtagatgtgtctgagaggcctcaggagtttggaaatgggggtgtccaacctgtttctttgtcctccaacaggctttattacctgtgcaggtatggtagtaagtctgttttgcatttctttaaggaatacctgaggctgggtaatatataaagaaaagaggtttatttagctcacggttctgcaggctgtacaagaagcatagtgccagcatctgcttctggtgagggcctcaggctgcctctactcacagcagaaggtgaaggggagcctgtgtgtgcagaaatcacatgatgagagaagcagcaagagaaagagggaagatgccagactctttttaacaaccagctcccatgggaactaataaatcaagaactcgctcacccctgagggagaacattaatctcttcatgagagatctgccccatgacccaaatacctcccattaagccccacctccaacattagagatcagattccaacatgagatttggaggggacaaatatccaaatcatagcaggaagagacactccctcctatgaaaacacaaatttgaagaacagttgtcttcagtgttatacaaactgctttctgactgcatataagagaattccgtttatggggttttggtctaaaattatagtgtcatgtcagatctcaatcattttaacttaaggcagttattctagcctttgaatacatttttcccctgaatattcgtggtgttgtgtgacaactatccaaaatattttaagattccattttatcagtaaaacatatgccaggctttttaataggcagagagtaatttggtagtatcattcctcttatcctttaaagttccttcatgctctagaatttaattcagtgattccttgtagaagctagcctgcccaacaccatgggcagagatattgcagagaatgccattttgatactctgagaagaacatgtaattcccatgccttgattttaaatgcaattaaagagccatagtttttcagaagaaagagtactctttggcaaacagtagtcattgcagaggtttggtccttaatctgttttcagggtagttatttcatggttactggatgttatagggacgtgcttctgaacattggtttagtttttatgggtcttgaatttcagattgtgacataaaacagttttctagtacatggtgccagtgttttaatcattagaagccagaaagtaataggccattcctcatgttggctgatgaccccaggctaaacctccaagctgtgtttaggacagtgaatcaggttccagggctagttcactcagccttcaaaatgattttttaccccaacccagtcttctcatgggcccctttgtacacacacctgaagttcacttgttttctgtttttgaggcactaattgtaactacataatcagatgtcagtttggtagtctagaaactctatttgaagaaaatacgtaataattttgttagtcattttctttttaatggtgtttcaagaagtgtttgagatcgatgaaatgatattcttttctatgatctaatgaagaaacctcccacagttgtgggcagcatttttggaaaagagtagccaggtccagtgaaaagcaaatctaataccattagtctttgaactttaatggaattagccagatttcctgaaatagtcctagaagactatcaaaagccctaggggagctaaacttgattgaaaatattataggaacttgaccatatatagcttagacctctgtggcataggctgctaaatttcccaagggagaaatgtcattgggtcacctttcaaagagtcattgttgatggttatgaattcaacagataagcttgaggttgaagagaagtgactttgattgtgttttagggacaaggtcttaacaaagtattgtctaaatttgtatttgaggatattagaaatccagaaaccaccatttctggaactattctgcgatggcactttctcaagttggagccaagaatggttgaattttcagaaagcaaaggatttcttgatgacttgaccagcaagtattagaggacagccttctcattgctgaaggttgtgttctatattttcatcatctgctgggtgccaggcactgtgctagctttgggcatgtagtggtgaacaaaacagatgttctctctgaatttatggagtggatagtctagtaggggtgacacacattattaaataagcaaataagccaaagtttaattacactttgtaacagatactatgaaggaaaagaacagatatgatttgggagtgctattagagttttggtcataggagaagacctgaggaaatgcatttgtttgatgatttaccagtattttaaatgtaatttctggtttcacagaacttgagtaagctgcacaagggaaaaaaactcatcttctgtaattcctcccagtttcttaagccactcagtaaatgctgactacggttttgtggatccattttgtggtgtctgttttcctttaggcaatcctccctctgtctaatttggatacagaatctaaatctttatgagtctgtaatagtacctggccattactggtctataatcagtgctcatataattgttgaatgaattagtgaaggttacaaattgagtgtggtttatcagttaaaagtgctctcccaattatctgatggaaccacaaaccttctcttttcccattatgcccctccttcttaacacaggtgttcccagcattctctccccaagagtaataccctatggccccagggctccatctatctcttttctacatataagtcccaagcctacaggttctagccctgttttctcctgcagagtatcagtccccaccccagtttcttactgcttgccagtcctctccactaaaatgtcctcctggaaactcagacgtgtgtgcaactcttccccctttgcctccttaagtctttagaggtcaccttctcagagagtcctcctctgggccctgcacttaaaactgcaagctactctcccatcccacctcaccccacactcaatccctaatcaacttccatgctttttccccccatagcacttattcatcattctctrtaacttattttctttattttctgtatccaccctctcactctctttttttataagaattaagctccatgaggacaggatttttttttccgttttgtttactactgtgtccccctgtgcctgtcatgtggtaggaattcactaaatgtttgttgaataaatgaatatttaatgttcaggcattatatatatataatatatcataatgcttctattgcattaggagacagtgaacaagtcagacgcttgcactgatctgtactgtcactgtgaatgtaacaaatacagactgatccaagtgttcctggtggtgactcagatatcaggagtgtctttgaccatagatgatgtgattttctgaaatgatagacaattcttgattgaattcagacaaaaacaatgctcccagcaaagtggaatggtggtgagaaaggattctgaagccatactgcttaggtttgaatctctcctgccatttgccagctgagtggctagtcacgtgatgtctccatgtttcatttcctcatctacaacataggaataataataattcttcctcatttaggagcttgttacaagaattagatgagcagtgtttagcacacagaaacactaagtgtttcttaagtaaattattattcagtagcttcgttcctggaaatttagggtatattaaactcatgtaaaagtactttatatttaaatttaaaacagtgagcttctagactaatttagtaataatcaagtttctttttaacctacrtgaattatatgagatataagacagttgtcatatgggactgtcctgtgtgtcacagaacggccagcatccctgacccctgctcactaaattttagtaatacccttcaatcatcatgaccacttagagtgcctggaaggttggtggtttttacatacactgttctagcgaggcctatacatttgttttgtgacatcattatagatcatctaactagacaagctctccctatctgaatcctcattgcccagtgtccacaatacccttatcacagtgaacaaattctgctatgtcacagctgaatgtgtgctgtctctttttttccctccctgcctttggacacttcccatcctgaatctctcctgtcagaggaactgtttttaatttatttcagcaaaaggaatacgtggtggtggccagaagctctttgccccatgcatgtgttctcccttaagcctccagaaagattcttgagtttggaagcacttaccccatctgcagttttactgttactcactcagcgttcttcccacttataactgaggggctctagttttaccacgctccctgaccagcttcaatttcaccccacctcaatttttgccaggcacttcttaagggagccaaacttcatttctaaaagtattttaacattattcaattaaatggaacatttataaattggttataagggaaaagatcaatattggagttcccatggaaggtttataagaagaagtgggcctcaaagaattaatagaattggactaagtagaaaattagactgggcagaaaagagcaggaaaggagggggtttgtttgtttgccaagcagagggaaaaaatactaacagaaatgcagtgcatggtgtgtagggatggtcaaaaccaggactcagattgaaaattataagtaagaatggcacagtagagttaacttagggaagttcttggaaaccacagtaaaaacatgacattctaccacttccttgttcattgtgttcccgcctcccttgtttttctgtttgtttttgttgaagaggtctctcgtggtccatgagtgagtggatatttatttaccttccatgcctccacacttgtgtaccccacaccccaggggattcaggcacatatacagcagcactacctgtcaccagcctagtttacacagagaaagctacctctttttagggttagtgtttgattctgaatagaaatctcattatttatgcttctttgcaaagtactggtgaagtcttatcactttttaatattaaacttcatgtaaatgttttggatatttaattgtttatgatcaaggtgtctggctwgtgtgttagtcatctcccagctaacagtctcttggcaggccatgcttaattcagttattgcatgttaacaggctgttcaaaattccacattgcctagagtttttccacctccaatgtccagacactttttctggcttctccaaccctctgggcattcagaatcatagtttagtgctcatatttgaagccatttagctctttcctttttatttgcctgattaattttgaatttgaattaatcatactttatacccttttcctgactcagttcagtgttcatctcattctgtttactcagaaagcccagaacataagatttgaaccatttgtgcagtgcccaaatgtgtgctgatggaagagtgaacctttaatgttttgactcccrtactatttggttctatttttcctaaataagtcatggtcttttttcattaagtatacatttacaaaaatggttcagtctttgcacataactcagctctcacaattccctaatctaatgttgaccatgttctattttgtcataaaacccatgattttactgctttctctttactagagccctgcatattagcagtgaagacctggtccttaatgaaagtgtggggtccatcctcagtgtctcatatccctgcctgtgttttccttcaggagaccttcctttccttcctatctaagccagagtcttctctgtttccccagttaaaactcgatctgatagtttttattcagactgacaggcaagttgtaggcaacgattgaaggtggctttcttcccaggggtggccagaactcaaagtcttaaagtaaagggtagcaggagcttcatctgccatgattaagaggagttctgggggctctctgctgctcctgggtgcatactatataaacagatgcccagccacccaggggagggacctacaaagatcatgagttaccacgagctgtttccagtttgtcctcctttaattaaaataattagagcctcgtcagtaatgacgagattgcctcactaactgtccaagggtgttagtactaagccacccaaagaacctttttataatgtctcatasagtagaccagagaatgttgctgtgactcctttatcatttatagagatgtggctatgttgggactcctaatggcatgttaccccaaatgctgaactatccagcttgtcactcagaaggagcttcctgacttcagcttcaggcattcacatgctatctggtagagtcgtcttctagcaatgctgatagtttccttggtccagaatttgttaccttcagaagaagagtgtgaggaagagatcccgttctaaagccacctagaccaaacctagcctgagtctccttctggttgggcttaagatgacaatgccattccaaccatggctaggaactcctgagtcttggaatcagatcatagctttacatttccctcaaagcatctgagcttacattcccaggttttccatctcttcttgatatttaaagctttaaaaaaccgcagttatcagtttaaaccataacaggcacgtgggctctaatgacttctgcaggtggtttgggctgtattagagaacctagtcttgatcttaaactgtcatctggattctgagttaatccaggaaaccagtaagaattagtaatgtgtattgcatgtctctgatacatgtgttttccattatttggtcttccacagtgcatgcgcatacacacacacacacgcacacacagcccttcagtttttctaaaatggggagagagggactatggttccaaaaggaaatgactggtgtggtgccttgaaatctgaacttagtcacgtgttgtaaatgaaatgactccaggcacattaacaagatttctttctttcatctcctactttttggaaaaccctttgatgagaaacattggctaacttatagactttcagatttatttctgtaaagataagtaatagccattgcaaagcagccgtacttgtgaaattggagttaagcttccataacagcggtcttaaagaataggtagggttagttaatacacagcagcaaccagctgttcttcctccctgctgagactgggaaagaaggaaattaacttcaactataatggaagagattttcaaaactggtaatgggaaatttatcatcaatgaagactattttaaacattggaacaaatgagtgaccaacagaartggaggaattatgtattctattggatttaaaatagaatatatcatctgctcaagacacttagaattggtagattagatctgtctaataatttttaactcttgggggtcacagaccccattcagaatctgatggcccctctctccaaaaacatgcacacacaaaactttgcgtatgatttcagggaacttacagactccctgaagtctataaattagacctgaatttaggacaccctggactagatgatctccaaaagtctgttttagctctctaagtgacaagctccacagcatagttgtcccatacataacaatggaatctgaagaccaaatgtcagactttgcattttcttcctccagatttgtaatgcttggcatgctcagtgtcaaagttaaaaaaaaaaaaagtagaatagaaagaattctacgtttaaattcaattctttgtcttggaaaagccaaacatttaattttaaaaatcactggttggctctgtgtcatctttgtagaaaggcagtacagaactaggttgtygccggcagttcttccccagccccacaccccgctctggattcatggatgaaaatgcaaactcagatgccatattaastactcagaattctcccatgttcacacatctttttactgtattgctgtgattgttcagttgggcttgaaaaatattatttattttctcatcagttttatgtctaagtttcattgactacaagttggaagatgaccacccagaattacaaatcagggagtaatttggtcctctccctaaaataaagagcttttatcctcttaagaagtaggaatggagtatagtctgtgtctgtgtattttaaactcatgataatgagttgccccatatgtagaaagcatgactctatatggttttcccattcccttctgtaaatattctctagcttacctgcaagttctgtagactccctttaattccatgttggaattgtacttgacactttgtgcctggaatcaggaactctggaaataaagatcgcctcaatatggaagggaagtgatctctggaaaagagcataattgtcagatgtctataacttgtcagttttcactgtacctcacactcctaatggcaaacctttaaattcatagttggaagtgtcttaatgaagtcagaaatattactgatgaataggagctaagcgtacttggccagggtctccttaccattcacatggaatgctggtccttttgacagttgtttcttcccattgttgaaggcagggaggaggacttagggattcttctctgtattccccactaaaaascccttctgttccagttgctccaatcagagtaatacactgcacagaaagcatacaagatatacgatgtctgtggacagatgctctgtggcattattaaccctggcagttgctttagcygttgtttagtcaatggaggttgtttgggagctagaattgggagagaacaggtgatcctggcacccagcccacttgtagctctgcttactgactgagagtccctctgcaccccttgaaagtttactgacagttcacacccttaaagcacatttctgtatttctggggctgaagcttatggcagagatgcacattctgttgaatatttattctttgtgtatattcctgtctgcagagaatgtgatcaatgggcaggactacgaagtgatgatgcagattgactgtcaggtgatggacaccaggatcctccatatcaaaagttcgtcrgttcctccttacctccgagatcagcagaggaatcaaaccaacaccttctttggctcccctcccgcagccacagaggcaacccacgttgtcagcaccatccctgagtcattacaatagcaccctgcagctatgctggaaaactgagcgtgggaccctgccagactgaagagcaggtgagcaaaatgctgctttctgccttggtggcaggcagagaactgtctcgtactagaattcaaggagraaagaagaagaaataaaagaagctgctccatttttcatcatctacccatctatttggaaagcactggaattcagatgcaagagaacaatgtttcttcagtggcaaatgtagccctgcatcctccagtgttacctggtgtagatttttttttctgtacctttctaaacctctcttccctctgtgatggttttgtgtttaaacartcatcttcttttaaataatatccacctctcctttttgccatttcacttattgattcataaagtgaattttatttaaagctatgccacacatgcatgttcaaatggtttccactgattcgatttttcattcatttaatgcaaacccattctggatattgtgcttatttgagaaaacacatttcaaaaccagaaaagccaaaaacactccaaaaacaagcaaaacaatttggagctttagataaaaggaaaaactcccagttggtaaagtttatctttacttaggatttgtggctcacacctaaacaaagggggtcagggagtgggtacaaatttgagaaaatagaagggtaagggaagggccagtggtggggtttggagagaggagatagctccattaatacacatgtttaaaagatggaaagttcacgcctgtaatcccagcactttgggaggccgaggcgggcggatcacgaggtcaggagatcaagaccatcccggctaaaacggtgaaaccccgtctctactaaaaatacaaaaaattagccgggcgtagtgacgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaagatggaaagttcgatgtgactgcagtatgagattaaagccacaactattgtttattttggggactctaggccaccaagtattagcacacatacttatgttttctctactaatctggtccaggtcctcatggaccacaggacaaagctttcattttcattcattcttctattgaaattataccaaattcagctgaggaatatggaagtaactttagacttaaacaagacaaaagttttttcactgaagaattgacaagtatttgctccttaaaacaacgcagattagtgaacgtggattcctgctgagggagtgcatcccataatatggcaataattttcagtttctccaacgaaaagatagtgaaggaattaaatcttttgtcctcccatggttaaaaaaaaaaaaaagctgtgttcatttttactgtactatgcctcttttttcaccatagtagacaattatgtttcatttgatgaattcatagaactggatctcatacagcgatgtcctctctaatgttctacctttcagtttctaaagtgagtcttcctccctctcctacaaaacttttcaattttttgatgtaactcatctacaaatactgtttcttaccccagttgacttgcctttgtcagatttcttcttgttccacactatagcaatcaatttctcttcttccttacaagaaagggaacgagaaattgtagcaacctctcaaggattatatgcagctagttagttttctgcctgtgaaattaggtctggctcctaaataattttaaagaaccatcagcacttctaactctctggacaggtgcctctttgtccaagctagttaaatgctttccaaggaaatcagttcaacttttgtgagcggggaaaagcagggctttattgttgtgttacctgggagtctggagtttgaaaagtgctaattaaccttcctctttttccacattacaaacctttttaagcagcgcagcactcccyttagatttggctatcctgggtgattttcagacaagaaccattttctctggggaccattcttctgctgggtgccaaggaatataaggcaaatgcccagaagaccttcaggtgactgggcagtcttatcatgggatatttcttctggccctgccccttcccattctgtaatgtgaattagccacaccagaggctgtgaccatggctagtagacagtggcaacatagtcatccccaagatgctaatcttctgctggaactgtcatacgttatcatggtcaatgtaaacctggtttgtgtggggtgattataaatagagtttccctcctctctgtgacagaatcacaggagaaggacccatctcgtggccttcttgttcttagcgcttcacttttacttcatccctcgattcccagctttttctatcatcattttrccaactcctcagatgcaagactttggttatgtcatactcaccaacgttagtccctctcttccaggtgaaaaggtgggtagcggttgggagggagtctccactgaagagcaggaaggtggtagcagggccggcagctctgccacagagctaggggtgcctgtaaggtgccgcctagagcagcctgggagctttgccttcttttgtctctcactagcccttctactctttgtcattgcctgttcttgagtggatctttgagatgaggggacaggattctcctaagggtagagtttcaggaaatgagtgaaaggcaattgacaaatgcaaagaagtagtcactttttaaattgcyggcaaagctataattaatccctaggcacaattgtagtttttattttaatgtttgtatgcacaaggccctttaggaaatgagaagttgccatgccagattaatttttttttttttttttggtgggattgccttttgggggttgcagccagaaattgtgggtaatgtgtgtatttttttatttattaaattttaaacaggattgtgcaagcttatgagacaattagataaactcatggaggaggcaggtcctcctgttattagatgattttgtgctctttgggctgacaataatacactcttgggaagtgatggtagagactgatgggaatagtctttctgcctggttgcaagtcccaaatttttaaggsttaatggaagtaagtggatgtttcctcatgttaactactgaatcagatgttaggagcttgtccctttggggttgacttatgcccagcagtacagggacacagcttcattagagtgttagtgtaaactaactccaaagttaggagttaatgtgaaaggatcatccttgaaacaartctgctgtttgccatgcttgtagtacagaaacttcacatggagttttgggtgggatttgtgttttcacaagtaaaaaatccctcacgattataaaactcagagcatcatctaatttttttttttaatgactacaagttccagcacaaaactggcatttctttgccatttcttgccagtaagaagttgacacggaggtatttgaaagcaatgttatgtgagtcattcttaagtgttccaagtaagtttagaaacagaaaaggaacttgggattcaaattgatttttcaaatcatttttaaagagacatcatcctgactaaatcttagcctgaaccttcctcccctgtgtgtattccccggtagtcaccgcagcgagatgctggtgagactgccgtggtggcatttagcatcgttaaaactggaaaactctcaagctctttgccactttcctactattttttgattcttgccattttaccaagcttaggttgtgaaacttgacagaaatgtattacaggaaaarcttataattgtatttgactttctaacacattgcaaagtttcaaagtgactttcactttcaacaacatattagaagtaaccacttttgctttcacagcctgaagagttagagcctgatctgatgccccctttcactctgaagtcatgggaaattttccagccatgaaagccctctttccactgcatactgatgggctgactcagcttccttcagccgactgagatcttttcatactattggctatttcataccaattaacctcttaaataagattgtgaattgccaaaattgatagacacttattaccacctgtggactccatattccttaccacaaatgttattttcatcagtcctgagtcattttaacttacagaaattaggattgttgctgctaatatgaataccaattataacttttagaaacaagaataaagcctaaaagagaatgaaatataagaaatgttcgttcccacccctaataacatttggaagtgaatattcccattttcttccacccacagggattgggattgatttttaatttcctaggaaacaatactagactacccaaaaagatgttgccagaatccaaaaggaactatgctcgtaaaagaaatgcagttttctcctacctaaaaaaaagaaagtaaagtgtgttctgttcttatctttttaatgactaagctttaaacagtttattttgggtaagactagaactttcagccatttgttctaatatctgtgttattagatgcaatagaatttatgaaaagaagaatgacaaaggtatctgattagaaaatttgatcttacgcatgaatccatgtcatggccagccactgtcacatagtgggtgccattctcaacatattggtttgctaactttaagcattagggatttagcacactaaaatacttttaattatattaggtttggtaactaaggagtaaataaatcataatttatcatttgccaaggccaacaaacaacactattgtgctgtttgctctcaatgaagttgaataaaccaggaggcttggcatatcccctttatgttaatcccagctagagattagtaggttgactttcacagcaattgtatattgatccattttaactcatccttgccataatttccaggccagtcaccaggacagaggagatgatggggaaacagagctttagatgaaaactactatgcactactagccttagaggcactggtttcctgttaccactttggcaagtatggatggtctaagtccagtagggcttcatccatggagccattagaactgaggggggagtgttagagatgccatttcaccaggatctttttgctcaggttgtacccatgccaattgaagaacgtgttaaagatgaggaggagagatgtaccattctctcccttaataatgatgttggtttgcaaaacctaaagaaataataacaacagactatttcatactttcaagcaagtctttatactacctgttatttctctaaaattcaaataaagaatttttaaacttaccttgtttattctgtatgtagaaagagagaaaaaagcccccaaatgaatcttcagtgttggggggttagtaatgggaaaggaagcctgaaaaggctttgtggcttgtgttactgttcagatgaaactgttgaactattttccactcttctcccaagcctaattaagtaaaaatttcctttatttaagtgtccagatatttaaactacaatcttatcaaggaaaaaaaaatctaaaaacccatattttatctatgtcttcaggaaagtgggttactcggtcacgcatcttgtcctcaccaaaggcctcttcccagcttgcaatggcaaatgccaccacacctgaagctagtcactgcagactgacagcaagggatccatccaggagtaattaatgcaggcatttactgagcacccaatgattacctctgacactggtttattaactatattatcttatttcaatcgtctctacatcctattttgtaagatggttattaataagtagtggagctggctgggtgcagtggctcacgcctgtaatcctagcactctgggaggccaaggcaggtggatcacctgagctcaggagtttgagaccagcctaagcaaaatggtgaaaccctgtctctacaaaaaatacaaaaattagccaggcatggtggcaggtgcctgtaatcccagctacaagctacatggggagctgaagtgggaggatcacttgaacccaggaggcggaggttgcaatgagccaagatcacatcactgcactcctgcctgggtgacagagtgagaccctgtctcaaaaataaaaattaaaaaatagtggcccaatatttgggcccaggcaattatgtgaattattcaccattatattattccacctgctgatacatagatctggcataagttcatgccctaaaagagctcacagtcagcccatggagccatatacataaattacaaaactacaataacatcagggttctctgagaggcaaaactacatttgtttcagaagatactttaatggacttatttagaaaatgagaccccccccccccgccccctcatctaggagaccaacctcaaatcacctctactgcagacaaagttagcagagattggagggtagagggttgaacagcagaaaagagaaatgggaccaaggaatagggctggagactaaagcccccaaggggagtgtcatgaaaagaccccctggtggcaggagggcaaaggacttttacaaactgtgatgctgaaatgcaaatcctcttcattgccccaactcttcagtaaaagcagatacacagttttgtatcaatgttgccttgggagtgagagactgaaggtaggactcaacatgatattactagtgaagaagaagacagcacagcaagataattcatacactgaagtgtcagtggacgtcaggtgaaacagggaaataaaaacttccaaccccccaccccgcccccacaatctttatggcattgtcccctgggacttctcactctatgtgggatatggttcaagccaatttttgaatctcaaagggtaaccacaaatgacatttgggttatataatacatggtatcatagatagagggcctctttagcatttaccctgtaatttacctaactggtccaattttggtagagatttaaatcacttccaatgttttgctcaccataggaaacctatcgcatatttcactccgtcgtattcattcggcatgatctgtgcaaatgcctgaagagaatcgttctcttagttcagttcagagtaggagctgatgcttattgaggacttaaccttccagacatcatgctaagcctttacaagcattagctcatttgaactttgcagcaagccttcatcatcgacataataatacctatgtctgtgaattacagatgaagaaatagtcacaagagattaagtaacttgcccaggatctcacaactagtacatagcagagttgagatttgaaatgaagtctgtcatgattttaaagccacattccttctactatgctacattgtcattcatcctttgaagtcataaagagacaaatgagtgaggaagaaaccaagccacacaacacaggcaaccagggtattgaggcatgttcaggaaagagggagagtcgctaagaggcaaggtccagcagtactcgagggttttctatgagtgactcagaaggcatacactcgatgctggctgcatgcagagcccatgctgggctgctgcaccaattcttctagacctcagtccttgtagtccccatcttggacgagttacccagtggggtggatacaagctggctcctccataattgaagatcctaggctctcctaactctcctactctactcatatccaaaagcccacccaagtgtggcatccagctccatcccaggatgtatccactgttttccctgtgatcacaagttctatagaaagttttcactgcagaattaactgctgatgtggatgctggactatgaaatagagatgcttgtgtaagagatcactaatctgcagacccaaaattgaaatggtttgtttcagaagtgaaggatatatctttaaaataaatacaacacaccatattaataaatggatcatcttgtaagattgagtgcagcagtgtcagtcctaaaagctgtatccatttggaaggcggaccttgcaaggctaacagaaaatactgttgccaattgtttacagtacagcccatatttctgcaaacatcaactgggtacaaaggaagaactgagaacctcaaaagccatctcagatgctccttccctaggtgtcctgcttgacttctgaagcctccgagttatctccatttcctgagcacccaatggagcttcgattcttgggctgcatttcttcatagtgggctagaggcaatggccctggaatttaaacatttgccactagttctaagtgttgtgcgaagctccaacatctaccatggagctgtaggaaaccatacagatgaactagacaacatccttgacatgtcctttacatgtctagacacatgagttatgtctcttccatgggactatgtggtcacccttctgtccccacagaagagtaaagatcatttccaggtgagggtaagatttctggtcagcctgaaaaagaaagttcagttggacacaagctactctcaggagagtttgggggtgggaggttcatggccagcatctttgccatgggcacagatctcacccactcacttggctgctggccccaggacatcaaatgatccatttcgccatattgtctctggtttcctggagttgctggaattcttctctgctaagccattcgttcacatgagatcgacatgttgtccccttccgcctggcaacctttaggaagacggaattacagcaacccccacacatccaactaggctgtctccatcaaatcaccagctagggggaacaggaaattcgtcttaatttagacaatatgagcaggaaagatgctgaaacacttaatctcttgttttaaatgactctacaggtcaccacccaggggagcacaactagaagcacattgcaagtagcagcacggttggggccgattccatcttcccaggatttatcatctggtacaaggcagcagggctcaaatagtccaaggaaggaaaaggccactcatagaaagattgtttttgttgccatagcagcatcttgtacttatcccttcctaactcccatcgcctttgcaattaccaggtaaacatttatcatccctgtgggacagtgagctccagaagagcaggaaccctactaatgtcttgaattcgatttttttcctccaaaagtgctgtggatatagtgtgcttgggacatggtggtttgggcattttaggctaaatcaggatttcgttgaattattgagcatttagaaagccacaaatatacactgtccttccaggagtctgcatgatagactggcatttgtcacactgcactagctaccgcaccctattcagatattcacagggcacagaagttgcagtatgtgcgatgcccagtgctgaggcaggactgcaagggaaaacagcagagatccctgccttcccttaaaagatgaggcatcatttgttttcctcttccccttttcttttcttttttttttttttttgagatgaggtctcgctctgttgcccaggctggagtgcagtggcgcgatctcggctcactgcaagctctgcgtctggggttcacgccattctcctgcctcagcctcccaagcagctgggactacaggcgcccgccaccacgccctgctaattttttgtatttttagtagcaacggggtttcaccatgttagccaagatggtctcgatctcctgacctcatgatccatccgccttggcctcccaaagtgctgggattacaggtgtgagccaccgggcccagccttccccttttcttttcatcctattgctttttcctctggcttcagtctgtggcatattagaaatgggcctggaaagaggatgtaaaccagcgagtctgcaagcggggccctgagactgcagcagcacctcaaaacttgttagaaatgcaacttttctggtcccaacccagacccattgagtcagactccaaggccgggcctagcaccctgtgtttcaacaagttccccagatgactctgagaggggactgagaaacacccgtgtagttccctgtcagcaagactggagaatgggaagatgcagactcctgccagagatgaaccttcccctggctgctgatgttggggtgggtggtaatatcaggatcacctgatgtcaggagttcaagaccagcctggccaacatggtggaaccccgtctctactaaaatactaaaattagccaggcttggtggtgcgcgcctgtaatcccagccacttggtaggctgaggcaagagaattgcttgagcctgggaggcggaggttgcagtgagtggagatcgtgccactgcactccagcctgggcgacagagctagccagaatctgtctccattaaaagaaaaaaaaagcaaagaaagaaaaagaaagaattgtgtgtgtgtgctgcatttttggaagtccacaggggttacatcttcagcatccacagcctccatccctgctgctgccaccctgggtggctgcactcccagctgagaggcctgaatcaggcctgtggatatagtgtgcttgggacatggtggtttgggcattttaggtgaaatccaggttttgttgaattattgagcatttagaaagccacaaatatacactgtccttccaggaatgtgcatgatagactggcatttgtcacactgcactagctaccacaccctatgcaaaaagaaaaagaaaaaaagaattgattaaggaatcagatgcatgcactcagccaagtcagccaccatccaggctcgggggatgcatccaggacgagaggcggaaccggctgcttgctccccaacaggtccacagctctcctgggcactgaactcctgggagcccctgcttcgaaccagcaccctttgctgtgggagggggccgtcagcctccctggagcaggtcttcactaggtggctgggagaacccccagcgctgggcaggggcaccccagagagaatgctcgtggcccctccttcgcagctctgaaggcaaggtgtgtgccccaggctccatgggcagagttggctaaaggctggaatccccttcacttcagccctagcttggtggttctcaaactttgctgcactttggaaccacctggggacctttaacaaatactggtgcgtggctcccacccccagacattctgactgaattggtagagggtgtgacctgggcataggagtgtgaacatttccccaggtgattctaatgtgcagaaaagcttgggaaccaatggacgctgtcttttgaggtctagttctgatgtttatggagcaacaccatcctagaggttgagggtgg

SEQ ID NO: 17561 - DNA, 151870 bp, Homo sapiens
  misc_feature (1)...(151870): n = A,T,C or G, or insertion/deletion polymorphism (see Tables 1-2)
agatgtttggtgttttagtaaagacagacttcaaactaagtggtgactaagcaaaccccttacataaagctttgaataggatttcataaatattccaatgaaaaacatttggagataagaaggaaaaaaagctcacacttatgaaaaaattattttcagaaaaccacttaaaattcaaattaagtcctattcatttaaatattaaaatataccataaacccaaatttaaaggaatgataatacatacatcagctttcaatggtagctgcttatttaaaatgagcatctgagggtatattccagtttcatcctcttcaaattgtgcagctcagataaatgtttattttatggaaaatatttgcaaaattacaatataaatacatgattatattaaggtaggatgactatataatttattcttatctatagatataaaatgaactcagtaaatatagcacactcttgatgaattgttagtacacagtgtttctcagtaaagtattattaagcaacagttatctagttttcaaatgtacatcttaagaagcttttaagatggaaggatmcactaaatcccccaataccctttttagttggggaaggttagtacttctgtgaattctgagatatcatatttgtgttagtgactgttcataggttccttgcatttccttaacttgaaaccttacttctttagtctgaatgttctttaaataatgccacatcagctaaccacacttttaatttgagtataatattatgtactgcatatttattcattacttaaacacatatcaacaatgaaacaatgattgaaaaaaattttgtctagacaaattccccaaattaactgtcagggcactgtggggaatctcaactaaatatagtctcaactgtaataagaatttgggttagaaatagtattttatttattctagttcttaagacatcaaatgtgaactctactttaaaattctttgttaaatatactgggatttgtttcaaaagcatcttctacccttctccattacactgatttaatggaaacctgttacaacaacagttccaacacaaacatatgcatgcacgggatcaccttatagattctagctacatagttattgaaacacatcccacctgtcaagtggcataaatgtacatcttctatatacaaaaggtaaagtgcattattaaattagtgaactgacagattgtctgcctggaccatacagctttcaaatagacaaatgtgaaattctcatattagaaccaattatttcaagaggttccaactagcttttccaccctgtcatttatttttttggccatgctctttagtgcaaataagcttgtgtttgactcaagtttcagggacatggcagtctggggctttaacaaggaaaattataaaatgtagaggaactttaatatctttataatacattgcatcttttgcataaagcaacagattagtgctgctttcgattgctaggagcacactgccaactatcaagaggaacccgtttccaaatttcatactattagcttatattactacagtttgagcctgtaccacattatgcttggattattaggtgcaaacatcatcagtgttttagaattatacagtgaactagtacttttggttactaactttcatgctcattttttaacttctaacttccagttgccttaagagtttaatgtcttcaaggcagggattctgttattttgaaggataccatgaacacttgcagctccatgtatgttacaaatgacaataaataaaatgcatattgcacagataagaatagtagcttattttataagatacatggcaatacatgtcctaagaccagagttttgaactggatcatatttaattacggctaatgaattcttgggaattttaagtatcaaaaagtcatagcatcatctcatttttgaatgattaactatgaaaaaaatgaaacaaaaggactggcagaaggcttaataattttagagtatactcaattgccagtatatatgcatctatttaatctgcagctttgagatggtaaaaactttgaagtatacatacaaagtagaaaatctggctgcttaactaattctttacttaaataattaatggaaaactaaatttaataatgtttatatacaatgagttaaagatatttatctttaagtctgacatggtattgtatgtatgtatacacacatatatatgtatacatgtatatacatatgtctgtgtgtatatatatagatatagacacatacccaaatcttatcagacccaaaaggtaaaaggaaatcatttagacctaatggatataaatattttagaaaggaagactttaagagagtgtatacactcatagcaatagcgataggaacaatcaaatactagaatattcacagctccagtttgccaaaatctgacaggttgattattattaataggcactatgatgggcagcaataacaatcagtagtacagtaattcaagtgcacatcattccttcatagaccaaaaactacttttttagcaagcctacatagttattttacagttaggactgtttaaaaatccttgctacttttagagtctcaacacccaccatgtgctattagctctagtactaacattatctcctaaccttcagttgttccatagtgatccagatggtccacaattataatgaactaatgagattccttcacgctactagaggaaatgtgaaatacaatctgcaaaccaacactagtatatatgtcggggttactgattgcttgttcttaagtaacataaaccaatgaaattaatttttttaattcataccatcaagttttcttagtgacctcacgtaaaggtattgggggacaaaactctggaagaaaaaaatcgctgatataattttaaattacttttagcatataaaagaagagctacattctgatttgaatccatgcagccagctctcatcaatgagagtgatatttgggggttgaaatcagtgttctggctcttaaatatgattagatggacttattgtgtgggaggtgaataaagccaagataaaagacaataatttcattcagaagaaaatatagctgaatagatgtaatttcagtcaattaatacaggatgggttggtacacatataacactatatccacttgtttaaaaaattgcttaggtgttgaaaaattgctgtggcacttcctggaaagtaatttttaatacaggtaaatgggtgagtcttgtgtaaagtcagaaagagcaccttggaaaatgcctgaattttcctttcaaatatatttataaccaatcttcaaataatatttttctcagactggaaatttgtattctaaattatttttagaaaaaaaaaatccccaccccctccagaattaaaacacctgtaaaatwcaggattatattggaagtgttgacatggttttaagggtagcaattgcaaaagtgctactaaaatatattattacaggtatatttttatatcagttaattggtacaccaacccttctgaaagagtgttaaagaagaagcataaagtataacaccttgagtccatgatatattttggggaagaaacctcttgcaatctttaaattagcatgaaaagctacaccaccaagatttccatagcaaagccattggatgaagcctcccactcaatgtgacataaaagtaattcctgaaactttggaaagtcaataaaaatatatggaacattaagtagaggtaaagaagggattgtaactaaacttagaataacgaattaaaactctcccatggctttgatatggcaactataaaatgtagggttaccacaaagtttgaaattatagaatactatagtattcttaagaaatattatgacattatatttttaaggtttaattaggtaataagatttgatcctttgatggtatattcagttattcaacggacaatatacgtctacttgtacttttataagtaaatatttatatataccggaggtcaatttctgtttctgtggtaactgccctacaggtaagcttagcagcttttaatgaagtagaattgaaatacttttgggggaaagtcacacttctatttaagtatatgtatcttttttcgggattatgtcatagtgcaatgtaaatcttagttatggtatttagaatgtcagaatgtcacattttgtgctgatttgcatacttcaatagtctggagcagttgaagcagctaaactatttagctctgggaaggttggaattcccgtaagaattatagtgatctatgtgtaacataacatgagaatcagacttcctgaagtatcaactactagaggtattactaataacaacgggccaaaaaagaggaaaaacttcttcaaaggataatggatcagtacttttagccaatttgtgattttaaattttgcctgatggagttcaatttcactctagtcgaggcattcttgttcttcaccactggcctttctgccatccattctcttttctttatggctgttgcaaattttcctcatctcttcttcatacttgataaaattctccccaaaccttgtccaagctttgaatggaacagtaatagtattacggtaaggtggtctcacctcacttaccttcaggaaaattccatatttattagagcccacatcaaagtagaaccttttattgtccactctgaaagaagtcccctctgggagttcaagcgggtcatcgtctccacctcttcgttcttctatgtctccttcgccatagtcttcaatcagctgaaccaaggcatcacgaaactcaatcattccttgtgctgggaggacaatagtctgttcttggcccaaactgtggccaaaataacctatcatgccagtcccccgcatcatggtttgtctaatccgtaggaagcgaccccgctgattttcctttaggtctaggtaatatttcctattgtccctctcgatatagtctgttttcaggacactgtgaggatgctcttcggaccccaccgagactggtggggagggtgccgagtgcttctgcctccttctggagccttgctctttgctgtggccatgctcttgccggtggcctttcaggcccaggtgggcatagtgctcgatgaagtcccctagacagtccttcagctccgctgccacagacagggagagggtcagtttactctttctgatgttgtcctgccggcctctccctatccagacttcggctatctttaggaagcggccccgggagctttgcttcacgtcyaggtaaaacctctttttctggatgtccactcgtttggaggccagctcctggatttcggctgcgcccccggcctgattaggggtggctgaggccgcgtagtgggggtagtgggagtgctgggcctggggatagagtctactcttgcttaggccagagccccctacattcttgcctccgcggccgcggccgccgccgcctccccttcgcctggctctttccatcttcagctgcaagtaacaaacagacacacgggatggggtgggggaggggtgttgagaacaatcgcagacgcccctcggcctgaccgccccgccgccgcccgcgacccccacgccgggcccrgctcccccggcgccgcagcgcggggctccagccactgccggccggttggcggccgccgctccggctctgcccgcgctccccgcatccctccgccgcccccggggccgctcccgcacgccgccgccgcccgtcccgcgctccgcggccccaggtctccagccggcgggcactcacatcatctctgccatcaccgccgccgccgatgcccttcacgaccaccgccgccgccaccgccagctctcggcccctctgctgcagccgccgcagccgccgccccccgcctcctcccccgccgccgccgctcgcactgccccccgccggagcagccgggcaggggcatcgcccgcggcgcccaccgcagccgcccctcctgcggccgctgcgggggccgccgcctgacttcggacaccggccccgcacccgccaggaggggagggaaggggaggcggggagagcgacggcggggggcgggcggtggaccccgcctcccccggcacagcctgctgaggggaagagggggtctccgctcttcctcagtgcactctctgactgaagcccggcgcgtggggtgcagcgggagtgcgaggggactggacaggtgggaagatgggaatgaggaccgggcggcgggaatgttctcacttctccggattccaccgggatgcaggactctagctgcccagccgcacctgcgaagagactacacttcccgaggtgctcagcggcagcgagggcctccacgcatgcgcaccgcggcgcgctgggcggggctggatgggctgtggtgggagggttgcagcgccgcgagaaaggcgagccgggccgggggcggggaaaggggtggggcaggaacgggggcggggacggcgctggaggggcgggtcgggtaggtctcccggagctgatgtgtactgtgtgcgccggggaggcgccggcttgtactcggcagcgcgggaataaagtttgctgatttggtgtctagcctggatgcctgggttgcaggccctgcttgtggtggcgctccacagtcatccggctgaagaagacctgttggactggatcttctcggggtaaagtgtcttcctattcccgttttcccagctccgtgccccggggtatctatagtgctaggcttctgagacacgtggaggcgcttaggcccgcggagcaggcccctgggctgtgtttgggagattctggaaaaacagactttctcccttttcctttcccctctggagcagctgggaaaggcgtctctcggagcttccgccattcagaaagtgtttccccgcccctgacggccccagcttgatgtttaccttgcgcgcttagttaggattgctctttctagtacggcctttattatggcagaaattgagccactacaggtctgcacagcaaagtcgagggaaataacctgctgtctatgatttagcaagtgatgatggatatttttgagttcaaatcactcagtctttaatggattttcttttctttttttcctagttgaatctcagttgttctcaggctaggtttgatatgaaaaatactactccctattgaagagggtaatataattcttaggatgctaatacaggagtctgtaagtcggagtacttcaggctttttatggttcggtacatttctttttaggggtgggatattgggataagtaggacagttcagatcttgatgtcattgaatagtggtgtctacctaaaaggaagaggctggggcacaaaattataatttaaagtgtttacttcagccaaaatgaggacagctgcccaggactcatttcccagttgccttggggagtgctccttcagccttggttacaagcaggtttttaaaggcgaaggggaagagtgggctgagacaaagttggtcaggaattgttattggtttacagagataccattgcttagtgattggctgtacactgtaactcatagggtatgagttatcgtgtccagcatatggcattttatggcttcttggttccagtctagagcccatatagcaggtgggctttaagagataattatccagctcagaccgggagtgagacgggactgttttttcattctaatrcctctctgggcctgataatttaaaggggcttgcattcttcagctaaaattttattttcttttattttttttcccccacagtggtctccctttattaatccaacaaatgtttattaaggactgctctaggcactagagataccaacaatgaacaaaacagacaaacatctctctccttttggagcttacattttagtggaaagagacaggcaaaaagtaaaattataggatgacagaaggtgaaaatagagattaaaaaggaaagggggatgaagagtgtgtgtgtgtgttgtgggtggggggctgtagggagctgcagttttacaataagtggtcagggacgtcctcgctgagaagggaatttttgagtccagagctcaaggaagtgagagaacttaccttgacgttctctggaggagaagaaagtacaaaggccctgggggaacctgcctctttatgttcagagagcaacttaagaggcctagtgagctggagcagagcggagaggaggtcagaggtcaggccagaaagggaaaggggccagaatgtgtaggactttatgggctatattgaaaattggggctttcattctgagggagatgggaagctgttggagagttgttagggaaacgtgatctgaattatgtttctaaaaaattggagtaagatatcataaaatttgccatcttagtcttttttgtatctggccaattccactcagaattcttttttaaacagctttattgagatataattaatatatcatatgattcactcatttaaagtgtgcaatacaatggtttttagtttgtcttcagagttgtacaacctttatcacaattacctttaggactttttcattacccaaaagagaatctccataaccattagtactcaatcccacccgctttcctagcaatcacttacctatttttttgtctctatatagctctcaaaccctatgatattccttctatctaactgtatttttgtactcattaacagcctctcttcattcccaccacccatccatcccagcctctggtaatcaccattctacttactacctcaatgacatcaaattttttagctcccacatataagtgagaacatgcgatatttgtctttccctgcctggtttatttcacttaacagaatgtcttccagttccattcatgttgctgcaaatgacaggatttcattctttattatggcttaatactattccattgtatatgtatatcacattttctttatccactcatctgttgatggacagttagcttgattccatattctggctattgttgaatagtgctgcaggaaacatggaagtgcagatagctctttgacatactgatttcatttcccttgaatatataccctgtagtggatttgctggacccgcttgtagttctacatttaatattttgagttatttccataatgttagtaataatttacattcccaccaacagcgaggaaggagttcccttttctccacatcctcgccaacacttatcttttgtctttttggtaatagccattctaacaggtgtgaggtgatatctcattgtgattttgatttacatttccctgatggttattgatgagcaatgtttcatatacttgttggttatttgtatatctccttttgagaaatgtctattcaggtcttttgctcattttttaaatatggttttttaatttttttatttttttgctattgagttgtttgacatccttaaacattttggaaattaacctcttattagatgtatagtttgcaaatattttatccgattctgtagattctgtcttcagtctgttgaatttgctgtgcagagaagcattttattttgatgtaatccctttgtctatttttgcttttgttacctttgcttttgaagtcatatccaaaaaatcattgcccagatcagcagtccccaacctttttggtaccaaggactggtttcatcgaagacaatttttccatccacaggagggaggggatggtttcaggatatttcaagcgcattacatttattgtgcactttgtttctattattattacattgtaatatatagtgaaataattatacaattcaccataatgtagaatcactgggagccctgagcttgttttcctgaaacttgagggtcctatctgggagtgatgggagacagtgacagttcataaggcattaggttcttctaaggagcatacaacctagatcccttgcatgcgcaattcacagtaggttttgcgctgctatgagaatctaatgccaccgttgatgtgtcaggaggtggagctcaggtggtaacgtgaggaatggggagcagctgtaaagaaaaatgaagcttcgcttgcttgcctgctgctcacctactgctttgtggcctggttcctaacaggccatggactggtamtaatctgtggccctggggttgggaacctctagccctgaccaatgttagggagcttttttcctgtgttttcttcaagtggtttcatggtttggggtcttacatttaagtctttagtccattttgagttgatgctgtatgtggtgagagataattgactactttcattcttttgcatatggttatcagttttcccaacaccgtttattgaagagcctgacctttccccattgtgggttcttggctcttttgtcaaaaatcagttggctataaatatgtggttttatttcttgggtctctgttctgttctattatctgtgtgtctctttatgccagtaccgtgctgttttaattactagagtttagtatattttgaagtcaggtagtgtgatgcccctagctttgttcttttagctcaacattgctttggctattcagagtcttttgtgaggataatgttttcaaggttcacccatgttgtggcatgtatcagaactcgatttctttttatggctgaataatattccatttgtttatattatatatatgccatatttatttattcatatgttgatggacacttaggttgtttccaccttttggctattgtgaataatgctgttattaacattggtgtacaagaatctgtttgagttcctattttcaattcttttgggaatatacctacgtgtggacttactagatcacatggtaagcttttagtttagctttttaaggaactgctaaaactgtttttccatgggagcagtgtacaagtgttccagttctccatatgctcaccaaaacttaatttccttttttaaaaattatagctatcctagtaggtggtgggaagtggtatcttactgtggttttattttgtatttctttaatgactaatgatgttgagcatcttttaatgtgcttattggccattatatgtcttctttgggaactgtctattaagtcctttgcccattttttaattgagtttttttttctgttgaattgtgggagatctttatatattctgaatattaaacccttattgggtgtatgatttgcaaataatttctcccattttgtgggttttcttcactttttgatattgttctttgattcacttttaaatttttatagagtccagtttatctgttttttcttttattacctatgcttttggcrtcatacctaattcccaaatccaakgccatgaagattttctgttatgttttcttttaatagttttatagttttactttttctattggagttttaagtaaattcttgtatattagtgtgatacattttaagttatttttgtatatggtgtgaggtaggggtccaacttcactsttttccatatggagatccagttgtcccagcaccacatgtttaagagtctattctttccccactgaatggacttggcacccttgtcaaaaatcaattggtggtaaatgtatggatttactcctggaatctcaattctattctattgtatttatatttctgtccttatgcctgtaccacamtgttttgattacagtagctttgtagtaagtttagaaattgggaaacatgagtcctccaactttgttcttcttttcaagattattttggctatttggggtcccttgcaattctgatgagtttgaggatcaccttttccatttctgcagaaaagccttttgatagggattgcattgaatctgtagataactttgggtagtattgacatcttaacaatattaagtctttctatgcataaacatgggatatctttccatttatttgtgttttctttaatttctttcagcagcattctgtagttttcagagtacacgtttttcacctccttggttaaatttattccttggtattttattcttttagctgctattgtaaatgcagttactttcttagtttcctttcagattgttcatttctggtgtataacaacagctgatatttcaacgttgatgttgtactctgaaactttgttgaatttacttattagatctagwagctttctttgagatttttatatgggattatgtcatctgtatatagagatagttttacttcttcctttccattatggatgccttttatttcttttccatgtctaatttctctggctagaactttcaatatgatgttgaaaagcagtggtgaaagtgggtatctttgtcttgcttcctatcttaggtggaaagctttcagtctttcaccattaagtatggtgttagctgtgggttttcataaatgccctttatcatgttgaggaaatacccttttattcctagttttctgagtttttatcatgaaagggtgttggattttgtcaaatgccttttctgtgtcaattgaaatgatcatgtatttttcctcccttatcttaatgtaatgtgttatattgattaattttcttatgttgaaccacccttgcctttctggggtaaatttcagtcacttatgttatatagtcctttaaattgtgttatcttataacagaatcactctgctactgttttgagcataggccatagggaaaagcaggtaaaaggtaatatggcttgaaccaacattgtagcagcggaagtggtgagaggaggtcgaattttggctttgttttgaagatagaaccaacagtatttgctgacagattagatgcagaatgtgaaaggaggagatgagtcaggatgaatccaaggcttttggcatgagcaaccagaaagatgaaggtgacttactaagatgggaaatatacaaaaggagcagtttggggaaactttatatctattgagtggaatatgccaattagagattcaaatatccagtaaataattggctatcaaagtttgaagttaagaggaatggtctaggctgtttatataactttggaagtcattagtgtataacagctaatttaaaagccagcagactctaagggagtgagtgtagagggagaagagtagaggtctgtgacttgaatcctggaatgctgtgatgtttagagattggggaggtaagaaggagcagcagagtatactgaaaagggattgttatactgaaaagggattgatatagatggagactcaagaattatcacagaaacctgataaaatgtttcaagaagatgggtgtgattaattgtgtcacttactgccggtacattgactcagatgagcgttgagaattggctataggatttgacaacataaaagtcattggaaaccttgacatgagcccttttcgtggagtggagtggttacagtgggtttaagagaggattaaaggagtggaaacagagatgctattatagatgactcgtttgagtagttttcctacaaaggggagaataataatggagcagttagccaaaagttgagtttttttttcttcttcttttttttagttggaaaaaattgcgtatatgttgatgggtcttttctggcagaccagtagagaggaaaaagttgatgatgtaggagatgggaaaatgtctttgagtagatgtcttygagaaaatgtctttgagtagatgagaggtttgcacacatggagaggttggatgtaggagtactgatagttcatccatagttacataagaaaaggtagatgtattagagttctcctgagaaacagaaccaatgggagatctttatatctctgtgtccatctctatctgtatttctgtctctgtatctatgaagagattataaaagttttaagatctgccaggagacatacccacgggagctaatggtatagttccaggccagttgtgaaggcctgagaaccaggagagcctatggtgtaagttccagtctgagtccaagtctgaaggcaggagaagaccaatgtcccagctcaaagacaggcagagggagcagatcttcccttacttagcctttttatttattcaggccttcaacaaattgaaggcccacccacattagggagggcaatctgctttactcagtctactgaatcaaatgttagtctcacccagaaacatcctcacagacacacccagaataatggttagccaaatatctgggcaccccatggcccactcaaattgacacataaaattaaccaccacagtagagtatatgggtacaaatataattatgtgatatagatttcagggtaagagcctgtggaaattcatttttgattgcttctagtgaaatcggaagcaagatcatcagctaagagtgacgatcggtggaggagatatgaagtttaagtggagaggagaaggtataaaatagtcttaggaggggaggatagtaaatagatkagggaaaagttgtaggattgccaggaagtagtaagggcccacttgaggctggtggtcacaaatttaaggtgagaccagtcaaaatggttgtgcttttcacctgctgcattcattcagctgcataggtacaggcacagagtaggtcaagagttcttttttattcggggttagagttttgccaggagatagtaataaagccagaagggcaatgaatttgagggagtatgcaaggaagtggctgttaacttggagtttaaactagtcaagaagagaattaaggactgcccaaggggtgaggacaatgatatggtagcagggcccttaaaagccccagttagatgaaaagattgttggaattgagtttctagagggaatgaacttgaaaaacaggaggtgttggttggagagtgggatatatggaattgagattatggaaggattcagtcgttggtaataacatagtatctttgtaggaataaataggtggagcaggatgcagacaagatcactggaggagggctggtcagaagactgggaggcactatctcccttggatattatacatcaaagcttgtgatctactagacaagtagtggggaaagggtaggatatagatattaatggctatagttttgatggtgatggtcatggtgatgatgatggtccattaacactcaactcaaataccatcaatttgatttatatctaacaccacaaagttaggtgttgagttacatgtggttatattgtaactaatagtcarcccttcatggacttctattctttgatgagactcttcttgtaggagtagtaggtgccttaaagcaccttttcatagttgtcagattgaaatccttcaccagtgttttaggttaaccctgttactgtggaagtttctcttggctttctgtgtgggctgcttctttgtctagttttaccttttggggttagcatactattgtgaataatttattggtgagaaggtaagcagagaagtagagtactctatgacctagtaatttcatatctaggaatctatcctatagaaatgataggaatgccttacaatacccacatatccacaagggtattcattgaacgttatttttggtgaaattcgcaagcaacctaattatcatcaatagggaattgttaaattatgatagataaaatggaattctattcagtcttcaaaaagtcagatcaagaagtggtcttacattttaattatcccatcctgtcaacaagagtgtcttcagttgcaagtaatggaaaaaccattcaaactgacttcagcaataaaaggttatttattggtctgtttcatggagacatctgaggtagagtggccttcaggcaagttcactcagggatccgactatttttctggccttattcttggccctcttctatgaaaacaccttcagggtggtttcttgtatgcttgtaagatggctacttgcatcaaccatgaccacatctagcaggagcaaaagcatcctttcccrtaccagaggagagtcccgaaatttgttgcaattggactgccttggaagcaataattatggccaggagatggaggctagagaactgagacctgatcatagctcctatccttgaatcagttgtatagcarggggaattggattttccttaagacagttggatttcacctgtagtcttggtgatgaggtcagttccatccataaaactttgctgttacacattttgggatggggtgaggagggctgaatggagattaggatgctattgaaatttgctgtacacaatggatcattatcgtcttctttcttagtgttaaggtaatcagcctctttttcctcctcctatgcttgactttactaaaaccatgagacatgtttaacctcaggactccaatttgaaaaaatatagactgttatttactttattacttacagaagcccttcatactactctcagcaagaaagaggtaggcagggagtgagggaggggggatcatgcttactgagaaacaaactatcgagtattgaaactcccccttcatatgcctgacctcagtcccattcagttaccagtaggggcccctattaattggtacctcaccagcttttgctgttcgttcataaaactgagtcattgaagtacagtagaaaaataattggactacaagataacttatttccttccataattgcaaaatatctgatttttcttcttgtttgtattatgtaaacttaccctgtctgagggtcctcctggattgttctttgcatttatatatacatagaatttcattttcttttttcttgttttttttttagacggagtctcactctgtcgcccaggctggagtgcagtggcacaatctcggctcactgcaagctccgcctcccaggttcacgccattctcctgcctcagcctccccagcagctgggactacaggtgcacgccgccacacccggctaattttttgtgtttttagtagagacggggtttcaccatgatagccaggatggtctcaatctcctgaccttgttatctgcccgccttggcttcccaaagtgctaggattacaggcgtgagccgcttgcccgaccttcttttttttttttttttttttttttgagacgttgagatagagtctcactctgttgcccaggctggagtgcaatggcacgttttcagctcactgcaacctccacctcccaggttcaagcgattctcctgcctcagcctcctgagtagctgggattacaggcgcccgccaccatgctctgctaatttttgtatttttattagagatggggttttaccatggtggtcaggctggtctcgaactcctgactacgtgatccgcctgcctcggcctcccaaagttctgggattataggcgtgagccactgtgcccggccaatttcattttctattttgaaatttaaactaccactgacacttcgttttccctctgttttacttagcatttatcttagagaataatcttaatatgtatagttctattttattcttttactggcagcttagtatgccatattttggatgtgtcattgtttatttacctattaatttaccctataactgcttcccatatttttgcttttacaaagggatgtaatgaacatcctttacatacgtctttgtgcatatgtgcaaatatttccataggatagatgtaattactgacttgaaggttatgcagatttaaaattttgatgccttctatgaaacatctttcaaaatggtgatgccagtttcttctctcgtaattactgcatatggtcaatcttttaaatttttgctggtaatgatatttcaaaattataaccagttttttggcctcatttcttgaataacttgttttttctcaaagataagaaatgtctccttcatcgtatgtcaaatttccatatttacatggatctatttctggacatggcaagttttatttatttattgtatgtatttacggtgtacaacatgatgttttgatacacatatacgtagtgaaatgattcctacagtcaaacaaattaacatgttcaccaccttccatagtctctgcagtcttcaaggttttctctatatgggattagacatgctatgtctgatctgtttttgtatttttacaccaattccacactaattttttttttttttttgactgggagtctcgttcttattgcccaggctggagtgcaatggcatgatctctgctcactgcaacctccgcctcccaggttcaagcaattctcctgcctcagcctccctagtagatgggattacagcactcgctgccacacctggctaatttttgtatttttagtagagatggggtttcaccatgttggccaggctggtctcgaactcctgacctcaggtgatctgcccgcctcggcctccgaaagtgctgggattacaggtgtgagccacctcacctggcacacactattttaattactgtagttttaaaagtttcatatttagtagggtgagtttttccttgttggtcttgtttttcaaaaaaaatttgctgctcttgagtattttctcttcccagtgaactttaatgtaaactcacgtggttcaatgaaaaattctgatgactttttttcttggtattgcttcttgagtgtattgatttaattaatatatttacagttttgggtctggctgtgccgaaacgcagtgtgtcttatccagtccttttttaactgtcttaataaaatttgctggttatctttaaaatggatcttgtatattttatgttaggtttattcccaggcaggttgtcatttttgctgttactgattttggatataaattttggatataattgtataatttggacttggatataattgtatttgattctgtcttatatataaaaatgagataggataataatttatcctaggataaaaataatttgagtatccttattttgcatctggtaccttacttgctcctgttaaacaaatagataaaattacttgtcttcaaagagatcctgtggaaaaattatttattttaggagactttggagctttgataaaaattaggcttatcttttgtaaaagctggttagtgatagcaatcagactcttttaaaggtgatttttttttctttcctttgataaaatgcttaatatgagggaggattaagaaagaggatggcttttgaacagtttcttcatggggaaataagaaattagaataatttcatgttctccaaaaaaaggagaaaaatgaccttccctcctgagcctacttcaagcctctgtttctttctgactctattgttctcatctctgcatttttccaatctcttctactgttagtgttttaggctagctcctcagtggagggcagaaattcaccttctctttagctgtctttgaaaccaagaagatagaggtatgagatcttcgtagtctgtagtaagaataatagaagccatcagaaaaaaatatcaaagctttgtagctgctcctggaagttttgatgtgaagcaggagacatcacctattggtacctgacttgcttttgctgttcattcataaaacagagtctctgaaatacagtagaaaaataattagactggaggataacttttttccttccaggaattacacaatcacaaaattgctgatttttcttcttattcatgttacataaacttatcctgtccgaaaagactgtatttgaacttactatgtaaratttgctttaggtaaatttatggctgcttccagaattgtgtattaattttccagtttcttttttaccagtctccacttttacctttccctcttccccctatacttaaattggtcttactgtaaaatttatgcgtttctctttctacctggcaatgctgattttttttttttttttttttttgaggcaaggtctcactctttcacccaggctatagtgcagtggcaagatcgtggctcactgcaacctcgaatccctgggctcaagcgatcctcccacctcagtctcccaagtagctgggactacagatgtgtgccatcgcacctggctcatttttgtattttttgtagagatagtattcgccatgttgcctaggctggactcaagccagcctcctgccttagcctcccaaagtgctgggattgctggcacgtaccgctacrtccagccagggctgagtttctgaatcatcattgcagcaagagaaattggattacctttagaccactggctctactgtgggctgggagtgggacaccttccttaaagcgcattggacattggctttgtgggtaactgatctttacctgaatgaaatttatcagtactgtattaagggtctagggtggaayggatgctagcaaggcaaccgttaacatccacttactgatgaatcctataaaattttatttcaggccatacgaagtaacagtaataaatataaaaggaaaaatagacaacctaagcaactttttaaattgacttacttgaaaactttccctgcaatttcccggtttataatggttgatttcagctgactggctatagctacttagagaacagaggaaattcattaaaaataatgaattattcagttgggtagtgaaatccagttataaagcacttcgctgtgccatggattcagttcaggtcaagtgatgttcctggtttatgggcagtgtggcttctcactatgacacagcaaagaacgtagcttttatcctttacccttgttactaactaaaattaatggcattttattgtgtttatttgtttgattccatttacagtttatttcacttggttttattagtacaaaattgtgctttatataatatttgacagttaggaaaaattgttagatacctataaagaaacaagtctctcaaaaatcatcctactacttttaaaaattacatcgtcttactacagttaacctagatgtgaatgggtagttttatttagcttttctggtttgtttgcttggtctgtttggagggaagttaagattagcagaaatgtagtaatagattcatgaaagtcttgaaagcttctttaattagagaatttaatgagggctttggcatgcattctttggtttttctctgttttcctctaccccttcttattctttttggttcattgaaaagtagaaagaaattctcaaaaaccgtacaggagaataccttataaatgatatcttctgcaataaactatagattgtatatatgtatatgtatctagatacacaatctgtgtgtgtgtatatatatgcwtgtgtgtgtataaatgtataaattagttactagtatatacgtaagtataaaamctcaatgtgcaaggttacattttcagaaaatatgtaatataataaaagaaatcaagcccagaatttttaaaaagtttattgcgctttctgttaaaaatgaaaggctttttgactggaagctgcttctcagtaaaaataacataattgtgttggtgaagcccaaagattctaatgaaaattagggtattgacaaccaaacggaattgctggagtacttaagctgctttggttttgtaatctttctgtgtcagaatatttgaaaaacacttattaatccagtcttgtaacttatccttgaaatctcttttttaatattcttttccacacacatgaaaagttagatgagtgtatgaatttctgttgtcagactagttgtaaacctcctaaatatagtttctgcagtatagttaaagagaaagaacatcctggctaacacggtgaaaccctgtctctactaaaaaaaaaatacagaaaatgagccgggcatggtggtgggtgcctgtagtcccagctactccggaggctgaggcaggagaatggcgtgaactcaggaggcagagcttgcagtgagccgagatcacgccattgcactccagcctgggcgacagtgcgagactctgtctcaaaaaaaaaaaaaaaaaaaaaaaaaaagaaagaaaataggcccagcaaggtagctcacgcctgtaatctcagcacattgggaggctgaggtagggaggattgcttgaggccaggagttcaagaccagcctgggcaacatggtgaaactccatttctacaaaaaatacaaaaattagctgggcatggtggcatgtgcctgtagtcccagctacttgggaggctgagtgggaggattgcttaagcctggggaggttgaggctgcagtgagctgtgactgagcaacagagctagactctgtctcaaaaaaaaaaaaaaaagagatgggttttgaaattcagtactttttttgagtgaggtccaatgggtcagaaagaagcattggataaatgaatccattttctcttctctgtttgaatttgtaatttgaaagaatattctacctataaagtacttcagtgcttaattagctgtcagtgaatttatatatcttatctaattcatatggatttgctatttttatctgtacctacagattcctgacctctctaaggggatcccagtatactatagggaatgaggtataatagaagtaaaagacctatcactagtcctgtcatcattccaactcatgtgtaattatagtttaaaagaagtgacatcatgtgtattgctgtttatctttacattaatcttgtggtcaagaaagcaaatactataatatataataattatataatatcataagacaagtaatataataatgggaatataatcccattttacaaatgaggaaatgaaaatttagagaaataaagtgacttgtccagggtcacatggatactaagtgaccaagtgtcaaagcagaattttccaaataacttaaagataattcttgtacaaatatagaaygaacacatgtcatatgtgttgtgttaatgagggaaccagaaggatgacaacattggttcagagagatgcaaagataaatatagacattggaggaaaaagttggaaataagattgttaggttagatacaaagctgtgttataggccaataaaaaccatagactttgaggttatcttttttactggacaggattcagttacacctttatgagaccaaaatttattatttaacatgtggatattagagtctgagttttaaaattattagtaaatgaccgtcaaataaagatatgtcccctaatgaaatactgataatcgctgggtgagcttgtgctcctatatgacattgaaatgacatactgccctctctttgtcttctaagttttggatacttttttttttttttttttgacacaaagctgcattagaacctaggtttcttgaytttcagtccagatttctttccactctacttcctgcttcttcatagtataattttcaacactagagcagtctgcataacttttgcaaaatcagctagtctttcttattagttttcctttgtgcaaagtgatgtagatacagctttcttcttcagagaaacattgtgaaattcaatgaatatttgtaaaatttgcatacgtgcccaatgtgagaaattgaaattattacttaagtattgcaactgttcttttaggatattttgtttgcaaatttcagagtaattataaatattcttgcatttttattgtaatcagtatttataaaacagtgtatttcatcacattaacctttacatattttgaataaaatagtattgaaccattttaaatagtaagtggaaatttttccacattaaacagtataacgggctaacagagttaagcattgcattatttaactaataattttttcctgaacttcagattattatctgtatgtgtcatataacttgacaattttttttttttagtgctttttaaaaagagtgggatactttattcagtttagccctcaagcaattaggcaagtcagttaccatggtaacagtaggtattaatttccttacctagttrgaggttttatgaacaaagaaatctctgagttcatccaccaaaacccaactttctcttgagactggcctcttgagactggtgttaaatttgtctattttctagaagatgacrctattctaagtggaaaatacggttctcttgaggtgaatttctactctatcaagagtgaagtagagtatggcttaaaagttaagtgattaaaaagctaccctttcttagctaatttgkaatgtaattggtcttaatttttctaaattcgttctaaccaaaatcttattggcgtgatttctattgacatgaactagaagtgacttcagcagacaacttgtcccaatatctaaatgctgtcaaatagaatcacttaagatgaatttcttccaaaacagagttcacaattttgacagataatctcttagcatttaattgactagtattaccaaccttatggaataggtccactcgtttagctatcatgaggaccattttgcaactaacttatcaaaaagccttcaccaagaagttgcatatcttattgatattttagaatgcgattatggagattaaaaatcaccacaatgggttgttaataacgccagccttgaactttcagttttagagcattttatctgtgttctgtagtcaaagttggtaaggtgtccagtgggtcatgtttgacttgctgcttgtttttgtactgtgtgctaaatggtttctacatttttcagtggttgaaaagtcaaaagaagaataatattttatgaaatttaaataaatccaggtttcagtgtctataggtaaaatttcattgtaacgttgttatgcttaagtattgtttatgacttctttgctatagtgacaaacttgagtagttttgacaaagatcatctggcctgtaaggcctagaatagttactgtctaaccctttagagaaaaaaattgctggcccttgttctatagtatgaaaaaatatagccttgattattcattaaaaaattattttcccattttattgacatacttttgtcccctgattgttaaaaggaatgcatgttcttatagaaaagttggaatatatagaaaagtataaagaacaatatgaaaaaccatttgcaattgtgagataaccactaatgttttggtatacattgctccagacttacacacaaacacacacgcgtatttattttatacaattagagtctaattttttttttgagacagtcttgctctgttgcccagggtggagtgcagtggcaagatttcagctcactgcaacctctgcctcctgggctcaagtgattcttgtgcctcagcctcttgagtaactgggattacaggcgtgcaccaccatgtccagctaatttttgtatttttagtagagacggggtttcgccatatgcccaggctggtctcgaacccctggcctcaaatcatcggcctgccttggcctcccaaagtactgggattacacacgtgagccactgcgccttaattttttaatttgcttttttcacttgaataattataagaacattatttttaatgactgtgtagtgttctgttttatggatgtaccatacttaattatttagtcataatttattattatgaggttgataaacatgataatcagattgagctcaagaagctagttatagggttgcacaattaatgaatcccaggtacctcgctgggttgctgaggctgctatttttttcctgcctgtttggaacactgtgtttgggaccaatgaggcaaaagaaattgaagagctgccattttcaattattctattagaagatacattgaagatttgtcaaatgacatagacacaacactaatccagaagattatttaatcaaaaaggcattcatttcagatatgaattcataaacatttgtaacgatcctcagtttgaagaccatatagaatccctgaagaactggaagacactatttgcttggcaaagagaagtccccagaccaactggggatgaaatattcaaagagataaatgaatactttgaaacatacaaggtactatggaaaaagagtggaagtttgggacaggtaatgacaggaagatataaaagctttacattaagttcaatctaaaactttattccaagtaacaggttgtcttattcatggagaagcagttgtaaattaaaacttgcctgtggtttggaatttcacattaaatgattacattaaaaattcaaatggtgaacctaactaaatccaagctcctacagtaccttcttttcacctttaggtgaagaaatgcggtgagctattttattactgattatgtggacagtccaaaggaaggttcataagcgaaaaggaaaaatttaaattattccatgtgagcgattcttactttgcagatttgttgaagtgtagttactggcttcaaaaagtggtatccttaactgacattttgaacacttgaattcactcaataaaaaaatgcagtgatcatgtggaaaatacattaaggtatatgacagagtttatggattcagagcaaaaattcagctttggaaaagtgaagttaaaatggttttttaagtgatgtttaattggtgttatttgaatcctaaagaagaattaatagtactagtagaggaaagtcagtgtgtctgtgacaaagctttagtattattttgaaatacttgatataaaaaagttcacgtttactcaaagcttacttaaatcatcagaataaattaacatgtttcttaattaaagaaaaggagaagctattagacttaaaaaatttttgcacccttgaaatacatacaatttgaagagattaagttgttggaatactggttaatggtgaaaaaggagttttcagtctatgaaagcaaagccttctcctttgccatttgcttttttgtagtggttgctatgtagaattcgaagaaaatattgttaaaaagtcttggtcaggagtagagtgtagcatgaacccaatgcattttaacgttaataatgaggaaaaagggaatgcatgataatttcatcaagtcagaaaaaaatggaaaaagaaaaagaggaaactgaagaaagtaactgatgaaagtaaggtgaaagggaaaacaactttttataccacctgtgaatgagattaattttcgtttccatactgaaagacaaatatattccaattaagccattcaaaataaaaaacaatttttttttggtaagagatgggatctcactatgttgaccaagttagtcttgaactcctgccctcaatcagtcctcctgcttcagcctcccaaagtgctaggatttcaggcatgagccactgtgcctggccaaaaccaaaattaagcaacaaaacaacaacaacaaaaattccagacagcctttaaaataatgataaaggttgaaaaattgtagatagtggtaggtagataagatttcaggaaaagtccaaagcaaatcataatacgttattttaaaggggggtttaaaatcctttaaaggtacaatgtgaagcattatgaaatgataaaatacatgttttttaaaaacattaattttattttaagttccaggatacatgtgcaggacgtgcaggtttgctacataggtaaatgtgtgccatggtggtttgctgcacctatcaatctgtcacctacatattaagccccgyatacattagctgtttttcctgatgctgtccctcctccaggacccagtgtgtgttgttccccatgtattctcatcgttcggctcccacttataagtgagaacatgtggtatttggttttctgttcctttgttagtttgctgaggataatggattccagttccatccatgtccctgcaaagtacatgatcgtgttcctttttatggctgcatagtattccattttatatgtaccacattttctttatctagtctatcattgatgggcatttggtttttttccatgtctttgctattgtgaatagtgctgcagtgaacatgaacatgtgtgtgcttgtatctttataataaaatgatttatattcctttgggtatatacccagtaatataattgtataacccagtaataggattgcagtgtcaaatggtatttctggttctaggtctttgaggaatcgccacactgtcttccacaatggttgaactagtttacattcccaccaacagtgtaaaagcattcctatttctccatagccttgccagcacctgttgtttcttgattttttaataaacgccattctgactggcatgagagggtatatcattgtggttttgatttgtatacaaaaaagatttgtatttctctactgatcagtgatgttgagctttttttcatgtttgatggttgcataaatgtctttttttgagaagtgtctgttcatgtcctctgcctactttttaatgggattgtttgttttttttttcttgtaaatttgtttgagttccttgtagattctggatatagacctttgtcagctggatagattgcaaaaattttctcccattctgtaggttgtctgttcactctgatttgctgtgcagaagctaaaagacatgattttagaaaaagacatgtcaaagtcatacatgctcaacgacatagcgagtacatatgtaaataaaaaattattttatgctgtgaatttgaccgaaaataacctttacctcgtcaggaattacaatcctcacgtatggtaaaggatttccctattgcaaattattccacaacattaatgttctgtgtgctttttatctatcccaagatacaagtaaatttgacaaagatattaggtttgtaaacaaatttacgttcaaatctttgcctggaagtatctagatagaattttgcatgcaaaagagtatttacatctaaaaaattacatatttcaaattaaaatgattttagtgttatagatagaaggaaagagttattgaagtttatttctgttttggcagtgtaaatgaattacttacaaaattttagaagtctacaggtgtttttataaagtttgtgttatttgtggaaacctcagttttctggcattttgccaatgaggtctactctaagtatagcagaaatttgttttccagctttataaatatatattttaagattaagaactgattttacttatataatctgggatcaacttttggcttctcctgtcaaggattttgaatttgtgacaaaatatacacttattgataaccagtgacatatataaaatgctttacaattaataaagcatatgtattttacatattttttcactacatatgacgcatgtggcaaccccaagagttgagttgtacccatcggcaaactttgatcatgattctgtgaatataggcaagcascaattgcaggtagaacattctttttttgagtcccaaaccgtgagaaacaaattacagaaatgtacctttcttttgcattaggacacgttgtagttttgtatgaacactctagttttaagcagtatgtgcaaaaacattgcacaaaggatttgtgtgttgattttgggactcctgtattattaattatgtggtttatttgactaccccacattttcaagcataaattaataaatccataattccaggcttattaacaataaacaatctagatagttgaactctttcttgctaacattttctagatatggactgtttggtatttttctactaataaagacccttagtaagctgccttctggtttgatgtcattgggatgtttactgggaactttggtggagatcttgcagtctctctcccccagtggtgaaagaatgagttacaaaccagctttccttcccagtgtacaatagcgatggagtttgttctatatggaaaatttgtttgataaaagtattctttaaaattttttgttccataaattatcagtattttcagtttctgattcatgcttgggatagttgctgcatattgtttaattttgtcagaatttatattgttaaatatcaaatacgacagactaccctcaaatcataagtagttaatgtaattaacatcctgtttcatcatgagactcttcagtgttacattaaaaactgctacctcctgggccgggcgtggtggctcatgcctgtaatcccagcactttgggaggctgaggtgggcgatcggatcacgaggtcaggagattgagaccatcctggctaacatggtgaaaccccgtcgctactaaaacatgcaaaaaattagccgggcttggtggcgggcgcctgtagtcccagctactcaggaggctgaggcaggagaatggcatgaacccaggaggcagatcttgcagagagctgagatcgtgccactgcactccagcctgggcgacacagcaagactccgtctcaaaacaaaaaacaaaaaacaaaaaaactgctacctccttattacaaataggaactaaagttgaagtttgaggaatttgctaagaactaagccttgaactaaggctattttatttgagtatgagtcatatcagggtacggatccattttactattaacaaaacaaatatgttctkttttttttttttaaatgcacacaccacgtttgagagattcttattcactgtattttctttaattatacttgaattttggtttacattgaggagtgccctcaaagatattaacagatttttaaraaatcctctaaaaaactcattcttagggaaatttgttcacttactaggtraggagcaaaataaaaatccttaatatagaagagctattatctgtcttcaaaattaagtctttgagtagatttgtgaataaatctaatagttttgctgaatttacttagatcttaagacagaataatcatgtagaaaatttaaaatgtcaggaattcataatgattcatatacccaaggattttcattgatagtraggtaaggttattcttgagaaagactcaaagtcataaaataatagamtttcgaaactaccagaattatacaagtcaattaaaatgactgatttgttttaagaggaagaaatactaaatgtataattattagatgcagcatattgtatctgttttgttttgtgattctagctcttataacctatgcttggacctaggtgtcataacttactttaaatatgtatgtttggttttcattcatattgacagtactacctctcagttttctttcagatattgttttgtatttacccatgaagacattgtttttyggactctgcaaataggacatttcaaagatgagtgaaaaaaaattggaaacaactgcacagcagcggaaatgtcctgaatggatgaatgtgcagaataaaagatgtgctgtagaagaaagaarggtatgttgytcattgactattctttygggtgagaaatttaatttatatttgactgygcaaagagtcagttgttacttgtaaacttcaagtcattgtttaggtcagagttgctgttgtctaaatgcaccaggacctagttgttgaaagggtaaactggaataaactttaattgggtttacaaaatgagaattcttactgtatattttctctttttcgggttgactttaccagtttgttctagttcagataatttagacaacattaactttgttgaattttttgtttgccagccggtcttcagcattttaaggcaacattattattacagttgtaatacgaatataattaccagagaaraaactcaggaaaataaatgcytttatgaaaatgggattagaggtttgaaaataaacttgttaggagaaataatttcacaatgggatggttttttctttgttaagttttctttatgacttcattagtttataaaacattaattgataaaacttagaactataaattgaatgcttcagtgaactttattatttcagtgaacatttgttatttgatgtgaactttgtgcctgttttgaaatttactaaactcaaggcatgtgttcrgaagagtgtttttgaagatgacctccccttcttagaattcactggatccattgtgtatagttacgatgctagtgattgctctttcctgtcagaagatattaggtaagtgatttgaatttcctgattttatttgaatttggacccttagaaggtactattatggtaatgtttgtgaatatactgagttttacaggtgaggtgtgttcaatagataattatttctatgtatacactatcaccaagttttacatttcaaataaaagtcactgaattaatttgtaatctgtcagtttgttcattcataagcttttctattacttcagacagtttttttttaacttttttaatatatgtgctgctgaagcgagcacgacagttttttaactttcagtacttaagatgttatatatagagctactgaacatactgtgtttattttaccaatttagggaaaaagtgcaaaaattatttaacctttaaatgcacctttatatttcattaaaaatatcaacatagtaatattgaataatggctatgatcggctctgttgtgtgtaattagtaacagttgtagcaaatgatccttaaaaaatgttctaactaaacattagaggccaggcgcggtggctcaggcctgtaatcccagcactttgtgaggccgaggcaggtggatcacaaggtcaggagattgagaccatcccggctaacatggtgaaacaccgtctctactaaaaatacaaaaaattagccaggtgtggtggcgtgcgcctgtagtctcagctactcaggaggctgaagcaggagaatcgcttgaacctgggaggcagaggttgcggtgagccaagattgcatcactgcactccagcctgggcgacagagtgaggctccgtctcaaaaaaaaaaaatccaaaaaaacaaccccacaaacaaacaaaaaacattagaaatgtctgttagtacttttaaaggttgccttgtaaaattaggactgcaatagtgcaatctaaggctctcaaagcataaaacaagtaataaggaattcattcagatattttccgaggtggttatacctgtcttttaaaaaaaaaattttgttatatattgggttaaaaaaagcagaggtgctgggcacagtggctcatgcctataacccctacactttgggaggccaaggcaggaggattgcttgagcccaggagtttgagaccagccatagtaagacccccatctctacaaaaaaatttaaaaattagccaggtgtctgtggtcccagctactcaggaggcctaggttttgggcccgagaggttgaggctgcagtgagccttgatcacaccattgcactccagcctgggcaacagggcaaaaccctgtctcaaacagacaaacaaacaaacraaaggcagaggtaggttaagctrtttattaatggtcttctactggtatagatataagctagaaataacattcaagtgtttttacttttactacagttatctggccactttgggactcattatactgaattagtttcacagaggaggtaaaatctgttgtttatgattacatattaactctaccattttaccttcagcattgctrtagtatgtcatatctgaaggcaattagcacaagtgacttgaagaattgtagttttgatgacttatatgtattttataaaaggcaggcagagtttttgtgtttgctttcccctcctctggacactttaaatttttgctaccacaggtttccaacaatttgattatgatgtgcccttgtgtaatgtggttggtgtttatttggcttggagttcgttgaatttttttgatctgtgtgggcttatacctttaatcaaatttgaaaaatgtcttcagatcctttttcctcccatcctgttattcttttctctttctgggactcttagtacacacaagtttgattgcttgatactgtgtcacaggccactgaggctctttcctttcagtcttttcttctttcttcctttttttctttctgtgcttcattttgaatagcttgaatagttttgtttcctgtcttcaagttcacttatatttttttcttctgtagtgtctggtctgtttataccatcctgtgaatttcttttttagatactacatattttgtttatctctagaagtcccatttggttcttaatttttttttccattttggctctcattattcatgtttctttcaaaattcttgaacatatttagcatatttttaatagctgttttaatgtacttgtctgttaattccattattctagggtttttttctttctattggatgatttttctcctgattatgggttatattttcctgtttattcctacagctgttaattttttttttttttaattaggcattgtgatcttactttgtggaatgttagattttattgttttcctttaaagaaaggaactttgtcagacatctaagttacctgaagatcaactttatgttttgaagcttgttttcaagcttgatcagggaaagtctacgtttgcctttagtctaaaggtaatttagccctataataagatgtgacccttctggagtctttgtagactgcctctggtgatcaacgatctcttctctgacttttcagaacgttaatgcctcttacctttgtgtaagtccgtcctaagaatcattcagcttatggttgtttgcccagccccatagagttttagtctatgcatgcttgtcttcgtattctgcaaagaccaaaggagtcccttagggagatttctggagctcttttcctgcctagcttcctcctctccagaactctgccccgtgagttccaggtccttcagcttccagggctctgaactctgtctccccaactcagtgctctccttgggattcttctccctgttctgttgtctgcaatgggtcccaggaagaatgtggggcaactgtaaggttcacccttcatttcccttcccttagagatcatagtcctgtactgcctgttgtctagtatctgaaacagttgttttatatgttttgtccaagtttagatttgtttgtggtgggagggtgagtctggcctcccttgttatatcatgttgkcctgaagcagaagctgagtttcttttattttttaaatatagtttcaatttttaacaactattaaataggcaagtatcaacaacaatagataacaatataatagatatgcatattcctcccactttatcaaatcttaattttcttcaatttttttttttttttttaatagggtctcactctgttgctcgtgctggagtgacagtggtgtgatcttggttcgctgcaacctccgcctcttgggctcaagtgatcctcctgcctcagcctcctgagtagctgggactacaggcatgcaccatcatgcccagataatttatatatatatttttttatagagatggggtttttgccatgttgcccaggcggtctcaaattcctggactcaagcaatctgcctgccttggccccccaaagtgctgggattacaggcgtgaaccactgcgcctggcctgttttcttcagttctttattaagaaatgaaacagtaaaatacagctgaagccccgtgtttgttctttctgattctccctctgtgcccctctgagataacttctatgagttttgtgcatttttttttctttttaataaaaacagggtcttgctctgttatccaggctggagtgcggtggcgagatcatactcaatgcagcctcaaccttatgggctcgagtgatcctttcgcctcagcctctcaagtagctacaactactggtgtgtgctgccatgcctggctaattttttatttatagtttttaaagacagggtctcactatgttgcccaggctagttttgaactcctggcttctagtgatcctcctgccttggtctcttacttaaagcactgggattacaggtgtgagccactggctgctcacatgttttttataatagtacttaataattttatgtctgaaaatattatataatgttattttgcccatttaaaaactttaaaaaatgctaacaaactgtgtactctgtaacttgtcttttttactcaacactaygtttttgagaatttttcttgttgatctgtgtagttccattttaactgttatatcttactatgtttcattatgcaacagttggttcaatccattctcttgttaatggaaatttagtttgtttctaatttttgccagtaggaacagtgttgcaatgcatattcttaaacatgtctgtacacatctgagggtttcatttatttgtgacaaaacttgccaggtcatagtgtttatgcaccttcaactagatattgtcgttgtcaaagtttttttccaaaaggattttaccaatttatacatgaaccaccgatagatatcctcttaacacgtggtattctgaaacttaatttttaccaatcagatagatgtgaaatcacgtagacttagtttgcatttctttgacttctagtgagaagtagtgtcttcacatattttttggatttttaaaatttattttttatttttgtttttcttagagacagggtcttgaacttttacccaggctgaagtgcagtgatgcgatcatagctcacgctaacctcgaactcctggactcaagtgatcctcctgcctcagcttcctgagtagctgggactacaggtgtgtgccaccaagcccagctaatttttaatttttttttttgtagagacatgctgtgttgcacaggttggtcttaaactcctagtctcaagcagtcctcctgccttgactttccaaagtgctgggattacaggggtaaaccaccatacctggccatatcttttggatttattggtcatttggattttcttttgggaattacctgttcatatttttctccatttttctgctgaataatttgtcttttcttacttatttttcaagaaattttacatattttctggctgttcattgtcagttgtatgtgctccagataacttgaacagtctgtggttgccttttaatttttgaattatgtctttagttatgcagaagtttaaaattttarcataaattaatttacactatttttctcactttagcatgagtctatcagatggggatgtggtgggatttgacatggagtggccaccattatacaatagagggaaacttggcaaagttgcactaattcagttgtgtgtttctgagagcaaatgttacttgttccacrtttcttccatgtcaggttggtatctctacatttcwtttttatatggctgataattgtaatatgtcaactttatccctataaaattaagttcttttattagctggccgttctctcattatctcaaatttatttaagtatttatgttctacctgattcactcacattccttgttttatttaattttcacaacrtacctgtgaggcattgacattttttctgttttagagaagagaaaactgaaattttaagaggctaaatgaccaggatatgtactgctattgctagcaggagtggcattcaaactgattattttttcttgtcatttatcaatcaggactgtttgctttagttaagaaatactcaaggtcaatgtgtttctgaatttaaaattactgttaaatacaaatttayacataaacatggtatgtataagaagtaggacataaatccatcatacttgacagaacttatggaaataacaagaaaatgttacagtttttccccagggattaaaaatgttgcttgaaaataaagcagttaaaaaggcaggtgtaggaattgaaggagatcagtggaaacttctacgtgactttgatatcaaattgaagaattttgtggagttgacagatgttgccaataaaaaggtaaaagcaatatatatataattttcatgatgaagattattttgtgttacacagaatgtactttctatctgaatgttagatttttttttgaaaaagcttgttatataatgtttttgtagcaataaaaaagttccaagtgaatgttctttaatgaaaacctttatttatttatttatttttaacttttgtttcaagatcggggtacatgtgcatgtttgttacacaggtaaacttgtgtcatgggggtttatcatacagattattttatcacccgggtattaagcctggtacccattagttatttttcctgattttcttcctccctcctcccaccctccacctcccacagtgtgtgttgttcccctctgtgtgtccatgttttcttatcatttagctcccacttataagtgagaacatatggtatttggttttctgttcctgcgttagtttgctaaggataatggcctccagtgccatccatgtccctgcaaaggacatgatcttatttattttttttatggctgcatagtattccatggtgtatatgtaccacattttttttaatgcagtctatcattgatgggcatttaggctgattccatgtctttgctattgttaaatagtgctgcagtgaacatatgcgtgcatgtgtctttgtaacagaatgatttatattccttttggtatatacccagtaatgggattgctggggcaaatggtatttctttctttaggtctttgaggaattgctacacagttttccacaatggaaagcctttagttctaatccatgtcttggcatagagtttcttttctttttttttttttttttgaggkggagtttcgctcttgttgcccaggctggagtggaatggtgtgatctcagctcactgcaacctccacctcctgggtttaagtggttctcctgcctcaggctcctgagtagctggggttacaggcatgcaccaccatgcctagctaattttgtatttttagtagagacggggtttctccatcttggtcaggctgatctcgaactcctgacctcagataatctgcctgcctcggcctcccaaagtgctgagattgcaggcgtgagccaccgcacctggccggcagacagtttctttttttctttttgagacagagtcttgctctgtcgcccaggctggagtgcagtggtgcaatcttggctcactgaaacctctgcctcctgggttcaagygattctcctgcctcagcctcccgagtagctggcactacaggcgtgccaccacacccagctaattttttgtattttttttagtagagacgaggtttcaccgtgttagccaggatggtcttgatctyctgacctcatgatccacctgcctcggtctcccaaagtgctgggattacatacagtttctttaagcaagccttctcttttccttcctcccagttcttggtactctttcactttcatatatttgcaaatgtaaaattgtgttttaggtgtatatttttaatccatgtataccagtaacttaaaaaaaaatttttttttttttaagggagagcataatggagctcttgtgatacggtgctcttagtggaagtttggctatcaattccatcacctgtatttcacatattttattaatgaagttcttaaattaaattctcatatttagccaagtattcatttggctgggaggtagaaagcctactaaccaactttttttcatgaacaatatttttaaagtccaagatttttaatacctacattagggaaattctagaattaaattcttacaatgtggactgcatatgaggcttttagtgacagggaatttgttgaaggctatctgtgggttgtattttggtataacatttcctaattttatttgtggtatgttcatttgatatcatttggtaatacctgaaaacaggaactgattttactgtgttgctttttcatcatttctagctgaaatgyacagagacctggagccttaacagtctggttaaacacctcttaggtaaacagctcctgaaagacaagtctatccgctgtagcaattggagtaaatttcctctcactgaggaccagaaactgtatgcagccactgatgcttatgtacgtgcttaaagatctttagaaattgtgatgtgttttaaaaacattattataaatgactttagaaaaattttattatagtagtggcagaaactctaccaaaatattttatatcaatttggcattgaaaaatgcttaggaagacatttagtgaaactattcattttcgatattaattagcaagtaccaatcaacagattgttcaatgctagtttattttcattgtcatgaagccaaattaatgtctaatttgtatgttaaaaaatgtgaacttgctgaaaacatgaaaggctaataaatccaggctgagcaagcataaatagtactgatgatggatttgatatataaacaattcagaatgaaaataattatagtacagtttctattttaaaactggccttatttcttatatataaaatgtggtgaaattttagaaaaattgcctccaaatttagcttgttgctgccattagatatatttttatatttacatgtttgtatgtagtgaaatctgggcttatctttatatatagcactattgtgtgttttttaagaaatgtattttattccacagtgaatttgttttctcctaactcatgctttcatttgtagatgaatattttattgtttctcctttgcatctatcaaaggaatggaaactcctttgaattgtaaccagcaaacaattcacttttgttagggaaattggatgataattttcctttaaaagataccgccaaacttgagactaacattctcagctgatttaagtaggatttctcttactagattgcattttgttagattccattttaagttattttatttggatattgtgtgtaatattgagtgtgaaaaagtgaaaacaaacttttaaggctcaggcacctttctcaattttcacaattggtatgattattaaatgaggacatattgatatttgtgtcacataataggttgaattccatgtttgggtgctttgtgaatcattctcttcgatttttctgaagatgggacttactgttttatttcggtgatctttagcatacttttwaaatttttctgtttttttataggctggttttattatttaccgaaatttagagattttggatgatactgtgcaaaggtttgctataaataaaggtatgttaagatccataaataaaatgtgaattcactcttttgtgaggtttatctccaaaaaaggcaatattcayatatttgcaaagcatttagtactataacttcttgaatgtctgagcrgtcctgrcattagggtgggatccatcagggcccaagatgagtgtttcatctttgttacttgtggcaaagcagcccttacttcttttactttgtagcattgctatgtatttggcttctagagttggggctttgtggctttcttattgcagtgacacaaccagctttctcctagtctggagrttatacatccttgctataagtatttaaaatgctttctatataatgctttaaaacatgtaagatggcttatccccaagatggtagctaataaacactaagtgataaagtaggtaaagatctatttattcatttattaaatattgttggtcattttacagtgctttctaacatactgatttacatttctaattttcttctgtcatttttctccaaaaataatggtcatgtcatccaacctcagtgctgtttttagaggtcttgataagccagtgagagcagaaggagccacgtagtagagtgggtgagcccaggctttttgttgcacagaccaatgtgaatcccagccatgtgacctgggatgtacctgtttctccaaacatggaatgtagatactagcataatgtccgttttaccgttttatagaataattgtgaagacttaaagggacaaactattcgaagcatctgtattgatataaagttatcactattctcgtagcttccttttggagattttaaatgattgtgtttgttaagatgttaattaaattaggccattttgctaaatgctcttaaaaatatggcatgactgcctcatataaaatgatatgatattctttataattgtcgttgagcctctgtgggtggcaggccctcctttatatgttaaggtagaagagtctttattcttacttctcctccctggagagccacttcctatgaatgcctgctggttctctgtagtcagaggtcttgtggctgtaacttagagtcagtctccatatccctgggttctgcatctgtggattcaaccaaccacagattgagaacattcaagccaaaaaaaaaaattcacagttttaaaaaaggaaaagttgaatttcttgcatggagtaccacattgaatctatatgaatgaagtgatgcgtaggcattttataaggtattataagaaatccggagatgatttaaagtatacaggacaatgtgtatagattatatgcaaatattgcagcattttatataagagacttgatcatctatggatttgatatcagtgggagggaggttcctggaaccaatccctcaaggatacagaggaatgactgtatgttaattaactgaggcaggtgatcggttttttaagctgattagggaaacagtatataagaacttacttaactcataataaaactaaaattcaacaggggagagttatgattttttggctttatggttgtggaattgcatgtaggttacatgtacaattttgttacatgtgcaattttgatgaaaatgcttccaaggaatgtttatgatatttttcactaaagtaacatatattaataacacagtactggaagtcctggtatctgtgtacttgtcattgtaatgctacattatttgaccttcactttttttcccctttattacattatatgtgtgagtatattgtgacatcttgactcagattccagtgaattgtattaggttggtgcaaaaataattgtggttttggtaatttttaatggcaaaaaccacaattacttttgcaccaacctaataactaagattaccatctttttttccttccttcctcccttccttcctttctgttattcagccagaagtatcagcatcactgttctcttattttcttcatgtacatatggatgatattttcgaatgaccacttttctcttttgctttttattattagactgtttttttcttcttgttaaaggataaaargattagaacataaaaggatatttacacattgtttccccattgacttattcccaagatggtagctaataaacaccaaatgatatagtagttaaagatacattgactcatttattaaatattgttgagcattttacgatatgggaataccgtagtgaacaagccaggcatactctgtttcctgaggggcctacagttttattggggatatagatgagtgaagaaagcaattgcagtgtagggagatgagtcttaygtcatgggaaaacaaggtgctgtagttgacacaccgagaggcatctgacacattgggggaaatattctagaatatttcctggagaaagtgcaggtaaaagccagacctgaaacctgagcaagagttagctaaggccaggtgcagtggctcacgcctgtaatcctagcactttgggaggccgaggtgggtggatcacctgaggtcaggagtttgagaccagcctggccaaaatggtgaaacaccatctctactaaaaatacaaaaaattagctgagtgtggtgacgggcacctgtaatcccagcttcttggraggctgaggcaggagaatcgctttaatctgggaggtggaggttgtagtgagctgagattgcaccattgcactccagcctgcacaagagcgagactctgtctcagaaaaaaaaaaaaaaaaaagttagctagctgaagagtataggaaagaatgggtacaggaaattacaggtgccaagttacagaggtgagagaaattatggtatctataggtaattgaaagtaattcagtatagtgaacattgaatagggctgggcggatgaaggcaaagcagaaaaaggaaagcagawgggccatggtaaggagtttatatctcctcccaagagcaatcgaagtgactgagagttttaaacacagcagtgaagtgaattacattaaaaaaataagaacttgggctctagaataaaaaacggatataggaggaaggcaggagtcacagtaggaatatcttttgggaggctgtgacaataatccaagtgagaagtaatggcaacttgagtcggttaattgtgttgagaatggagagaagttgacaggttcaaaattcatttttcttctttttttgagtctcactctgtcacccaggctggagtgcagtgatgcgatcttggcttaccgcagcttccacctcctgggttcaagtgattatcctgcctcagcctcctgagtaactgggattacaggtgcctgccaccacgcccagctaatttttgtgtgtttagtggagatgtggtttcgccatgttggccaggctggtctcgaactcctggtctcaagtcttccgcccacctcakcctcccaaagtgctagaattataggcatgagctaccacacctgacctcaaaatacatttaatagagcaagcatgagccactatgcccagcctcaaaatacatttaataaaccaatggaatttgaggtaatgatgaaagacacatgtcaaggatcattcctgtgttgttggcataagcaacagggatgaaaagcattgaggaagagcaagattttgggatgcgttgtcacacagttgattttaggtatgttaagggagggagacctgtaagacagcaaagtggaggtggtgcaagaattagttgtgttggctgtagcacagaggacagtttgagttaagagagttgggactgagaatcccgaggaactcttagtgttgaacatttgcgtggaggaggggacaccaaaggagttgccatagacatcgaggaaattaggaggtgtggtgtgcagaaagccaagtgaagaacatgttttaagtaggaggatgctatcaactgttttaaattctgctgagagtttgagaaactgaggacttagaattcatcattagatttggcaatgcgccaatcatttgtaatcttttaaacaatagttttgctgtactgggtagcaaaagagtgatttgaggagtggtcatttggagcatatgctattcaaacagagaagagtccacgggctttggtaacatgaaggtcctataaccatagcaagagaatgaggtgggtggaagtcatattaacgtgaatagaggagtaggttagatctgaggaatgtgggaacagagacagggtctcattatgttgcccagcctggctcagactcgtggcctcaagcgatcctcctgcctcagcctcctgaatacctcgggtttcaggcctctgcatctggcttgaaaacaacattttctcagaagcttgttttagttgttttagaaataacgaaggcatgtgtaaacaactgttctagaagcttagtttggaaagggaacgtttattgatgcatataacacttatatgttgggtgcttatgtgtcaggcactgttagagttgctcgggaaaatttacaaaccaagcaaaccatgccccttcatttcctttgggtgaagtgagggagccatgtggttatctgaaggaagagcttagcaggattagagggaagaaagtgcaaagcctcctagggtgattggctggctcttttggaggaacagtacctataactgaatgaaatgagtgagggtaagagtggcaggaaatgaggctagaaaaggagcttgggccatatcacgtagggcctcgtaggctgtgaatctgacttcatttcttattaatgaaaataaatacgatgatgggtgatgggaaacccatagaggatttggagcagaagaatgatataattaaaattttattttagaaatatttttctggttgtcgtaagaggaaaaatatttagccccagggcattttggcagagagttaggaggctattgtaacagcccaagcaatagacaataattgtttggattaggcgggtagcaatagaggtgatgagaagtcgtagcttctgtaggtatttggaagatatatattgtgaaggatttgctgatgaattccctgtaaggggtgagatgtaaagattcatagaacattaagatattttggtcagatcatctgatcaatggaaaggtcagttatagtggacagattatgagaagaacaggtttgggtgagaaaactttagatttcagtgttggatatcctaagttttagatgattattgatatccaagagatatcaatatttgggatcaatttgggaaatatgatcccaaagttcaaggttgaggttggagatgtaattcagatccgatggtagttaaagcagtgagactgaatgagataaaatagggagtgaatgaaataaagagtaggtgtgatattgacctcaagggcacaccagcatttagaggttgggaagatgaggagagagcagcaaagaggactgggagggccactaatgaaggagggaagtacaggaggtgtttagttctgaagccacctgaagaaaatgtttggaataggaagaagttgtcagttgctttaaatcattcggggaggttgagtgagatgagagtctagaactaacagttaggtttgatggtgtggaggccatcagtaaccttttctttcttttttttttttgagacagagtcttgctcagtcacccaggctggagtgcagtggcgcgatctctgctcactgcaagctccgcctcccaggttcacactattctcctgcctcagcctccggagtagctgggactacgggtgcccgccaccatgcccggctaatttttttttttttttgtatttttagtagagacggggtttcaccatgttagccaggttggtctcgatctcctgacctcgtgatccacccgcctcggcctcccaaagtgctgggattacaggtgtgagccaccgcgccyggcccaagagtaaccttttcaaaagcagctttgctctactgatttgggtaaaagcttagttgcagttggtttgggaggaaatgggagcagaaaatttgagagagtgagtgtagacaactctttcaaggaatttcgctataaatgggagtagagatctgaagactgaataattagcaaactgaaaagtgggaagacgtaattctcttattatttcatttttcttagtgaaataagaggtgaagttctctgagtaataggagggtcaaacaggtgttagaagttcacaaagaaaggaagaggtttgaaatagtcattttgagagtgggaaatgtagaagaattaacagtcattgctgagggtgcgtttgaaatctgtcatgagtttaaaataacttgtgtcatcatcgatgtgtttattttcaactatattcaactgcttgggtgtaggcatcaggtaggtaaaaaaagtgggttttattatgagtagaggttttgccacgtaattaccatggagggagggaagagcaaaggagttgagagtatagatacaaaggaatgattactgtaatgtgggtaagagaggaatggaaggctcagtgggcagtgggagtagggatgttgataggtaaggaaaaggtgataggatcaatgcatttggttctgcaagtgtcaaagtattgttggggaaagcatgctggaaggaaagatagggatgctggtgttctcagggtggaaggcttacagttgtagtctggaagtggtgattttattggcaattataaggtcaacggtatgactatggaattgagtggctaaggtctgttgaagaaaagattgtcggaaatgcaggggtcaaggaactggcctgtggatgttgaastcactggcastgatcaaggaatagtagtggagtgaaagtagttaatgaatcaggcactaagatctccaagggatgaaaggatgcagtttggagatgacaagataactgtagtaatcaggaatagcaggttttgtagctctgtctcataggcctcagaggagatgggcttttgaaggacaagagaaatgatgatgaataaattctaagcaggggaagtgtttgggaaagcagggcaggctttgtgctgttgatggcaaatgatgtaccagacaggatgaagttgagaatytggaagttgatcactgattagaaaggcttacattttattttggccgggggtggcagctcatgcctgtaatcccagcactttgggaggccaaggtgggcggatcccttaggccagaagttggagaccagcctggccaccattgcgaaacactgtctctactagaaatacaaaaaaaaaaaaaattagctggtcgtggtggcacatgcctgtagtcccagctactccgggggctagggaatgagaatagcttgaagccgggaggtggaggttgcagtgagccgagattgcgccactgcattccagcctgggtgacagagtgagactctgtctcaaaaaaaaaaaaaaggaagggcttacattttattttggwgctgactgggaatgaaggcaatgagggatgactgttggagaaggctgtgcttactaaacagtattattaagtagcagcatacatggtgttatactgacttctgattttgcaatagtacagacaggttcagattctcatttccaccttctccttcygcctaggtgaataactgctgggttatagtacagatgactgcagatcatttggaatttactttaaatgtaaacagtaaaaatttgaaagagagggaaagtgattgaggcaatttggggattgaataagaaggtctttttgttggaattcatttaaggaaagaaaatgaaaatttgatccctaatattatttaatgaagtggctaaatgaatatctctgctttgtggtttgaaaattaatattgattttttttccccctagaggaagaaatcctacttagcgacatgaacaaacagttgacttcaatctctgaggaagtgatggatctggctaagcatcttcctcatgctttcagtaaattggaaaacccacggaggttaaatattaccttttttttttttaacttaaatcaattctgtttatttttttatyacattttcctatatgtgaagaatactattcattaaggctgactcatagaaatttgcttgaatacacacacacagactgatgcataaatttgagaaatatctttccagttgttgaatagtgaatccaaaggtttaagccttttctgtctgctttgtaggatgttttatgaaacaaaggaatagaaattgtattcatattatacattttgaaattatatctatattatattttttgtcaaagcaaaataaattatacattaaggaaaatatttaagattcaaagttgtcattttctttctgttaatgagtatctttgatttaataacatttatagtttggtcacttgaaatctatagtgaccaaaagcaatgtcatatttagtagcctcatttctgttactatctgattattacttaagaattctacttaattaatagattattagaacaaaaggcattccaattttagagattcttttatggttaaagcactaggtaacttaaaaaatttggatcaaatgttatacagattaatagaccttggaatacaggggctatgtctttttggaatcagaccttgtcctggccttaattgcaggatgacttccttattaaatctctaaaagcaggaatgctctggaacaatgaacaattagaatgtggtaatgtaattttgggccaaaaaatactttgtagaaatgtgrwtctcttacttggaatagaaagaattctgactcgaaaaagtgcagttaatgtatgcttttctgggtaagatttgtgatagattttgattgagatttaaaaccatgatatataaatttagcttttttgtcaaagtaatttgccaccctagaatttgtgttggtaatttttaatgcaacttggacaatttctgaaagatgtaactttcttttttttgagacgagtctcgctttgttgcccaggctggagkgcagtgacatgatctcaggtcactgcaagctccgcctcccgggttcacaccattatcctgcctcagcctcccgagtagctgggactaccggcgcccgccaccccacctggctaatttttttttttatttttagtagagacggggtttcaccgtgttagccaggatcgtctcgatctccggacctcgtgatctgcccgcctcagcctcccaaagtgctgggattacaggcgttagccaccgcgcccagcctgaaagatgaactttaaaatggggaaggatactagtaaagccatttcttactcatgtatacattttyccctccatgaaattaragcagccaccttttacatgacttttacatgcatttcaratttttgtactarcaattaaaatatctactggatgtaaatcacatgtgcttaatgctttgcttcataatatctgttgaagtcaattaaaatataragacagatctttaaattgaacatgttttatttgggaagcaagaattaaatttgaggcatatacacagactgggtgtccttggtatctctgaagaacaaagrgaaktttggaggttatagaaaaaggaaaatgtgacattgtttttccagaaagttctttggcactagtaaattttggggagttggaagctctgatgggttagtgactgtggtgggtaaaactagtcttagagtcacaacaggttgtttcagtatctattagataaaacaggttttaggttacaataggcagtttcagcagctaggcttgcagaaaattacattcttagagtaatgttatgtgccttgagtgcttttttccccttggcccttgactctgatttagttgggtatgacaagaattatcaatttatataattactttttacatattgaagctgaataggttttcttaaaacttggaaatgggaaatactgggtcttgtgaagttttagtgtgaaaacgataactagtctcttatttcatgctctttgtaacaagtctacagtaatacctaatgtatctagatgacacctcagaaccaggagggaacaaaaaagacctctgagcagtcaaaataatgctataagcatgtattccagcttactttcggcatttctgtggagtgcaggaggccacattttgttcatagatccagtttgacaagcttgggtactgagttaaagtgaaaatggtgtaaataagtaatcatattcacatgacagtaggtggaagtgacagctgacaatctgaaagagtggacaaaactataaaaattagaactaagaactcttaaaatagaacggtttgaagtttgttacagaagggagcagctttatgcttcagtggactctgaaggtattggcagtgtatagtactgcttagtcattgatttaaattcggtatatatctcttctattgctgtcatgtacttgacattctgctgggtgctaaggctgtctgcaggctactaatatgcataataacaatcctgaaaaagaaggaaaagtatactgtgccttactgaagaaggcaggacagcckttggtatttgttagagtaaatattagttatcttacataaagcatgttatattccctgatgtcagggcctgataaatgagcccttacactcttgatagtcaatctgtgccactgttgctgtgtttgtatgttacaccatttcctgtccatgtaacagttaaactgtatcacatatctgttcctactaaactatttgcatataattttaacatttgagtggctgtatataaagctaaaagttctttataagatttatagcatcttagaatgtttaaattagrtaacattagtgtgcttttagtttttgaatttaattttgctcttgattttgtttgtgttaatgtagactttgtctacgtaagcttgagcccaactttggagtggtgttttcagtgatggaagtaactggaaataactcatgaaaccacttagtacttttgatagtttattcccatgaaggatcaaatttttacttgagtcattaatataaaaatttaaaagacatgtcagattttattaagcatggattttaaatatataaatattagaagacctaaacaaaatcgctaatgaaagagtaaaacatgtccctgcctatcatactcccttcactttcactgatttctgcttttatgaagtactttaataagctctacaacaaataaacaagacattgtgcctcattttacactctagcagtggttttccattccaactaactagattgggtttataatatagtcatttaaacttacttagttaaaatgttatacattagcaactgcaattaaggagctaagaaattcagctcgtatttatttatatgcatcttatccatagtttctcacttgttatatttgcctactgatggcaaattgattttttctgttccaaaaatgtagtgttttgagatttttggagatgcaaaacagcatcattttcaaattagatcacaaacaatcttacttgttgcagttgagactagtaattgatcagtgaggtgaaaaaattaggcaaaacggtatcatcaaaattttctttctttttttttttgaaacagagtattgctcttgtcgcccaggctggagtgcaatggcacgatctcagctcagctcactggggcccctacctacgggattcaagggattctcctgcctcagcctcctgagtagctgagattacaggcgcatgccaccaagcccagctaatttttgtatttttagtagagacagggttttgccatgttggccaggctggtctggaacttcagacctcaagtgattcacctgcctcagcctcccaaagtgctgggattacaggcatgaaccaccgtgcccgccccaaattttcttttaacttaaagtgttaatgtttgtttgttcccaatatttttatatatgtcaaggctttttcattatatacaggccagctcttkggagttctgcatagtgtttcttgtttaaaccacacctataatgtaccatctacaatttccaattctttaagacagagtgaaaaattaagacacctgaagcaatctgagtgcggagtcctaggcattatgattttccttgacacttttagggttcttttatcacagtttatcaaacaccttttttttttttaacaaaaaacaaatttacaaaatctttccatgtattcaacttagaatttaatgaaatagggtttttttttttttggtggtcatgtatcatcaactttctttacatttaattaaattaatcaacaaaaaacatatagttgacataaacaaatttgggaccaagcactactgactcttagtaaacatacaagtcaactgttggtgcagaagtgccttgatgctagagagtagcctgcaagctgtaattatatatgggcattagggaatgaagaacagccttaatactattgatcttttaagtgaaggtcascttagaaagcttttacttgttaaaaagcttcacagtttgtccttgtagttaatgcaattgaagttgaattaatctttcttaattttttttttagggtttctatcttactaaaggatatttcagaaaatctatattcactgaggaggatgataattgggtctactaacattgagactgaactgaggcccagcaataatttaaacttattatcctttgaagattcaactactgggggagtacaacagaaacaaattagagaacatgaagttttaattcacgttgaagatgaaacatgggacccaacacttgatcatttagctaaacatgatggagaagatgtacttggaaataaagtggaacgaaaagaagatggatttgaagatggagtagaagacaacaaattgaaagaraatatrgaaagagcttgtttgatgtcgttagatattacagaacatgaactccaaattttggaacagcagtctcaggaagaatatcttagtgatattgcttataaatctactgaggtactaaataaagaggaagcacatttttagttattagtaggttctggcagactttattcccgtaaagagacagatagtaaatattttaggctttgtgggacatacagtctctgttgcagtaactcagttctgttattgtagtgtgaaagcagccacagacaaatgtaaacaaatgtgcctgtctttcaataaaactttatctasaaatacagatagtgggccacatttggcttgcgagctgtagtttgctgttcctgacttagtatgatatgcagcattgtgtagtggaaagattttatagtatcaacagacatttgtaggagtttgctattttataatttcgtatgcttttttcataatagatgtctctgctttttgtggattctcttcatatctactagtgtttactcttctgactttgatttttgggggtgtattttatttctttatacagaatttttttcttttttctttctttttttgagacaaggttttgctgtgtcaccccagctggagtgcagtggtgggatcttggccccctgcggtcttcaactcctgggcttaagcgatcctgtcacctcagcctccctagtagctgggaccacaggcctgcaccactacactcagctaatttttgtattttttgtagagatggggtttcgctctgttgcccagactggtctccaactcctggactcaagtgatccacctgccttggcctcccaaagtgttggaattataggtgtgagtcactgtgcctggcccagaatttctttacttgctcatgtgagagagtttctaataaactcctgatgcttttgcttgacactatagttttactgtcatctcagagtcagattttttccttaatttcttcattaaattgatttcttaatttctcatttgttttgcattagtttacaaaattacttaagatgcctatattctctgaaattttatattttatttcacgataaataagtttaaaaaattagatttgaccatttaattagagttatttccccatcatttttctaatggcaacaataattttagcatttgagcaattctctgtattttggtaactattagtaatcacttttatcagtataaacatgcatttcattttaaaatggttttcaaaatattctcataccaaccattcataaaagatgttccccttctgggaaatatcagtttttgctaacatctgcatttccctttgattttctaggaatttcttattaggtatacactttaagtgatatgtttcatataatattataggattatcaggatttcatgattttttttttttgagatggaatctatctctgtcgcccaagctggagtgccgtggcgcagtcttggctcactacaacctctgcctccccggttcaagtgattctcctacctcagcctcccgagtcactgggattacaggtgcccgccaccacacccggctaatttttgtatttttagtagagaaagtgctgggattacaggtgtgagccactgcacctggccttggatttcgtgatttgactgacatcttttacaccaattattgccatttttttattgggtactaattattagtattgctttctttattygttaaataagaagtaaaagaacttttaaaaaataaaataactttttttcctagtacaaagcttattttcaattttttttattgcttaaattttgcaggttaattaaggctgtacttctttttcctacttcctgtttaaatatttggcattttttgagggttttctttctatggatttttgtgggggatcccatctcgttggacacttggttcctggagattgccaaattattgaaaagtttcctcatacccaaacattggcaatagactgaataaataacatctctgacattatttttcaattatatagagaatgctttttgtaaaatactgatttatttaaagatattacartcatagtagttttttgcaatctttttwaaatcagtggatgtcaaggaacaactattgttctttgtacrgcatttttcaacattgtgaagagttcttatactcaaaaagtttgggagacacagtktgayattgtttaacctgagttgaacttgtcattttgtattcttgtttagagcagggattttattttgtctctttatctaactttgtattcctaactatttctttctttctctttggttctttgtttctttgttcattcttctctctctcccttttttatctatcatataaatatgtaaatatatattatatatccattagggaagaggaagytgtctaaagatatctagtatataggagctttgttctgcagaaaagaggatatgaagtcaattatattggaaattaatgcttaatacttttttttaaagcatttatctcccaatgataatgaaaacgatacgtcctatgtaattgagagtgatgaagatttagaaatggagatgcttaaggtatgtttacaattataaaaayattacttcaagttctttccaaaggacatttaattaagtaaaatattaactaattctaaacyaggttccaccacaatgaaattgctactaattatgtaacattagatttcacattttccaattcatgtttcttttatgtagtctatgaataatgggttagaggtaatatactaattttaattgtgctttctttgttccttcttttttttttttttattttgagacagggtctcactctgtcacccaggctggggtgtagtggtgccatcttggctcactgcaaccttcacctccagggctsaagtgattctcctgcatgagcctcctgagtagctgggattacaggcgtgtgccaccatacccggcttatttttgtattttttgtagagatggggtttcaccatgttgcccaggatggtcttaaactcctgggctcaagtgatctactggcctcagcctcccagcgtgctggggattgcaggtgtgagccgccgcatccagccctgtgttccttcttgtgttactttcttgtaattttttcctggaatatgggtagtgatttggctctccagtattgaaattgagtttcctttcttccaattcatgtgtatccatttttatttggaagttttgtttttatacattcaataatcatctttactttctttggtattatttactatggatattttatattatataattttcaaatggattaaatggttcagttttactcttattattgagattgaaaatactagtttataatttatatattttctattcctttacctctaatttctttgtcaggtgttactaaccaaagatgtataataagaaaagccaatgtagctaaattaagtaaaaaatgaagaaaaacacagaagttccccattatgcatttttttattcctaatctttaggttgatgagatttttttatttttatgaaatgagattaatttattgacttttttagttttgaggccaagtaatgagtagtgagtaagaatgtatattctagggccaggcatggtggctcactcatgtaatctcagcactttgggaggccgaggcaggaggatcacttcattccaggagtttgagaccaacctgggcaacatggcaaaaccctctctctccagaaaaatacaagaattggctgggtgtggtggcatgtgcctttagtcccagctacttgggaggctgaggtgggaggatcacctggggagcctggggaggttgaggctgcagttagccatgaccatgccactgcactctagcctgggtgacagagtgagaccctgtctcaattaaaaaattaaaaaaaaaaaagtagattgtgaattcagatgtaggtttgtatcccagcttttccagttagtatctgtgtgactttggggaagtttcttagcatctttgatactcggttaacagttgtaattattatttaaggtattgcttgagaagagcttagtatagagcctgacatttagtaagtgtttaatacatattagctaacagtaaaactagaacataaatactgaattgtattttgttattaattatccatttctctgagaagtactgttccaatagtacatttataggaaacttgtggacgtctacaaacgtatacattaaatctcttagaaggcaacctggatgcccatattagagaactctattttaaacatgcattctaagtatgtttgtggacttgaataaaataaaacaaacagaaacacttctttcttctgccttcaggcttgaaatgaacatacttttttttaaaaaaaaaccttcaaaatgaaaatattaaataaaagatttaataaaaagagaaagtaaaaactgtagtttaataaagtcttcctgtctcttcatagttaaaaaatgttatagatgaaacaattttgaaatattcttgaaatagataatctttatttaggggagaatgtcagatactgtcaagccaaaataaaaacaaataactttatttcatgtttgtaaaattccttttctaaaatgatttgaatcttttgttgttttgacaattccaaaacacatttattgtttgctcatagtttcagccttattcagaaagaatgcgactgacacatgatatagagaaacttgttccaaaaataacattaaaatccacgtttactacttgagaatcgaaaatattgaggtgcaataaagaataaaatgttttaaattatccaaatttaaaatttatgatagctttccccaggggcagtttattatatgctattaatgagccttgtttatgctggaaatgttccatctttggccttgcgccttagaaaccattcatgagcacatatttaaaccggagcacacatgttcttttgtagtatggcttgcacatctgccagctttcgacaaaattgtaggccctgttaataatagtccttttgtgtttggtgaaaaagatacgacactgtcagtggttttgcttttaagatttcttttaaactttcagtctttagaaaacctcaatagtggcacggtagaaccaactcattctaaatgcttaaaaatggaaagaaatctgggtcttcctactaaagaagaagaagaagatgatgaaaatgaagctaatgaaggggaagaagatgatgataagggtaagcactgaagtatgtttgaaatgactcacctgtgatacctaccactgactttaacttaggatccagttttggatggtttggaggtcagggactttgtggcatatagttaattattggatccttataagcttttgtctccttagtgcttttgtctccataaagcacaatcttactacttagaaaaatagagtaatagcattatgatgataaaaatatctttccctttgtttttttgtatttctccaaatcattatagctctcatttagaattattaaagctgagaactctaacaatgaacttttattgtttagtggttaattatcttgattctttgttttgccctttcttggccactcaggaatctttcaagctcactgtggacagggaaagtgacttgggtagagctaacataacttcattgtgctgtgcagttagaattttgaccaaagatgtgggtaactaacttttcctaactaaatgacatttaggtaactaaactaaacgagattttcgtaactaaattttggtgtaactacatttagctttaggtaactaaaacgaagattttattttatctgtggatttttttagtgcgggactaatgtaatttctgattaccattaattgaaggttggttatattataacatttggattggtatattgcttgccatggtttgttctaaatgttagcctttagaagtattcctgattctaaaacatcagttttttttaatagtcctggcaaagtgtgaatcacaacaaaattctaatacttaaaagtaatccaagtgtcacagatggtacccagaagaccagtttgtattggaattaaaaaatagaaaacattaacccatggtagctgtcactgtattctttcaaagaagccaatgaaataaactgttttctccctctatgkggtgtttttctacttgaacataaatgcacattttattttatttcmagactttttgtggccagcacccaatgaagagcaagttacttgcctcaagatgtactttggccattccagttttaaaccgtgagtataatctcatttaatcaaatcacatatttagtattctctttaaaacaagggaaaaggcaaataacctgtctgcttaacagcaacagcacaacttcactatagttatacatgccacackgtattttctgtgtgactacaaaattatttcaaagtgatatttatataaaattcatttctgcaaattgtttttataagtgaggaaaaatggttttcctttaactgagcagttctgagtagaaactagtttaaagatacttataaataaatgttaatttaatactgacttgtttttcattaaacgagtgtctatgtgcctgttttgtgtatattacccagaacatgcagatgtactagaagttcttaatacaacaatttgaggaatagtgataatcttatctattttaatgtactcaaaatttgtttacatctaacaggcacatttttgtgaggattaaatgagatgaataagaatgagatgaacaagtaaatgtgaataaaactaataagcctgtgaaaatctagactggatttttcctattctgagaatttaaaatataatccactgaagtatttctttccttttttcttttgatcttaaacattttttatttatgtcttacatacagaaaagtgcacatgttgtagagatcaatgaattgtcataaactgggcaccctgtggccagcacttagttaagaataggtcagtaacagcatgccagaagaccacctctccaattgatttttcccatgatattttattaagaaaattttctaagatgtagtaaagttgaaagaacttttttctgtgcatgtctgtattcccaccacctaaattcaactatcattactatacttgctttatcacatatccatccattcatatgtctctatccatccattcattcattccagttttaaaatgcatctcagggtcaatcgaggacaccattacacttccacctaagtatttcagcatgtaaattattaacgagttaaatatttacttaacagttttttctttggtgtaaaatttgcacgtaaggaaatataaaactttaagtgtacatttgcaaattttaaatatacatgtgcatacccatgtaacccaaattcttatcaagagatattattatcatcaccacacagagttcccttatttcccttttcagtcagtccttgtccctgagcatttctcttattattttaaagtattgattcttttggatatctagtatgaagcttagaatctgttttttactttagatgtatgtagtgaaatttaatatatataccaaatggtagttgttagttagcttgaatgggacattggtcaaatggcattgtttgttttaaagttccaggtttgtgcatttatgtatgaagtttgaaaataaattctatgagaggaaatgaaaaattgaatggattttaatttgtaccttgggtttcttattaataaaacaaaatagctttttgcttttcaccttcaagagttcagtggaaagtgattcattcagtattagaagaaagaagagataatgttgctgtcatggcaactggtaagttgtacttaagcaaaaccwaatcctttaaaaaaataaaacataaagagtttgaaatgcttaatctttcattaaactctcaaaatacaaatgcarctacaaatgatgtaaamtatagaagagagtgaacaaagaacagatgctcagatttatgtatcaattagcttttaggaagatagcatactagtattgaccattcatctgtataagtacattgtaaaaagaaatgaaagcatcaaaggtttatttttatttctatatttttttcattttatttttatatttttttcatttcaaggatatggaaagagtttgtgcttccagtatccacctgtttatgtaggcaagattggccttgttatctctccccttatttctctgatggaagaccaagtgctacagcttaagtaagtcatgttatcattgccacamtatcaccctctttttttcttctgtgggtgaaacatctgatccatcatgcatgttaaaatctagttcacaataacacatttctgcaggtattgctttatctttattggtaataaatgaccctttagtggaagagcttaccttctttcttgtgttctctgtaattcaaagctaccaggtggccctgataaaatttttttaaaaaacattattactttatgctggtttacattgaatatctcaaaattcttttctctttttgttacccttgctttttagcttgataagaagtgtatacatggaagtatattttttatctatgaaacacttttcagcttcttcaacctgagcttgcaatctgttttaaattgatacataatatctttacatattcatggggtactgtagtattttgatacactcatatcaaatacacttgatcaaatcagggcatttgttcatcaacttgaacatttatcatttctttgtgctgggaacatttctaatcttttctttgagttattttgaaatacacagtgttgttgttaactatagttaccctactgttggttaatgagtacaaacatacagttagaaggaataggttctagcaacctattcctttaccccctgtcatcccctgctgccctgagcttgcagtctctttcaaagacccaccttaaaaacttgcattctgataaggcccttgaaggaatttgcttatcaagttagtaagtgacaaaaaagaaaattgcaaagaacaggaatataaattattatatttctttattctttctcacttaagagtgaaattgatatgtgtaatgtgtacatggtgccagaatatttgtttttcttcttatagaatgtccaacatcccagcttgcttccttggatcagcacagtcagaaaatgttctaacagatattaaattgtgagtaatttttttccctcaacttttattttggatttatgggggtgcatatgcaagtttgttaygtgggtgaattacatgttgctgaggaagttgtgagtaatttatgtcatttctaatcatgtggtcagatgtctgtggtatatgagagaattttgtatacaaacaaattttactaaatgcatgaaaaaaaaagtccatgattttaaaatgcactttcttttgtacctttgcaggactgttactttttaaatccttcaaacttgaagaaatctgttattctcggttcttgggctataagattagcattgtactcatagaattataaaaattttggttttggaagagaagttggagaatataaagatttgtctcattttatagatgagaaaactgaggctcagagacaagtaatttgcccaaaatcacacaatgactggctgagcagggactggattctaggtctcttgcccaaccaattctatcatgatgtaattcctaaggagaatgtcatctcagatacacatacacacacccattttgtgtgtgtgtgtgtgtgtgtatatgtacacacacacacaaacatatgtacacttatatatacatacacacacatatattaatatatatgcatatatatgcatgttctaattcagaacattttcatcactcccaaaagaacacccctgcccattaagcagttgctttctttacgtatatattagtatatacatacacacgagatacacatatatttactgagttttgataaatgcatacaaagatgtaaaccaaacctctaacaagatacagaatatcactgacactctagaaagtttcttcatgtccctccccagtctgtccttccatcctccatcctaggcaagccactgctccgattttctctaccatagtttggtagaatgccatataaatgcagtcacacaatattaactcttttgtgtaagacttctttcatttgctgtaatgtttctgagattctttcatgctgttgcatgtatcagtagttttttgttttgttttgttttgtttttgttttttcagagtcagggtctccttctgtcayccaggctagagtacagtggcgcaatcatagcttactgcagcctctaactactgggctcaagctatcctcctgcctctcaagtaggctaggctgcaggtatgttccaccatgcctggctaattattaaattttttgtagagacaggatcttgcttggttgcccaggctggtcttgaactcctggcgtcaggattgtttccagttttggattattacaaataaagctgagacacatataagtctttgtatggacatatggtttcattttattgatacatgtcaaggagtgggatgactggatcgtgtggtggatatatgtttaactttcttttttctgagataaaattagaaggcgatcctcctgccttggctttccaaagtgccgggattacaggcgtgaaccaccgcacctgatgcagttgttgttgttgttgttgttttaatatctgrttattattttattgtatttcattgaatatagcacagtttgtttttacattttcttattgatagacacctaggctatttttctggttttggactgttactaataaagctgctatacacatccttataaaaatcttttttgtgaacatgttttctttttttctaagcattttaaatcacctttattgaggtgtaattgacttacaataaattttatatgctgagaatgtataatttgataagttttgacacaggtatgcactcatgaaaccatcatcacaatccagataatgaacatattcatcacccacaaagtttacctttttgttttaaccccagtcaccgggtaactgctgagctccttcctgttactgtagactagtttgcattttctaaacttatatacatggagtcattcatattttatgtgctcttttttgtctgatttaaataatgcagtataattattttgagattcattcatgttattacagtgattaatagttcattcctcttattgttaagtggattacattttatggatatccaacaagttgtttatccattcacctgatagacatttggatcgtttccagttttgggttattacaaataaaactgctatgaacattcgtatgtaagtctttgtatggacatatgttttcattttattatatatgacggagcggaatgactggaacatgtgatgcatatatgtttaactttcttttttctaattgagataaaattcacagaacataacttttaccattttaatcattactaaagtccagtgggttttggtatagtaataatatataaccatcataattaattccagaacattttcctaactcccaaaagaaattccatacccattaaggagtcattccctattttcccttttcttttctttctttttttttttttttgagtcagggtctccctctgtctcccgggctggagtgcacttgcatgatcttggttcactgcatccttgatttcctgggctcaattgatcctcccacctcagtctcctgagtagctgggactgtaggcatatgttaccatacctggctaatttgttttattttgagtggagatgagattttgctatgttgcccaggttgctctcaaactcctgggctcaagtaattgtcccacctcagccttccaaaatgctgggattacaggcgtsagccactctgcccggcctattatctctgttctgcccacttccaaccactaatctactttctgtctctatgatttgcctattctggatgtttctataaattaacttatacattatatggccttttgtgtctggcatcttccacttagcatagtgatatcagtacttcattcggtctttttttatgactgaataatattccatagtatgggcatacacattttaaaaattcattcatcagtgatggacatttgggttgtttcctttttggctgttatgaataatgatgctgtgaacatttgtgtaccaatttttttatgaacatacattttcaacgcttttgcatatatgcctaagagtggaattgctgggctatatgctaattttttaagaaactatgaagcttttgagagtgattgtatcatgggatattcccaccagcagtgtatgagaggtccagttcctccccatccttgctatcacttagtctggctgatctttaacttaagccattctaatagtatctcattgkatttttagtttgcttttccctaatgactaattatattgagcatttttcatacacttattggccatctgtatatcttctttgagggagtatctgytcaaatcttttgcctattttttcttagtgagttttgatagtcatttctatattctgaatataaattatttatttgatatatgctttgcaaacattttctcctagtttatggcttttcatactttccacacagttcttttgaagagcagcagtttttcattttgataaagtccagtttgtcgattcgttcttttagggattttgcttttagtgttttgacccaaggtcacaaagatttgcttttatgttttctcctaaaagttttatagttttaagttttacatttagatttacgattcatttttagtaaatgttgtctattgtatgaggtattgattacagtttatgtatttttcacatattgttccagctccattttttaaaaagactatgcttttacactgaattgactttgtacctttgtcaaaaataaattgactacatatatgtgggtctattgctgcactctctattctgtgttctgtggatctatttgtctgtcttgattggtgtcttgattactgtagctttataataaacctggaaatcaggtagcgcaaggcctcttgctttgctcttttctttcaaagttgttctggctattctatgtcctttgtatttctgtgagcatgtcagcatcaccttttcaacccatatgcctgctgggattttgaatgagtttaccttgaatctagatatcgaaacaattagctgtcttgatagttattgtcaccgttttataccgaagaaactaggcatactaaagtaacttggctaacatcacttaccttgtaagaagtagaactgggctgtttgacatcagagcttattctttataccatttcctatgttaattagaatacaatattaatttcataaaggtaaaggcatatctgttttgttcctatttgattccttgtgaaagcacaatgcctagcgcacaatagacacttaaacttayctgttgaatggacaggtgaatgcttttaaagtctttccatatagaaaattaagtttcattacatttgacttgatctaggttttcatttcatagaatggagagcagactctgtaaatattttgccccagacctagcyttattacaaacattgtcttaattaggattctgtctacccagaatagaaattaactcaagctagcatgagtgtatattgaaatttatattaaggataaaggaatgtctcatagatcccactcaaaagaaattagccagcccttaggaagagactggaattgggtttggaaaatacaataggtctttctttttatctgtagtctttagtgagtcttcctcatttttctctctgaagagataagcattctctgcatatatatagcattcttttagattttcgtgacataaagtattatttaaactttcataaggtatcttgattttaagttgtaattccttgagatgattgttttctttattgttaatatgtttcccttcctgtttttttttttttcttttttcttttgtttgtttttacagaggtaaataccggattgtatacgtaactccagaatactgttcaggtaacatgggcctgctccagcaacttgaggctgatattggtaagtgataaagaaagatctctgtaaatacttactgagttaatatttaaagttaaacctatggatggacactggatttcacttctgttaaagtttatttcaaacattacttcctccaggaaatctctgactctctaacttgctgtttcacctatcttatcccatgatactctataattccttttgctatagaaattaggctctgttatcataattacctgtttatatatctgttttcttctgctaggctataaacttttcaagggaaaaatatcactttttaaaatttatgtttccccagtgcagtgcttggcatataggcacttaaacatattgttgaatgaatgttgaatcctaggttctgtgaaattttaatttacttgtttttcatgttctgtatctaaattaagtcagtgtagtggttttgtaccctctttgttcataagaatcacttttcaaactttaaaaaaaatgtaggtaaccaacacccaactctgaaaattctgatttaacaggcctgggttggcacctggcattggtggtttctcacaggtgattctgatatatagcccgggttggaaaccacagtacctttgattagttgccactagtgagtatgatttattacaaaaaccaaaaacttagataagtcacagtttatttcctagaacgtgtaaatatagaattagtcaaaagctgatagcactttttttgtacttaaaaatattttaagcctcagtatagtgagacctcatctctacaaataattttttaaaaaattggccgagcctggtggtgcatgcccatagtccaagctacttgggaggctgaggtaggaggattgtttgagcctgggagatgaaggctgcggtgagccaagatcatgctactgcactccatcctgggcaacagagcgagaccatgcctcaaaaaaaatttttttttcttcttggtggttaggcttaactatccaagaattgcaatcatggcttctattgcaaatgcccctatttcccaccttcagttggcctaaccaaatttaatttttcaatatcatatgatctttttgtataattatgtattmaaataattccagataggttaggttttcgaattgcaacgtctcatttaatggttactttcatataactgtaggaaagcatttgataatttttccaacaatgtaatgaaaacaaacttgtatcttttttattatgtgttaaaaccaacaaaagaatgagggcagcaattaacatttcattaaatatattagcaatgagtacatttatgagctcttaaactcccttattgacatactgtattttttgcctttaatggacaatgaatttgatatgtttcctaataggttgtatgaagttattgtgaatatttcactttggattaagaataactaccctatatataaatttcatggttgtattgcaaaagctggggtctatgtccatagtggtttgggtacgtttttactatttgctttgtttctgtgatagtgttaaatgaataataagcttaagtatttaagcaaatacttaatacttctgacaagtagttagaactctctatttttgtttttttgtaatggatgagttatggacactgcaattattagagcagcgtactttgcttatgatggatgaaaatgttctctggttgactcagtgttgaataaaaagggatacatgaaataaaaattatttttgaaatattttcctttgccttttgttgcgggaaattgtacaatgcttgcaaaaatgaatatacgcaggatattatttgtacagcagtctgacatttagctaatcagattcctcatttttaggtaaatgttaaattacttaagtagtctggatttttaacagaaacagcaaacatagttttatagggaggctccttaccaaccagacttttaacttaagtgaatgttggcaaaagcttgtctaaactgatttccagggataaggtttagctccattaaaagctagtttgtcaaacctgtaactaaagctttttaaaaaatgaaagttttaaaagagaccatcattctgttttaacctatttaatttaaaatctgggctgaagtaggagtattgcttgaacccaggagttcgagaccagcctgggcaacacagtgagaccccatctctgaaaaaaaaaaatgagctgagcatggtacctgttacagtgctagttatgaaagaaagaaagagagagagagagaaggaaggaagggagaaaggaaggaaggggctgggagtggtggctcacasctgtaatcccagcactytgggaggccgaggcgggtggatcatgaggtcaggagatcgagaccatcctggcgaacatggtgaaaccctgtctctactaaaaatacaaaaagaaaaaattagccgggcatggtggtgggtgcctgtagtcccagctactggggagggtaaggcaggagaatggcatgaacccgggaggcagagcttgcagtgagccgagattgcgccactgcactttagcctaagaaaaggaaggaaggaaggaaggaaggaaggaaggaaawatcagtcactcactcaggtttagtttcaaaagccaaaacagtgataatattgaattttttccagccactcagtagtacccagagaattttgatacaaataactgactttgaccccatgtttagtaggttttttttttgtttgtttgtttgttttttttttttgtctttcttctccacactctcttaggackgttgtagcttgtaatgttagtgaattgtaattgtttatttgcatgtctgtctcctcttttagaattgtgaactcctcaggtcatggattgtattttattagtctttttattcctagaaaagtgtttggataataatagatatttattaaccataataggagtagtagcatttttgtgtgtgtgtgccaggccctattttagcattttatgtgaatgatataatttaatttttagagcatctagaaaatgttaggtaccattattatccacattttacttgtgagaggactgagacttggaaagcttaagtaacttgcttaaggtaatacacatggcagatggtggagccaggttctgcatctgggcagtctgactttagagctttttaatcatcctcctcctagtgtccgaacattattaatgctcagagaagtatcaaagaatgatgatactcattgagggaaaaaattattcttaagtatcaatttgttaattgaggacaaaagcactactgttactactgtgaaaaatctgaaaacattgtcacggatgattttacaataacatccttttctgacatgcattacaacacactattgattccgtttcaatgtttgtgtctggtatgggggcggagtrgagaggctactacaggaagaaagaacaaataacatttcttcttactactttgtgcatcatgtgatttagctcctcccataccattttacattagaaaatgtggctgtcctcctgtgctctagtactggcatttcagaggactctttgcaatatgatatgtgatcaatcatggatggcgatgcagttaatttcagtagaaatttgctgactctttttatctcttttaatagctaatgcatgagataaaattgaaggtattaccaaggagaaatgcaggtggatagttttgraggcaaagtcacagtaagcaattcatctctccaaggaatagtgatgaaagctgagatccaataaatgtcttgtttggattaatacataaatatttccttttaaaattcttaaggcttttattcatatatctcccctctccctatttccaataatgatttttggtgttaatatgatgrtatttatgcttctgtttttataggaaccaaatactttgatttggttatttattctcctttggagatgtagatgagtttattttttcctttcgagctttatcttttcctttatgtgtttttcttttttacaggtatcacgctcattgctgtggatgaggctcactgtatttctgagtgggggcatgattttagggattcattcaggaagttgggctccctaaagacagcactgccaatggtaagctttgccaagtctgatgtccygaaattrcattcttaataaggagagcattcaggattggggagtggtaaagaagctgaagacttcactataaaagagcaaatggataatgtaaaaagagaactatttttttaaaaatgctaaagttggtatataatctattgaggaatataatagaacaaggcttgacaaaccttttctgaaaggaccagataataaatatttcaagctttataggccacatgtagtctgtatcacatattcctctctctgttttttcttttagtaaccctttaaaaatataaagagttacatttttcactggtgggccataacaaaacaggctgtgggccatatttgtccgaatgtcttctcagtgatctttcatccrtatgtccttttactctaggatgctgtgaaatcctggttaccccttcttgtatcacattgaaaacctaaagtttgaactattctatagaaattttattaaagcttttggtattagaatttccctttcttccctaattataaaaaatagcaaattttggccgggcatggtggctcacgcctgtagtcccagcactttgggaggccgaggtgggtggatcacctgaggtcaggagttcgagaccagcctggtcaacatggtgaaaccctgtytytactaaaaatacaacaattagctgggcgtggtggcaggtgcctgtaatsccagctacttgggaggctgaggcaggggaattgcttgaactcgggaggtggaggttgcagtgagccgagattgtgccattccactccagcctgggcaacaagagcgaaactytgtytcaaaaaaaaaaaaaaaaaaaaaaaaagtgaatttttacatgaatattctacatgattggcatatttacatgaatggtttaaaaacccacaataatagcactgttttattttttattttgaaaattgtagattcacaagaagttgtaaaaaaaaaaatacctatatagaggtcctatgtacctttcatccagtttcctgaacagtaacatcttgtgtgactatagtacaatatcaaaactaggaatatgacatttgtacagtatctagagtttattcctatttctctagttttgtaagtactcttttgtatggcatgtgtattgttctatacagtttaatctcatgtacatttgtgtaactaccactgcagtcaggatgccaaatgttcccttaccacaaagctccctggagctgttcttcccacccctggccctagccactggcaaccacaaatctggtctctatctctaaaatattatttcaagaatgttatatacatggaatcatgcaatttgtcaccttttggaattagtttttttcactcaacataactaccttgagatctatccaagttgtttgtggtcatgtgttgcctaacaacagggatatgttctgagaaatgtgttcttaggacattttgtggttgtctgaacatggacttacacaaacctacatgataaagcttactgcacacctaggctrtatgatagagcctattgctcctaggctgtaaacctgtacagatgttactgtaatgaatattgcaggcaattgtaatacaatggtaagtatttgtgtatctaaacttatctaatgtagaaaagrcacagtaaaaatacagtataaaagataaaagatggtatacctgtatagggtgcttcctgtgaatggagcttgtaggactggaagttgctctgagtgagtgagggagtggcgagtgaatgtaaaggcctaggacattactgtacactactgtagactttatacatattgtacacttaggcgacactaaatttttaaaattttctttaaaaattttctttcttcaataataaattaatctcagtttactgtaactttaattcataaacctaaaacattttttgactttggactcttgtaataattcttagattaaaacatgaacacattgtacagctgtacaaaaattttttcttccttgattaatgcattccataaggctttattttaaaattttattatttttatttttaaaacttttttgttaaaaactaaaatacacacatatcagactagacctacacagggtcaggatcatcaatgttgctgtcttccacctccacgtcttatcccactggaagttctttaggggcagtaacactcatggagctgtcatctgtgataacaatgccttctcctagatacctcctgaaggacctgcctgaggctgtttttcagttaactttaaaaaatgaatacgtaggaggagtatactctaaaataatggaaaagggtataggtaaatacgtaaaccagtaacatacttgtttattattcatcaagttatatactgtatataattgtatgtgctatactttttaatgcctggtagtgcagtaggtttattgacagcagcatcaccacaaacgtgagcagtgccttgtgctaagacattatgctggctatgacatcacttggtgataggaatttttcagctccattataatcttatgggaccactgttccacatgtgctctgtcattgacagaaatgccgttaagyaccacatgactatttttttyrgtggtctgttcctttttattattacagagtattccacagtatggttgtaccacagtttaactgatcacctgttgaagaacttttgggttgttttccagtttttgactattatgaataaagatgctatgaacatttgttcatatctcaaaggttctttatttttttttatttatttttctttttttgagacagtctggttctgtcaccctggctggaatgcagtggcgcgatctcggctcgctgcaagctccgcctcctgggttcacgccattctcctgcctcagcctcccgagtagctgagactacaggcgcccgccactgtgcccggctaattttttgtatttttagtagaggcagcgtttcaccgtgttagccaggatggtctcgatctcctgacctcgtgatccacctgcctcggcctcccaaagtgctgggattacaggcgtgagccactgcgcccggccttcagagattctttaatgggtgaatggttaaacaacctgaaaatataaaagttttcatttctctgggataaatgtccaggagtgtatttttagtttttaaggaattgtcacaaacctgttttccaaagtggctgtagcattctacattcctgtcagcagtgtgtgaatgatctagttatccttgccaccgtttgttgttgcaactgttttttattttagccatttcgataggtgtcgagtggtatctcacttttaatttgcatttctctcatggctaatgatggtgaacgtcttttcatatactaatttgcctctggtgaaatttcttacataattggagtgcttgtttttttctgttgagttttaagagtttaaaaaatacattgtagatatgagtccttggtcagatacgtggtttcaaatatttctttcactttgtagcttgccttttcattctttttaccgtgtctttcacagagtaaatatttaacattttagtgaaatccagtttatcattttttcttttatggattgtgctcttcacctagccctagatcctgaagattttctcctgtggttctttcctaaaattgttacagttttatgttttaagtctgtgatccattttgagttaaattttgtataaggtgtgaggtttaagtcaaggttcattgttttcccaatagattaaattgcagcagatcctttgttgaataggctgtccttcccctgttaaattgcgtttgcccctttgttgaaagtcatgtgggtgtatttgtgtgggtctatttctgggttctctagcctgttatattaattttgaacgaataaagttggcttatgtttaagttttcttggtagtagcgaggcaatggtgccttctgagcccaggatttcacaattttgtgagtaaactgtgttagaaattgtttgttattcttttggtaggttgtctagttcaatttcattgctcattaatcttgcttatagatagcaaattgagaggcatctcaaaaatagtatcttttgttagcttatctcacagagtttggttggagcagatattaaaacagaacaaaccaaaaataaattaaatatactagttagcaagtttatattgagggaaaatcaaaccatgtgaattgagctccaatgatgtggctggccttgggtcagattttagtatcatggttcaacaaggtagctattaaaatcttcatactttttcttgaaataattctttagtagtcacataggacagcacacactcatggatttcttctttccttactgtctctttattctcagcctcctgttccttctcatctccctgaccttttaatgttggccttccagaaactttagtctttggacctacctttgcactcattttcttggtcatttcacccaacatacagttttatgttattttatttttttatttttgagatggagtttcactcttgttgcccaggctggagtgcaatggcgtgaactcacctcactgcaacctctgcctcccgggttcaagcgattcttctgctcagcctccccagtagttaggattataggtacgtgccaccatgcctagctaattttgtatttttagtagagatggggtttcaccatattggccaggctggtctcgaactcctgacctcaggtgatccacctgccttggcttgccaaagtgctgagattacagatgtgagccaccacgtccagcctacagttttaaatatcaagtctatactgaggactcccaaatttttatctccatcatagactgatatcagcagtatatgagtgattcagttgtttttgcctctttgccagcatttggtgttgtcactattagttcattttagccatttaatagaatatatgtacatatatatgtgtgtatacacaggcacacatctatataactactcaacatgcctctggtgagatgaccaacaggtatctcaaacttaacctcttcctaattgacttctgcatagcactccagatctgctctttcctcactctcctccatcttgtttaacagcagctccattggccaaaattttggaattttcctcaatcttttctctttttcttacactccactgtttatttaaacagtaaggaaatctcgtgaggtcttcagaatatatgcagaattaaatcacttctctcttgatccctgccattccccaggtacgggccaccatctccttagggcctcctgctttcactcttcccatccctcattctgtttcaacacagcgtccagagtgatactttaaaaatgaagtctgatagatcatgtcttcggctcagaaccatctagtagcatgccatttcattctaaataaaggcaaaagtccttatgatgagttaccgatcctcatgtaatctggccttccattttccctctgatctcattctctactggtctcctcattcaccggatgcagccacaccaccctccttgtttttcttcggacattccaggcatgcttcagtgcctgggctttgcgcctgctgcttcctctccctgaatacgtttcccccacattgtctataggatgttctcccatacttctctcagatctcttggatttaggcctcctgggccaccatatttgaaatatcagattagttccccctcccccatyattcagcattcctcgtaaatctttgctgttttaaaaatagcactatcactgtctaacttactgtgttatattttgttaattttctgtgagttcttcttcactagaatattctttgtagggaggagtttttgattgtttggtttataaaatctggaacaatacctggcttataggaggtgctcaatttataatggggtgaatgaatgaatgaatgatgatgagaaagctgagaatcagtaaagtgactttccaaaacaggtagtgggcagtatagagttgggccataaatagctgcaccatacaacatcctgctagtttctaaagcaaatgatttgaaagaggcataaaacataatttctgccctcaggtagctcatagttcagtaaaggagtttagattcatacctataacagtagaagtaatagcaccaaatgaaatatggtattatgaagtggtacaaataatataaaaagatgaacagtgttagtagtacatgtttagaagggatttctgtggtgaaagtcactaggcacagtgcacctggaggaccgatttccattccatttagaatggtttaaagtaagcttttggaaactaggaagattactttctgtaatcctttcctaggcctttgattctagaaggattgtgttaaaggagttttaaatattttatacagttcttaaacattgttaagcttgaattaaatcttttattatgtctggccatggacgtcattggatcattttcatttcttgggaggattaataaagcacattccttctgttgggcctccagtgcggggagggtgttggccgagcagtggctgaraaaacgtttttcccctggtgttttcaagaaccctctttattagctaagtggtgagacatgccacctggtggttatagtagtatcatttttctcactgttcttggtgcttttcttctcsttctgattccagttatactaggacaactgctataaacctggaatgtttcacactatattatttcagtaatttcaaaaacagcagaaatcactaagctgtttggcacaaagattcctatttggaaggaatcagacaaagtgagtgttgagaaagaacagccaggcagaaagctttgcatcagtcttaaagttctttacatttcaagtaagaggaattgtgaaatccataagacatgtggggtttttctattactttctccccagtatctattacaaagatcagcacatagtaggtactcagtaactatttagaatgagtgcatgaatgaatgaagtatgtgtgatgttatggagtacaaagttagaattagcaacatgacctgaatttagaagcaggtgggatacttatacttttctcagtctgtgggcaccacaccattgaagtatatgtctaagattaatttatatttggttgtttgatttagcaaaacttgctgcctgttaaaaaagaaattaagacctgtcaacttaaagaatacattttgtgagttaagaactaaatgacagtataatttattacccaaagcagtttgcttctgaaaattaaagagttcaagctattaataattatgctgtgactgcaggcataaactgggaatgtcctggcaaatgaggatgtattgtcacctttctcagcctgcctgtgtgttgtttttaagcttcactctagtttatatattttaaatgtcataaaataccacatacttataagagaaaaggttctattcattgctgaagtggaagyttatcattaatttttatttatttatttttttttccagttttggaattcttattactttgaacccaagaaccactgataactagcacaatccagtgaaacagaggaagcagcagcttaatcaaaggaaaaatacatttaagattataagtctggttataagcttaaaaagtgacccagaaagggatatcattgctaaaaaaaaaaatccccttgtgacctgggtrcattttgcaaagccacaggtttgcartgttacacaagggccaaaggaggccatgagttgtctttggttgtggggccggagggtaaytgttcatgaaaatagtgagtgtctgaagattaagaaaatcatgctgcagcagaggagaagggagaggaaggcaggaagggaaaggagatgcctgagggtcaaaagctgagcccaagcctaagcccaagctcaagttcaagccccagcatggcacaattttgtgaattaactcaggctgagttgcctccagtctttggaatgtcatcttatactggtactgctgaggcagagggcagtaattggttctttgggataggagaaggggcagttgctgaaatacaaaattaatagtcagcatcccaagttcctyaattgcagccaaaatacatgtgttcaggcctttcggcagtaccgcccccagaactaccagctgtagtgtggtctattcccagacagcaacatgcaagaataagtttacaatacactcagcccttgtggcttaagatcaggggctcagaggctgtgacaactcatgatgctgaaaatgtatccaatgaaaacgaagtactagctygtttagtagtaacgaagtactattaatttttaatatagtctgatactttattttctaattgtagaagcaacattcttagctatatctttctagaatgttgaggcaaaagagtaaatttatagtgattttcactgttaccagattgctggaatagggaatttctggtagcaagatgggaatttttaagttggaagggtctaacacatcatatagccgtctccatctcattttttttgctgaaaaaactgagcccttgcaaatgtcagttgcaaatctgggagtagtactcatgtctctgaagttgttatatagaattctttttatttattttaataacaatatttatgatagttgaaactttttgagtgcttactatattttatttcatgcattatgttcagcactttacatgttttatctcacttgatattcacaactttatgagattggcactgttattgtagccattttatagatgaggaaactgaagcttagagagttaaataaagagctcaaaatctcacatctagtaagtggcaaaaacaggatttcagctcaagcaatctgattccaaaacagacytttttcactgtgctgccattcttttgcctggtttttctgttaacttcttaaatatatgtcatgtttcatgcttacttcctcattttcataaatatattacctgctcacttatacattatattgcttagaaacaaacccaaccctgttttcttatggactgtatcctgaaaatcactgtttttaatatgtggttaaacaagtgttttattagtgcatttatataaattatttaaccaaaacacttaaccggtgaaagtgctttactgtgagagtgagaatgtgcatgttctaagaacctctaatttttaaacctcccttattctcagccttatatttgttaaaacctgtgtgttaacacagatgcacccatgttaggggttaattagagaaaccaacctctttatagattagcttgttcatctttaagttgctaggcaggcactgtaaattcagagaacaatctgattgtaagccacaaatcaatgaaattaattttggggttgccttttaaaatagtgtcacaaaatttaaggataaagaatgcaaaaatgatgccaattatctcatcacattagttttgatttaatttttttaatttgaaaaaacctactcttaaacttaattgatttttttaaatataagtttggagataatttttaattcagtaaagttatagtgattgaaaaagtagtttataatttttaataaattgatcttgttttaattttgagtcatattctagaagtgcttctttgcaaattggtaaattgcacatacatttccacttatatacaagataattgctatggttggtttgtataatagatgcagtgcatctgaagagctattttatgagaatattgtttcttgtatctgtcacgagccaaaaagaatatttttaagaaagttatattcttggtgatagaacagctgataatttagaaacaactgtaagacagtccactttttctgattatgaaataataccatagttaagtgtaatttcctataatagaataaaaacacsagwtctagttttaggggaggcatgttgttacygtaccttagaatttctggaagatgacatattcatgcttttcctgataactgctgagtctcctgctctgtctgccaatccagtcaagaagcctttgctagcaatcaattaataatacgtttcatttatacatatttcctatatatagtatgttattgattatctcagtaccactgaagagaggttatctgggtcattggagctttgcttctagatttgtgaagccataaacctatatatttmaaataggaggccaaaaaaaaacgaccattgctttatatagttagattttcagtgaattgagagtttatcatttgtaattatacattaatcaaatataaggcataatatacccccctgcttatatcagcaccatttcaaatgtaatgttaaaaaataataaatggagaagtagatagctaacaagtaggcttaatttaataagacaaagtaaatggcatttggaaacmtcatggatttaatgttttatttaaatgatttctgatttttaaaaagtaaatattgtwtccagaaggctgagaaacaagttagtagggagattttttctttgcaaaaaaattttacagttgtgtctttaacattgtaccacaaactgttgtcctaccagtctctttgtaagaaagctatagacatgttgggaatgaatgagctctttcctttttaaaatatcagttttacatcattcaggttccaatcgttgcacttactgctactgcaagttcttcaatccgggaagacattgtacgttgcttaaatctgagaaatcctcagatcacctgtactggttttgatcgaccaaacctgtatttagaagttaggcgaaaaacagggaatatcctkcaggatctgcagccatttcttgtcaaaacaaggtaaggatttaatggttgatgaattttggtaatgatttcctttttttttttttaacaacttatgtattttatgttatttaygatttccttctaatgcatatttaacatatttcaaattccacctagttttggttcaagtcaagcatgatgttatataatcaattcagtgattgagactagtgtatttttaaaagcagaaaccaattctcctaatattttaataccccattctgttgcttaaacagggcatatactatttatttttattttttaaaattttacttatttatttatagagacagggtctctctgtcgtccaggctggagtgcagtggtgtgatcacaactcactgcagcctcaaactcctgggttcaagcagtcctcctgcctcagtctcccaagtagctggaactacagtcttgcaccaccatgcctggctaggacatatacttttaatgattgataagtaaacaagcaaacataaaatgactctttcatctgaattctgtctagtttactaattacatgacttcagtcttaaggagcttagaaaaggtcaccttacaaacacagtggagcctgtattgtgttccaaggactattgtaggcgctttctatataaaatgatctaatttaatccctataactgctcagtaagttacgtattattttcattttattgttgaggaaactggcattagtacttttttctgtttattttgtttaaaggcattttaaatatatatgttaagaagttttcaaaagcctatattttactttttataagcctttattttactatttgagacagtgtcttgctctgtcacccaggctggagtgcagtggcgcaatcccggctcactacaacttccacctcctgggttcaagctattctcctgcctcagtctcccaagtagctgaaattacaggtgtgcgccaccatgccaggctaatttttgtattttttagtggagacggggtttcaccatggtggccaggctgatctcgaactcctgacctcaagtgatccacctgtgttggccttccaaagtgctggaattacaggtgttggccactgcgcctggccagtttataattttaaacattaaaataaatgcttcttgtccaatcatggtgtctcacacccataatcccagcactttgggaggcagacgttggagaatcacttgaggccaggagttcgagaccagcctgggcaacatggtgaatccctgtctctacaaaaaatacaaaaattagctgggcatggtggtgcatgcctgtagtcccagctatttgggaggctgaggtgggaggatcatttgagcccaggatgttggggctgcagtgagctgagatcacaccactgtactccaggctggatgacagagcaaggccccgtttcaaaaaaaaaaaaaaagcttctaccaatacaaacacaaaacaagcatagacaaatagagtttaaagaacatcattggtgttttcctctaaagggaatattgatgctaggccaaraaaatcctggagttattcttgaggaccttaaggaataattgaaatgtaggatttgctcctggctttcttgtcctatattcagaataaaacaagaatggatcgaatatattctgagtgttctggccattctagtgctctctgaagtgagtactcactgtgtttcacttccctttcatcctaaagaggaaaagttcttttgaagaaggctgtttgtcctaggttagagtctccacagtcagatcattatctcctcctaatctttgatcctgttcagtctctatggtactttcccttataataacactctctatggcactttcccttataataacactctcctttttaaagcagtttgccttttttgtgtgtaatattgttctcctggttttctgacgtcctggtcctcttataatcctatgcaaatgtttctttctgtttttcatgttgactctgctaattgaggtctttgttactttttagccgagactattataatttccccaacagatayccctctccccagtgccccttgttgctttctatgcagtttacaaattattgtctgcaaacacatccttaagtctggaatacctttctggaactccttactaggaaataaagaccagactcagtgtaacattcaacagtattgaagatctaggtatttaatatgaatttttttttttaaggagatcaagaaagatttttgtacccatttttaatcctccaagaagacttaggatagcaggaaaccattgagagtcagaatgctttctacagatcttaggtgaacagaaactttcctcttcatgagcagtgaggtagagggtaattaaggcttcagagcattgcccgttatttccatcttcttcccttcctttaattctgctaaattcctttaatttgtttatcagtattcaagtatttttatccattgagctaaggtgtttcttaaactaaccctattttgttaaagtcttaattataatatattcatagtacatttaagtgagatagatgagtctctcatataatttagtggttagattagattagaattttctcccctcagaaaattaagaggaaataaaagtctgtagcaaatcacttggcaaaataatggctccttttgtaataggaatttttactctttygatttatctgttacataagttcaaatttttacatattttccaccttttttaaaaaagagtgatatgtagtcaatatcaatttgagcaacactgttgcatataaattgaaaaggactccaattttctaattccgtacctcagttgtgatcactgttggtattttggcatttatgtagacttcctttctctgaccctactactgtgcagatatatagttgcagttttttgttgttgttaagttgatacagaaatagttgcatactatatccattatttatgcaaattttttttcatttaaagtatctgctatctttccatatattgcattttcttaaattagagccttaatatataggatattacaatatctaggttttgttgagtagttttttcttctttgaaaacatgtttttaaaataagrtttttttttttttttttttgacatggagtcttgctctgtcgcccaggctgtaatgcagtggcgggatcttggctcgttgcagcctctgcctcctgggttccagcgattctcctgcctcagcctcctgggtagctgggattacaggtgcatgccaccatgccctgctaatttttgtatttttagtagagacggggtttcaccttgttggccaggctggtctcgaacttctgagctcaggtaatccgcccgccttggcatcccaaagtgctgggattacaggcgtgagccactgtgctggccttaaaataagatttttatacactaaaagaaaacttacatttttcactccattaagtagttcactgtgaatttttgatattgaagcccatttggttgctgtcaaaaatagatttgaacagattattcagtatgactcttgtagtgaaattattgccttgtttcctctgcttaagttttcagtggcttttgccacagtccttaaaggttttataatttttttaatgtttaatttttaaatgtttgcttaatatttcttagtatgagtgtagataatgatgaacatttagatgactttttactattataatgttgcagtgaatatttgtttacatttatcttttggccaataagcaaatatttttgtaaattagaatcctaaaattgaaattggatcaaaagttatatgcacttgaaattgattaacttttcctaaatctaaaatagtatagtcttttttatattgtcagcataaatgaatgcacttatgtaaatgaatatttttaggcgttaagtaaaatattctrtggaaattgaacatttaagttgtttatacttctatggaaatcgtttacgcttttaataaagaagcacaagtttctacaaaatacattctaacagatgttttctataacattcagtctcaagattactagtaaatacttctttgaactgtaaaagcaatctttcaatattataagaaagctcttgctttagtaaacatttagaaactcagctttattatcataagcaagaataagaacagtgtaacaagttttatgcacactcctttgtaaaccctcaccagactaattgttaatctggtgccttgcattccccaaagtatttgtatctgtcgtttataagtttttatcaaggtttcagctaaaacaaataaatttgtttctggttttagctttaatttgaactgaaacagtcaaaactgagttttggggacttcacacaattcatttggatatttgattctccataatgttttaaattttcatgcacttaaatatatcattatttttgataggctttcttcctttagtcttttctttagaaggtagaaaggaagaattaaataagataaaaccaaaygggtctgaagcatgtataaagtatatatrtttgctcttttgttcttctttttctttagttcccactgggaatttgaaggtccaacaatcatctactgtccttctagaaaaatgacacaacaagttacaggtgaacttaggaaactkaatctatcctgtggaacataccatgcgggcatgagttttagcacaaggaaagacattcatcataggtttgtaagagatgaaattcaggtatgaggatcaatcatcattgctctccrttgctcatagtggaagtggatrtttctcaaatgtttatttaccagatctttattgaatactttctttgtgttgaacataaagcagtccctctgataaatgtgggagaacaaacttgcagattagtataaatagcaatctgtacctagtgcttaggtgcacagaggagggaggaatagctctgtcaaggtagttgtgtaatgggggtggtccatccaggaaaattcaattagagtccaaacatgtaagtagaagtttttcaagtatgccaggccagtaggtgatgaggggaaaggaattggttatagaattccaggaagaaggactagcaggtgcaaagacactttgatatgagaacacatactgggttcaggaaatgtgactggtatggaatggttggagggaaagacaatgtggggtaggaatggcacaaagtatggacaaagaggcagggtggaaccgttagagacttgagagaacagttgaatgggtcggttggccaggttatagatggctttaaaacttgcaaagaagcagtctgggcttggtatcatatacctgttagttttcactgactactttagccttagaatttttagtttagatacaattttctgtaataggtaaaacggattaaagtagaataactctggctgaagttaatgtgagggaaaaggaggtacaagagtctcgtctctagaccttgaagacactccctgttggggtcttataatccttggagtgccgcagaatcatttgaaaaccatcttgatgtactactctgtgtttttaaataagataataggattatagaaacattagactggcagcaataagttggattgatttgaagaagagaaactgaagaagggaaagggtatcgatgcagctattgtgaaattctacagttgagattcctgacctgattggactggctcagtgggtgtcatagaggatttatttgggaggatttaagttcaaggcacatgagtaggtttaagtcaacaacttgacactgtcaacatgaaatccacactgtaactataagtccgaggaagagccctctcctgaagttaggaatttaacttcagctcttgcattttctgtcccaccggtcatccatttcttctctatccatctccttttctgatatctagttgttatcagtgttgttgaaaagcttaagtatgattcatattcactgtctataaagttcactacacatagtcatgctgtaatgcatacccgcctgaaagcatctggtctctcttttccttctttccaaagataagaataccattcacagctgtttagaatagaaattttatccaaattcttcagtgtttatatttttgttctgttatttcagtgtcttgaatattgtcaaatgacatttattagctactactggtactactgaatcttaataatcaatcttcaagccattaactgaccaatggtttcttctatcttaatgtattagtaattattcatttagagtaaaacatctcccagaacatgaaagaatacaaactttattcatgttacgttgtgacaggaractttgttggatgcrcctgattttcctgccaatwcacarcttcattaaaacagtaatgctttgaaatatggcttaggaaacttcacaatgatcattaattacacctaatttctggaagagtatatgcatgtatgtgttgcggtattctcccttgctgtggcaggatgtcacaaatttttatccacattacgaaaatttaaaaattgatatggttttttctccctacgttgatatcagatattttgttttatctgacagctggcccaatgtactcctactttgccattataaagaattcaaaagcttcatatttgcattgaaagttctcaaacactttgtaaagatgatgaaagtatgtttcatcatctatgtagaatagtcaggtgttcttgcaattgattacttgctaccgagaattgaatacctactgagtgcataatgtatagaattctagatattcacttttgtgtgtttttacagttgttatataccttagtgtggctctaaaagtggaggtgacagctgtagctcttaatgtcttacactgagtgatgtttagaatcttaaattttcttttataattttagaaaaaagtatacttttctttcttatttttataaccagatccaaacacatttgcatgtagataggcatttttagtcttgaacattcatttttacttttaatcctcacttttattagtttcgtatctttttgtatttcatttcccctttcaagatgccttgagtcctttctttttaggaatgatgttgtgaataaattatttgataaaatgtctttacacctgagagtttataaggatagtttgaaaatcatgtctgtaaaataggttgatctcacctaaaaataataccatataattaaaattagaattattattgtgttgcttattgactcttacatatatcaaaaaattgctgagtcttattcagccagagcttttacttagtatgatattcattcctatatttacttttttctcacctttctcatactttcttttacttactcagcattttcctcctttcctccctcctttcttttcttctttccttcttttctcttcctttcgtattcctggtccatcttagcatgtaatctttctttatgaaatggcatgcagataggtctactgttcttacagtaaaaaacttcaaggcctcatgtctttcccacttctgtttcccattcacaacctttttagctgattcttttggtactttaccactatatcttgccatagtttatgtacctggctcctacttaattttttgtttatttgtgtattagtcgtaggcattatttatcgactcttctctctgaaagatgaaaggttagctctctttcacattcttaactgcccttttttcttaccttgtccatgtatttctaaccccctttcctcctaatatgtttatgtcataattttggctagattagtgtatacgatttacataattattactctgtaaatgctttttatgatctctgagccatgtagtatattatggctatttttctttcttatctatttgtatttttattgttattacctaaaaaaaaattttctatgtcttatcactaattcttccctaaaatttcccacaattgtgtaaacttacctcagtatattcatagatatgagacattctatcaattttaccctcttaaagatgcagarataatgcattatgtttcatcccaccatctttaatgagaagcttccatcttagattaayattagagaatgttaaaatactctgcaatcaggtaaggacgcttgaaacttcatyataatgcaaaagttttctttaacacaataaatattttgaacccyttttgtgtcttgtattcataggagttcagatagaccactttatttactattttttatagagagtgaacagaaatcccatttctagtcaccagtccttaatctgtaaatcaggcagataatctgtaaatgattggttgaaatcacattgaattccactttgtgccagggacttaagttaacgaacaaattattcttacaaaaaggtataaatgtaaggttttcattcygctaaatatgtttgtcaaactgtgttgtgatttgttctcagtgtgtcatagctaccatagcttttggaatgggcattaataaagctgacattcgccaagtcattcattacggtgctcctaaggacatggaatcatattatcaggagattggtagagctggtcgtgatggacttcaaagttcttgtcacgtcctctgggctcctgcagacattaacttaaataggtaaaaaaaatttattgtttttactcttgcagatttctttctttctttccatataaacctcaaaagtgtttgaggctatttccagtatcccaagtaatttgtgagtgcatttaaagtaaaaaaaaaaaaaaagaaaaataaaacctccccaaatccagaggacatgtaagaagaacatttgtggtaagagttgccacttggagatgagctaatttcagcatgccttagttagtgtgaggaattaactaaatcaggacaatacttgggcctgtcacagagatcctatggaatactttcctaccattgtgcattaatgaacaggttcttttcctctcctcagatcctgtcaagttgcgatgtcttcagccatagttacttcaactaccactgattttgttactgattctttcttcccatgctacagtggtgattattccagaggatttctctcagtccctatttgactcttgttactatttgttttcttggttagttccatgagaccatgccagttctccttgactgtgtatgaatcattgtgttgcactgtactgacagactgccgtaagtcaatattaagtgttcagtatctaagtgcaggagaacctttctacttaagtactcaacaagtagtttgttggcacttaagttctatgagattttttgttgtaaaggaaaacattatcttgcaaagattttggggcagcatttaccaatactttgttccttcatccgtaggaaaaagaatctcaggagaaaaacctatacatggtaaccaatggggctgccaagctgatgaagtattttcagagtacacctttgtgtagctgaataaattgagatcttgaatggacatattagctcattttagtaaaatgataagagagtgcctcccactacagtttttgtttttatgcatcattaaacaatgtgtttttgattgtccactgtgttccatgaactatgctatgtgtgggagatatagtagtaaagaaaagcaaagtacctgcttccatagaattcagtataatgggaatggtaattctttagagaatcacataactatggatacataggcttcattttactgttctccttttgtgtttgaaaatgtcaacaatcaaaattttgtaaaaaaggaatcatgcaacatatttaaaattataactgtgttaagtgtaatgaagggaaattgcactgagtagtaagaatatataatggtgtgtggtatttcccaagttaaaaaggtcagataaggcttccttgtggaagtgatagttcaaatctgaaagartaggaattaattaggtaaaaatgtttgatgcaaattttaagattttccttctgagtagtcagtagcttttccttcttaacatagaagatgacaaaaccatcctttttttgtacataacaattcttgttttcctttagacagttgtatctgtcaagcttcttatgatctaatttaaataattgggatagaacacagctgtacatgttactattaaatatggaatatatcaaacataagttgattcctaccagttctgattttatttgtgtattttgttaaaggtactgaggacattaatatccagttttatattgtgcatttgaaggttcatcaataaatacaattcttgtttctctgggtcttaaaagatattttaaatggttatctcattaagatttaacaggaaataacagtgattcaaatcaaatagtggtgccagaaacccatacttgaattttgggtatagacaggttaccctttgcatcaatcctgaggaaactaaaactataggattaatcaggataaaaaagaattgagcaaggattcaggagggatctgtatcatcctggtgacaaccctcttctagaaaaaactagaaagtctaagaataaatgaagttgctggttctcacctggaaaggtcagttactcacaaaatttttagagtctatcttatgccataattctatcactgagagaagaaacttgtccagtcatcatgtaatcttcatgtaaatttatgtttttaattgcagaattcataccacaggcaaagtcccaatgtctgcatttgctgttaccttaaatagtcaaaccccaaagttattgtaatctttttttaacagagaataatttgcagagtaatctcggtccggtagatctttcagtggatccaaatgattgccatgaatggtttagaatttttttaattttcaagttgtttttattctgtggaatactggacttatttttgtagtcccaaaagaaaaataaatatttatttatttgccgttaagagttgtagttttgttttctcaaatttgtcctgacactgacgagattagttaaatgtaggtcatctgaaccaaatacaaggaaggaaggacccagttctgaagagtgtgggcatttcttttcttgtttttttttttttttttttttttttctataggaggggaacgaggtgaactaaacaaacaaaataaagcaaaaaagaactgatttttatcccttgaggtagaaagaatgagattacagtggacccccttgtctgcattttcactttctatgttttagttactcacaaccacgtccaaaatgttaaatagaaaattccagaaataaacaatttataaattttaaatcagtggtggctttgagtactgtaatgaaattttgtgccatcccactcagtckgcctcgacttcccttagaatcatccctttgtccggtgcattcacgttgtatttactccctgtctgttagtcacttgttgcagtatcacagtgcttgtgttcaagtaacgcttattttacttaagaatgaccccaaagcacaagagtactgtgcctaatttataaattaaactttttcataggtatatacatataggaaaaaacataatacatacaggatttggttggtactattctgcggcttcaggcatccactggacgtcttggaatgtatcccttgtggataaggaggaactgtatatggttaacctaggagctagagtcaacagttggaagagactttggggataattacatggaagggcatggtgggtggtcgtttcagatgacaagaatgtttttgaataacggatcatttgtgtcttcagactttccagaactccttgagaattatgcagaggtatttaatcagtcagaaggttgaatagtcaaattattagtgagtgaagtctattttgatgaggattttactaatgctgtcccttagatrttataagtaaatcgttgttttcttttgaaatatctgaaacctagttaacatggactttcatttgttcttgtaaagatatgcaaagctatttgggagattgtcatcatctgatatttgatattcatgggctttcttcacagaagactagaaattaacagagtcatgatgaattatggctgcattgactttaaaaaacaaacacctccttaatgttatttaacaattttgaataaatttgatatggcaaacaaatcagttataatcgattgagaaaggaacttaattctaatacttgactggtgtcccataataacccataatactaagagacagttttggagggcgagaagtcctgaagagctgatagagataaaggttcaaatttgagcttctttcagtgttccttacgtcaatgcttttagtttctcatacaaaataaaataaagaataacctttttactgggaaaaggtaaaaattaataaattgtagaagcattgtttgaagccaaaaagtgtgtgacatgtaaattgaaatgaaaaaccttagagtttttgatactttttcaaagcagctaaagaattgatacttggacacaggaagaattttttttcaaaagcaatttttataaaatcagaaaaatgtttacctcttgttgggggcattgactggaaaggaatacaacagaactttctgagatgctagaaatgtttttttatcttgatggggtgtgggttttgtagataatgaaaaataaacagtaaaaaataaktaaaaaaaaaagtragaaagttgccaatacagttttacatattcctgtgmtgtttttaatcgacaggcaccttcttactgagatacgtaatgagaagtttcgattatacaaattaaagatgatggcaaagatggaaaaatatcttcattctagcagatgtaggagacagtatgtattatttattttrtgccaatagtatggatttatggatgatgctcttttaagacaacaatttggctaaataattatcagtattttgaaaaaatattttgttgctgttacatgtgtgctgaatttttaaggctaacttctttgtgtctgagtaaactgaagtcaaataatgaagtcccaagtgaatcaattaatggtgattttacctcattattttcaggaatgaacttaacatatacgtttctgttcttttatttaatttaaaattttgtcttgggtagaatcatcttgtctcattttgaggacaaacaagtacaaaaagcctccttgggaattatgggaactgaaaaatgctgtgataattgcaggtccaggtaaagatttcttattatagatggacattctaaaastctttctttctcttccttttcatgtttaactgaatttttgttgaatgataagtatttcagttttttaaacaaaacaatgaatgtgtttagatatgagaaagcaaacaatattaaagtattttgcttaaaaaatagataaagcaataaaatggtagccctaaatctaaacatatcaatagttatgttaaatgtaaatgatctaaaatattatttaaaggcgtaaattgtaagaattggtttaaaaacatgaccctgttctgtacgttgtccacaagaaatccactgtaattatatagataggtttaaaaaagaatgaaacattacattccatgaaaacattaatcaaaaggaagttggagttactttaatatcagacaatggacactttggagcaaagaatattatcaggataaagaaggatattatatgatgtaaaagaatcatttcaccaatgtatcagtcagggttcaccagagaaataggacgattgatattatggagatatatatatatatatatatatatatatatatatatatatatatatatatatatatggggagggaaaggaagaacaaatatggggagagagggatgaggcgactgattttgaagaattagctcacgaaattgtgggggttggcaagtctgaaatttgtagagcaggtcaataggctggaaactcaggcaagaggtgatgttgcagtcttgaggcagaatttcttctctagcaaacctagtttttgccctttagtcctgccactgagtggatgaggcccacccacattattgacaataatctcctttacttaaagtcaactgattataaatgttaatcacgtctacaaaatattttacagcaacatctagattagtgtttgaccaaacaactgagcatcataggctagccaagttgatgcataatattaatcatcacaaccaagaagacatcatcctaaatatatatatatatatatatatctacttaacaaaaagactgacagaactgaaaggagaaatagagaaatctacagttacatttggtgacttccagcatctctcaataatcaataaaactgacagaccaaaaaatcagtaagaagacagaagaaatgaacaggattatcagcatgctggatctcattgacctttttagaacattctacccaacaacagtagagtacacattcaagtgcagatgcagtattcatgaacatggatyatattcagagtcataaaacaaaccttaacaaatttaagaatcttgtatttgtatattttttgactagaatggaattaaactagaaaacaataacagaaagataacagaaaagtctctaaaccttagaaattaaataacacacttataaataaatccatgagtcaaagaggaagtctcaaggcaaatcagaaaatgttttgaactgaatgaaatgaaaatacaaaatgtgtgagatgcagctaatgcaatactgagaaggaaatttatagcattaaatacctatgtaataaaagaagaaaggtctcaaatcagtacctaagcttacatcttaagcaacaagcaaataagagcaaaataaatcaaaatgaagtaaacataaggaaataacaaagaacataagtcaatgaatagaaaagctatggtcataccactgctgtccagcctgggtgacagagtgagaccctatgtcaaaaaaatttaaaaacaaagcagcatgcagcattcattgtcagtgaatagaaaatgggaaaacaatagagaaaatcaactcaaaagctcattctgtataaagatcaacaaaattgatataaacttctaacaagactgacggaaagagaaaagacacagaagaccaataccaggaatgaaagagggaatttcactacagacctcccaggtattactagggatgataagggaacactatgaacaactcagaacataactttaataatttagatgaaatggatcaatttcttgataatctcaagctaattaaacttacagtgaattagataacctgcatagtgttacaaccattagagggattgaattctatgttaaaaatctctgaaaataaaatcccctagcccaaagaatttcaatgacaaattctaccaaacatttagaagacaaaataataccaattctatagcatgattccatttatataatagtctttgaaacataaaactatactagagggatgaagaaaagatcagtggttattagagattgggggagggagaaggtatgattccaaaggatagtacaaggcagtattttggagtgatagatttatcgtgccctgattgtgatgggagttagatgaatctatggatatcttaaaatgtgtagaactttacacatacatacaaccaatttgcctatgttaattgaaaaaataaaataaaaacaaattatttacctggtgggttagctacgtacctaagttcaatagctgcgttactgtaagacaaaagaagcattattagggatggagttgttctctgtgtaatgacaaatacttccttcactaagaagacagaattgttttatgcacctttaaaaaaaaacaaaaacaaaaaaaatacaaccaacaaacagtaacttgctggtgcggtggctcacacttgtagtattagcactttgggaggctgaggtgggaggatcacttgagaccaggatttttaagaccagtctgggcaaaaaaccgagactgtgtctctacaaaaataaaaaataaataaaaaaaattagctaggcatagcattatgtgcctctagtcccagctactctggaggctaaggtggaaagatcgcttgagcctggaaggttgagactgcagttgcagtgagccatgatggcaccactacactccaggctgggcatcagagtaagactctgtctcacataaaaaaaataataataatgataaaaactagtctgggcatggtggctcacacctgtagtcccagtcctttggaaggccgaggcaagagaattgcttgaacccaagactttgagaacagcctgggcaacatagcaagaccccatctctatttaaaaaaaaaaacaaacttaaaaatccagcaaatacataaagcacaaagccgacagaagaggtggagaaatcaacaaatccaccatcaaagtgggagaatttgatataattttaagttattggtagggtaaacaatccaaaaattagtacactgtagaaaatttggtcaacatagtaataagtttgcttattactatttatcagtatacatagtatactgatttatcagatacatagtatatggagccctagagcaagcaactatagcagtgtatctcaagtatttttacttcatgacccacatagcaaatgatatgtgtatataacacactgggctaattgtcagagttcagtttctgtccaaaaccctaagatctggagtgattaacctttcagcactcttagaactcacttgtttgtagcacactgattgagaagcactgaaagacttcactcctcaaacatacatggaatatttctaaaaactatgtattgggccgggtgcagtggctcatgcctgtaatcccagcactttgggaggccgaggcgggtggatcccgaggtcaggagatcgagaccatcctggctaacatgatgaaacgccgtctctactaaaaatacaaaaaattagccggatgtggtggcgagtgcctgtagtcccagctactcgggaggctgaggcaggagaatggtgtgaacccaggaggcggagcttgcagtgagccgagatcgcgccactgcactccagcctgggcaacagagcgagactctgtctcaaaaaaaaccaaccaactgaacaaacaaaaaaactaaaaaacaaaaacaaaaaaactatgtattagagcatgggttggcaaactatggcctgtaggccaaatctgcatgctgttttatttttttttatttttttgacatagggtcactacaggctgtcacacaggctggagagcagtggtatgatcatagctcactgtaacctcaaattcctgggctcaagcaattctcttgcctcacctcagcttcccaagtagctacaggcatgcactaccagacccagttaattaaaacaaatttttttttggtagagacagtctcagtatgttgcccaggctggttttcaaactccttgcctcaatcagtcctcctacttcagcctcctaaagtgctgggattataggcmtgagccatcacgcttgactaatgtttttgtaaataaagttttctcagaacacagccatgccttttgtttatgtgttatgtagggctgcctgagttaagtagttggctrcaaagcctatcatggcctataaagcctgaaatacttactatctggtcctttatagaaagtgttttctgaccctgtactagactagcttgtctcaaaattcttcaatgaatttggaagttttctcaccacattttctgaccataatgcacttgagttagaagtaaataagcagataaacaacaaaatcctcatgcatttggaaattaaaaataacacttaaataattcatattcaaagaaaaaatcaaactggaaattaaaaaaaattttaaacctacagataactacattaatatgcattaacatttttagaacttagggatagttacaatgatatacattaaaactggtaagaggctgggtgcgttggctcacgcctgtaatcccagcactttgggaggccgaggctgggggatcacgaggtcaagagattgaaaccatcctggccaacatggtgaaaycccgtctctactaaaaatacaaaaatcagctgggcgtggtggcacgcgcctgtagtcccagctacttgggaggctgaggcaggagaatcgcttgaacctgggaggcggaggttgccgtgagccgagattgggccactgcactccagcctggcgacagagcgacactcttgtctcaaaaaaaaaamaamaaaaaaaacaaaaaaaaaaactagtaagaggkcccagtggctcacacctgtcattctagctctttgggagactgaggagagaggatcagttgaggccaggattcaagaccagtctgggcaacataacgagaccgcatctctacaaaattttaataacaacaacaaaaaaactggtaagaggcaacattgaatagtactttgtgggagtttattagcttgaaatactcataatagaaaagaaaattaatcagctaagcatctcactaaagagattaggagaataaacctaagcatagtttttttcccccaaacattattatatctggaatattgaatgcattcttattgctatttcaaagatacttactctaaggaaagcaattgaattaggtagttgaactctatagtagattttctttaatgagtccttttgttctcaacctacttaaataattctcatttgaatttatgatagtttcagatctacccaaagggtgacttaggaatttaacttctaaatctatttaaatgaaaggtttataatctttktgtcatattttacagtcgttagcgtttaacaatttatagcataggatttgggtttttttttttttcattttaaagaaraagtttatttaagcaagacacttgactaagggaagactatcttggagttattattactagagtaatttatttctacttaaagacagattgccccacaagtaacagctacataaaaacagttgtaaaattgtccttggttttacaatgataaatgaaaaacattaaaattctctaattgaacaaggtatgcaaggatttttatattgttttttgctaaaactatgacagcaaaataacatcctggagtataaagataagagctgaatgagcaggccactaggggacaaagggagtcttttcacagaaccaatgcttcttttgcccaccccatctccatcgaagtcaatctaaacatattattggccatttagttaaaaaaagaaagaaaagaaaagcaatatgcttgtggacatacaccagttactttatgtgcartaaaagagtaggaaggggaaggtgaaagaatagagaaaactatgtagtcaggatgtggtggaaccaaattgcaactttcttttttttttttttttttttgagacagagttttgctcttgtcacccaggctggagtgtagtggtggcccaatcttggctcactgcaacctccgcctctcagattcaagccattctcctgcctcagccttctgagtagctgggattacaggtgcatgccaccatgcctggctaatttttgtatttttagtagagatgggttttcaccatgttggccaggctggtcttgaatgcctgacttcaagtgatccacccgcctcagcctcccaaagtgctgggattacaggcgtgagccactgcgcctggccaaattgtagctttctaattgagactgtcttcttggtctggaagagcagagttctgcagtaaaataacaggtcccccttttagtagacatctccatgtctgctgctggaacacatcagttttgtcttaagcctcacttccaaatgtgcagatgtgtctggttcattgattggctgcctgtcaaattgaaacctgatctgcctcattggcaaaccgtgccccttacaataggctttcattggtttactaagcggtgtggtgcgtggctgttcatcttaaactgcaccacagtttaagatgaaccttcaaatgaacattatccttgttctcagtcttgactttccttgggctttttgtggaccctggtgagtgtggcagtctcctcagctgctgcttcacaaaagaggtaccaggtctgccccgaatgagtgagcccctaaacaggaccaggagtggcagaagaaagaggcagcaactgagatgtgttttttctaagctgaaaggctttttttttttttttttgcaacacacctttaacactaaagtccaatatttatataattggtcaagtaagtggagctgttctagctataaatatggcaactctgcttgctcgtcctattattgacattattcctttctgtggtctgaggtgcctcccatgaaacttgcttctaggacactaggattgagaaccatcagcgtaacatatctgttaygctacaatagtttattttcatattttagctactttacatactcgggtataatgaactttattcatagcttctgaagcagttggcacatttgagatattttttacttggctaattgttatgctaaatcttttgatttctaaagatacatgcctttgctaagctttcttcaaatgttattatttttatttagattggatcattgctattccatggatgactcagaggatacatcctgggactttggtccacaagcatttaagcttttgtctgctgtggacatcttaggcgaaaaatttggaattgggcttccaattttatttctccgaggatctgtaagtatatatctgtgaattcccttcatagatcttcttttacttctattacacttttcttcagaggtttgcagtattatgattgtarctttgacttcagatgggtgactaggaactcatagagtcttactaagttccagttaaacactacattcattactttggataaaacccgtgtgtatggcatcttctgctgttttcatgttcaagccgatgttcagctctgcagctcagtctggaagcattgtgttaatttatcacattgcatttgggtgaatccctagactagtcttgcttaggataattaggaaaagttaactttcattgtatcaagggacaggtagaacaaaattgtccttttgtccaggaaacyattaaattcttcaaggaaaactttagttatagggattattttttaaatgtctaatttcagtaacaatatttgggacatatttatttttccttctgtttcctatcagaagtatttaaagttataagaaaattgtggtttttgcctttactaatgaataaataatcaattaaattcagttacttttttttggagtgattgatgttccagtattcttctaaacaaccacgggtacaaatgtgaataagataggaccgttgcagtccaagagcttgttctgtagtcctttcctttatatgattttttcccctgatttagaagtctataaagcaaagctaagtattacacactgataatggctgaataaatcaagagcaagagataggatactttgcaaatatgcatatttattaaaaatgtactttaaaatagagattaaaattctcgtattgaatgtagaataggtaagcatttatttgtgaaatactcgaatgcttcatgtaaatactttctgagtttgtatttttagaaaggaacattttggaggctgaggcaggagaatggcgtgaacgtgggaggcggagcttgcagtgagctgagattgtgccactgcactccagcctgcgcgacagagcaagattctgtctcaataaaaaaaaaaaaagaaacatatttattaaattagttgtgaaatatttttaatgaaatatattgaaaacttctgttgatttttcatgtactgatgtttttagattctaaatggagtttaaaattttgtttgtaaatcacaagttggattagaaatttaatagtagaagtgttgcctaaggactattttaggtgctgtgagtgaaactgtattttttataacaagaattttagttgtaagggacagcttaaatataattgagatctgtgaaaatgtattctgtctctatcaccttcagaacctgtgtatctcagttgaatgtataatttataaaaattattcttgttttaatttggtgtaatccagccatatccagtatcaacaaataagtctaagtaggctccttgacaaacttgaactggccacaagagagatcagatttcacctattaaaaaaccaaatcagaccacttacactgacagtctcttctgggagtcctcaaattaagaagtctatcctttgtgaaatattacactacccttgctagataaaacttttctaaaagtaccacttaatgaaaatctgtagacactaaatgcaatgaaaataaggcattgtttttttttctccccatttcagtgatcttggtatcctgggatattgtttttaaaattatcgttataattcctttgagaatttagtgaaaygttccctttaaccaacttaggaaaaattaatatctttgtacatgattttgagctgtaaaataaacattttaaactgggaataattggagtttagttaaagagataatgtatataaatatataacatagtagcagcatataattctgtcttacacaagatttttctgaatagtataaacagttatgtagcctatctaggagtttgtgaatagagtttaaaattttgttttgaagctgcaaatttgattagaaattaaacagtraagttattacttaaggaacttcgttttagctgtctgaacaacttactgtataaaaatctttaaacattctgtataaatatgtgataagatatgcaatgaccttaattttatagattagaaaataaaaacacactcattaatttacataactgacagattaagtgaaacttctcttctgatcacgttagcagaatgccaaatcttgtcgtggcactagaattagacggtagttttgataatacatgatttgactatagacatttgttgaaactattggtagttttaatcactcttgtaattttcaaactatctaacgggagaggattatccatcctgttttctagacaaactgtttcatctgaatgaaatatattcctagagataattatcactacttcatcttttggttttattttgcacatagaattatagttcacaatgactttctgaagctctaaagttgcagctgtgagcttctttggcctgtagggactgggaaaaagcacccccgtcctcccccaagcccccccaccaaaaaaagttaaagtgtttttaacaatagctgtgggctttttgtagtttcagaacttaggagttgcccaggctggaatgcagtggtgtgatcatagcttgatgcagccttgaactcctgggttcaagcaatcctcccacctcagcctccagagtagctgggaccacaggtgccaccccacccagctattttttttattttttaatttttttgtaggtatggggtctccccatgttgccctgcctgtctcaaactccagggctctcaggtgatacccaccacccttggcctcccaaagcacygagagtcactgtgccaggctgagtttaaaatttcttgagttggagtttatggctattttttccactagttattaaacatgtatttttgtataaggcactgtattacattttgtggggggattcaaagctaaattagatgagacgcatcatctattatggaagatgttacttaagaagaaatgagtgtaatgtagcagagaattagataagggacgtatgaatacatataaatgctgttgaagttctgaagagagagagtgtttagagaaattagaggagtctttgtgaagktatcactagaacttcctatttttgtggaatatatagtagattttggtgtgatactgtggatttggacattcactcagagaaggaatgagggaagaatggtggagaagaatggcattcacagtacaaaaagcaactgtgacttttaaagaagttaatatggagaagtggcaagtcttttcttctctcttctcttctcttctcttctctcttctttttcttttttctttttttctctgtcagatacygttgtaaagactttgcttttaccggaaactgatacgttgggtcatgtaccctggccagtcagttctctttattctaacacttagccgatcarttagatttccacattccatgatatgtcagttttggtgacccttatttttccacctggtttataaagggaaagaatgtgatatgtcacccaggctctggagtacagtggcatgatcataggtcacagcagcctcaaagtttccagttcaagcgatcctacytccttggcttcctgagtatgtggcactacaggtgcatgccaccatgcccagctaacttttttgtagagacagggtctccctatgtttcccaggctggtcttgaacccctgacctcaagtgatccgcccaccttggcttcccaagatattggcattacaggcatgagccactgtgccggcctgaaaatttctcttttgagatggcatcccacagaagtatacctgcttagagctaacactggtaaaaagactatttaaccctattgccttattttactgtagttgagattgagttaaactgaaagctgaatgacctgtcctaggtcatactgttactttgtgccagagtcaggatgagcaaatggatttcctgcctgctagtctagtgtcttttctatttattgtgctgtaacatacagttttaaatttgtatttttatgcccaatggacatggtagctcacacctgtaatttcagcacttttgggaagccgaggtggggggattgctcgagaccaggagttcaagatgagcctgggcaacatagcgagactccgtctctataaaaaaaaatttaaaaattagctgagtggtgatgtgtgtgcgtgtagtcctccttgtgggaggttgaggtgggaggatcgattgaatctaggaattcaggactgcagtgagccatgattacaccactgcactccagcctgggtgacagagcaataccctgtctcgaatgaatgaatgaatgaatgaatgaatgaatgaatgcccaaatccgtaagctatgttctgtatagcagctttttcatcataggcagtttttactcttatcagtggacaacctacaaaattaactaaacacttaarcaattaacagaggaggccttgttcagagtgagaaatcattaagcatttgttgttgaaatttcttactgtactctgttttaattctgtttttttttttttttaatgttacttgttttagtttggattcctagttgaaaagggaatatgattcctttaaaacaaagatactcygctttaaagcaaaggtatatcatcctcttcatggtgattgccatggaaacaagacaatgtaaatttattcaaatagtacacagtttttatagttattgatcatgaggggaagggacagttaatccctactgatcagataaaacctcattgtttcatactaataaatggtttttttatgcttatgaaaggaaaagccagaagkgtaatttttagtgtttagagagctagtgattctagttagggaacttaatacctttgaagttattagtttgcaagcaatagaatctactactaccaaggtgacccctagcagatgtagagtaccattaacaagtgttccagggaaggaaagccaactagataccaagtcatgctttttactcttagattaagaaattcaggttgagttaaaggatcagctgttaactaataaaaagcagattaatattacagagccaggctctgtcctggttatggacttaatcttcacagcatcctcaagagataaaaatgaatatacctgcatattagatgaggaaatagaagataagtaacttgccagagctatgacgtgaactcaggtaatgtagcttaagagcccccacatgtatgtatattgggtgtgtgtgtggagggggtgcgtgtgagtgcttgtgcatgcgtgtggtataataagaaaaaattagcatttatgcctgtaatcccagcactttgggagaccgaggcacgaggatctctcaaccccaggagttcaagaccagtctaggcaacatagcgagaccctacctctacaaaaaaagttttaaaaatattagcgggcatggtggaatacacctgtagtctcagctgcttgggacgctgaggtgggaggatccttgagtccaggagattgaggctacagtgagctatgatgacacctctgcactccagcttgggtgacaaagagagaccctgtctccaaaaaaaaaaattagaactagttatctggaggcctgtgttctagtcctagctttagtacggctacacagtgacacattaggctaccatttaacatctttgaacctctgataatttgttaacaatatgggtaaaaatgactaagataaatcaaagagctccagcattccctccagctctgaaattctatgatgttttatcttattttacttacaaaaataaattatattatgtatatttaaagtatacaatttgatgttatgggttacctatagtaaaatgattactataatgaaactaattaacatatccatcatcttatattgttaaccatttttttgtttttgtggcaaaagcagctgaaatccactcatttagcaggaatcccaaatacagttcagttgtattaattgtaattctcatgttgtacattcgatctctagacttgtttatgctacatatgtttgacttttaaacattctactcaaatcaaccctaagtcagggttagcacagacaggacttgttaacaaggtagaaggtgccacattgtacctgggtgtttatatttctctaaatcttgttctgatcatattttaataaatataatcatcaggacaccaaaattcattccttagctattaaaaaattctattctattttattgttaagatttaggagagcatggtacagattctcttaactatacctatcagaagcctatgttttaagtccaatgtataggcactgctctgtttgtctctggtgggaacttaccctgctttacctaatttcatcctrgcttcctttttgtgaaagatcacccttgcttagcctattttttggcaaatctacaccttggaaatagtagtaaatgacataagcatattaatatttatgatgtgatttatttttgttttcaagtcatatactggggaagattctcaaatattaaaacaatgtatctttacatttatgtatgtcgttcttgttctgttttagaaggcttgtatttgcatttttaacattccaaaaggtaaacctgtaatcataatgttttcatcaattcaataaaaccattacgtttgtaatagagagccctatagttgccttagttaagtttgctgcaactcattttatatattcttttaattttgatccctggatttttaattgattattaaaccttcattaggatatatatgaaatgtaaaaatattgagttataatctaccgttttctaaaattttatactgcatttttatatagaaattcaaattgctcataatcattctagtgaatttaagtagaaaggtatttattactaggtattaaatggcttataatattgttgacaaggttccactgcaaaatagttcaccaagggagctgtggcctcttctgtgatcaagaagccatctgtcaacttgggaagcttccactatagcacctaaccccagactacattgagtaggaagctgtaataatcaggaagcttctacctttgcatgctctgcaaaccaacgtgaacctgctgtaatttgtaaccacaaaatggatgcctgttgatacttacgaagctcatcattgtatgctgggttctttgctaatactttcttataaaaattaaatacctccacaatcatgcatgctagcagaaacagcagasgagtagccttagcctcacttcctgcttatacctgtcatgcaratatacagaacccagaaccctagctgaaagggagtttgagaactagtatttgtattgtcccagattctgcagtggaagaattcatagtggatggaagttagaatgacccttgaattacaatcggccacattcatcacaaatacattaaataagagtaatttgccataaagctctatgtttgtatacttctttgktttttttttttttttttttttttttttttgagacagggtctcactctgttgctcagtctgtagtgcagtggtgtcatcatagctcactgcagtcttgatctcctgagctcaaacgattctcctgcctcagctcctgcttcagcctcctgagtagcggaacaacaggtacacaccaccacactttgctaattttttattttttattttttgtagagatgtgggtctcactgtgttgcccaggatggtctcgaactcctgggcttaagtgatcctcccaaagtgttgggattacaggcatgaaccactgtgcctggcccatatactacatatatttaaaagtagtatttaaatgtgtaggatgaatgaaagaggcagtaagagaacaaagtgaatgaaaaagtatttctatatgaagtgaaagcaggagagtcctctctgttagagaacaacagaattgcatatgacagactagctttcttaatatttctagaacttgatggctgtgaagagcgtcccgtaggaattctcccttcacttaggaaaacatacctcaaaaccatcagctgtttagcatgcacctgcttttcctggtatatctcagtgaagcagctaaattgtaaatgattaagtaaactttgcagtgtatcatgtgcaaaagcacagtaaaaacaaaaatgcattggaagctgtgagttgttgcactgcactcatggatgaatagctgttggttcgcattgcgttkttttgttttgttttgttttgtttttttgagatggagtcttgctctgttgcccaggctggagtgcagtggcgtgatctcggctcactgcaagctctgcctcccagattcacgccatcctcctgcctcagcctcccgagcagctgggaccacaggtgcccgccacaacacctggctaattttttgtatttttagtagagacggggtttcaccatgttagccatgatggtctcaatctcctgacctcgtgatctgcctgccttggcctcccaaagtgctaggattacaggcatgccgcattgcgttttatataattctcatggttctagtctcgagctgtaggattttgatcactgtttcaaacaataatgtgagtttgctaagaggtctaaataacaaaagctaagtgttccaaacacatatccaaacctatacactgggcaatgcatctgaattatatgtgaaatttcctgccattatttaagacacaaaaggaacattattttgataatgtatttatttgtgagtggagtgttcagaatgagcacgatgggtataacatttttgtaggtttttaaagttgaaatttagtgtaaatccaaagaatcaatagacaagtctgtgttttacttaacctrtatgtttaaattagcatttttagatactgattttattcctaatttcagaattctcagcgtcttgccgatcaatatcgcaggcacagtttatttggcactggcaaggatcaaacagagagttggtggaaggctttttcccgtcagctgatcactgagggattcttggtagaagtttctcggtataacaaatttatgaagatttgcgcccttacgaaaaaggtaaayrgtgtaggagtctgcctgtttgacttaattttgtttcccactccacattaaaagatcctttttgcttttaatagggtagaaattggcttcataaagctaatacagaatctcagagcctcatccttcaagctaatgaagaattgtgtccaaagaagttkcttctgcctaggttcatttttcagtttttttcttgtaacttctgcattttttgttgctatttatgtgattcaaattataccagtttataggcctctcacaagtaaaatgaattrcctgtttgtttttgtatgcctattttagtcagtytgggggaagggatctgtgaggaaaggataagtcatagagcacttttcttttttaagagacagagtctctctgtgttgctcaagctggagtgcagtggtgcgatcatagcttactgcagcctcgatctcgtgggcccaagtaatcctcagccacctgagtagatgggactacagacatgcactactatgcccagctaatatattttaattttttgtatagagacagggtcttctagtgcttcctaggctggtcttgaactcctgagctcaagtgatcctcctgcctcagcctcccaaactactgggattacaggcatgatccaccgctcccagccagaacattttcttggttgatgggaagtagctgaccatggtatttagaaaacttctttctcatcgattaaagaagcagtactgaaatcaatgcggaggaatccatatatcatatttacttctggtgtgtagaagtggaaagggaatacatttgttgcttacttttttgtacctttacatgtgattgatcacttgtgagttttttctttcaaacatcttaaagcttccagagctttttctrgaaaaaaaaaycagttttaagaatcaccagttctaaaagggtaatatcttattcatctttctgagaatggagtatcatgattcatgaattagatacttgcatcttaacatttgaaataatttaattttattattttttagttygaaaactgtatcttcgggcaccaaagagcattgttataatcaagtaccagttgaattaagtacagagaagaaggtttgttttaaagaaattgttctgayttatttcattctttattgattcaaattctgtttaaaattttatattttaattcctttccaattaaagagaaaatggcatatataacaaagcataaaattcggccagggaagtgatgtgaacagactaaaatttattgtatataatttctggggctaataaagaattggaggtatttgagaaaggaattaatttgggttcttttaaacctatctgctaactcatttggcttagagtagtcacatgttataatacttatagttgatcaaaaaattgattcctaagtgttcttattaaagacacacaccacacacacacacacacacacacmttctctctctctctctctctcacacacacacacatgcacacacacttatgtactttcttgctttttttgacctaagatcttagataactattacagattaaatactaatccactggcagacttcagctaattagaacactggaataataggcaagcatagtgaattacattttctggtgaactttttctgctttattgaagtatgcagaatgtaaatgaattgtttttataactttggcacttgctgtatcttagaacattcttttgatgatttattttctgtagttttgggagagataagacattggaatgcgtttctaactacctttagaactttagaaactgataatttaggaggttattttcaggtgattaatttgacagcttgattaggcaaagaaaaaattgtgattttgagatttttgtttcttattttcttcacatttaaaagttttttgaaactttttttaatggacctttatatgtttaaatgcagtctaacttggagaagttatattcttataaaccatgtgataagatttcttctgggagtaacatttctaaaaaaaggtacagagttccatatttctatgttctatacttgctttatgagtacttttttttctaaagagaaagaactgtcagatgttgggctatttcattggcaaaaggaagttaaatttaaaacataagcttttcagtattagaatgatcaaagtgagctataaaagaataatgttaatttaatagctaacacttcttggatattactgtttgtcaggcattatgttaaatgctaagaactttatatgtgatatctcatttaattcttacaagagtctaacagctgttactatttatcgccattttatagttgaagataccaagggttaagaagttgacaaacttgttcaagagcatacagctaatggccgagctggctttcaagtctatatttgtctacctctagcatcaagacactatttatttttctttgtatgaaatatatacaggcatactttgttttattgtgcctggctttattgtgacttgcagatattgcatttcttataaattgaaggtttgtggcaaccctgcgtcaaacaggtcatattagccccattttccaatagcatgttctgttgtcatgtctttgtgttatattttggtagttcttgactggccattcaccatttctctccctctcctcgggtctccctgttccctgagatacaacaaaattgaaattaggccaattaataactctataatagtctctaagtgtgttttttttttttttcgagactgagtctcactctgttgttcaggctggagtgcagtagcacaatctcggctcactgcaatcttcgcctcccgggttcaagcgattctcctgtcttagcctcctgagtagctgggactacaggcgccccccgatcatgtctggctaatttttgtatttttagtagagatgggtttttgccgtgttggtcaggtggatcttgaactcctgaactcaggtgatccgcctgccttggcctcccaaagtgctgggattacaggtgtgagccgctgtgcctggcccatctctaagtgtttaagagaaaggaagattcacatgtctctcaatttaaatcaaaagctaaaagtgattaggcttagtgaggaagccatgtcgaaagctgagataggccaaaagctaggccccttgcaccaaacagttagtttgcaaaggcaaaagttcctgaaggaaattaaaaatgctaccccagtgaataaaacaatgataagaaagcaaagcaggctttttgctgatatggagaaagttttagtggtctttataggagattaaaccagccacaacattcccttgagccaaagcctaatccagagcaaagccctaactctcttcaattctctgaaagctgagagaggtgaggaagctgcagaataaaagtttgaggccagcagaggttggttcatgaggtttaaggaaagaagccatctccataacataaaagtgcaaagtgaaacagcaagtgctggtatagaagctgtagcaagttatccagaagatctagctaagatcatcgatgaaggtgcctgcactaacagactttgaatgtagaccaaatgctttctaccagaagaagaagctgtctagtactttcatagctagagagaagtcaatgcctggcttcaaagcttcaaaggacaagctgactctcttgttagaagctgatgcagctggtgactttaagttgaagccagtgctcaattagcattctgaaaatcctagggcccttaagaattatgctatatctactctgcctttgctacatacatgtaacaacaaagtcttgatgatacctgtttacagcatggtttcctgaatactttaagcccattgttgaaacctgcttagacaaaagattcctttcaaaatgttattgctcattgacaacacttagtcaccaagagccgtaatggagacatacaaggagactaacgttgttttcatgcctgctygcttaacatccattctgtagctcatggatcaagaagtaaattaaccttttaagtattattatttaagaaatacagtttgtaatgctttagcttctgtagatagtgattatcagagatgggtttttaagaggttttccagaaaaccttctggaaaatattcactattctagaagtcatgaagaatatttgtgattcaggagagtaggtcagaatatcaatattaataggaatttggaagaagtcgattcttattaaaatcaagagtttagtgatagacatactgagtttgggatacctgtggagtagtccagaagttaatttaaatatatgggcttagtgtacagaagtgagcagggtgcttatatatgaataaatattattttaagatatatttaaattttccttaaaataatacctatacttgatataaaaagttaattggaaattagtggcttatgacaagcataccagcccacactcttcccaaacccactttgctcttattcatagaagctgtcatcttcaaatcttccagctgatttccctggcgtgtgccttcttatttctgaatgacacgcttagagtactatttttttgacttagcaattttagaaattttctactcatctcctattatggtagatttcccctccttcattcctcctccaatataattatatttcgtcatattaataatttgtttatatatatttttaatataatatgataatattgtatttatattattaaaactacacaaatattatatacacactactaacccaaccgtgttattatggccaccactacctttatttttttccttgtgttagtgattgtctttgttttattttcttggttttgagtattccttttactaattttcttttttcctatttcaatctctcattatttgtttactcatttggagtgttccttgacttttatcccctcttacctagtgacattttaattttagttatcaaatttttaatttctaagaatgcttcttgttctcttcttgtttcttcttccccaccagccaaaaatctatgatgttatagcaaggatcatacattgtttcccagtaggttaagaaaccttggttaaaacctgttgtatcccagtaagttaaaagacgttaacgtgtcatcttcagtatggatgaaagaatattttctttcaaaagcagttggttgaggaagagaatgggacaaatgctctttttaaaacaccaattttgtgatgaactcaaattgcaattttaactttaccattataatgaatgtatttgatccaaaatgtttaaaatctaggctgttgtcatttaaataacaaattaccttactggtatcatgaagaataaatgtttgtactgatttggaaagacattctcatttaggggatgaaatagaaagtcaatgaggagaaagaaaagcttttattatttattttcttttaaatatttyagtatcatggtacagtcaccagaaaaagcttacagttcctcacagcctgttatttcggcacaagagcaggagactcaggtaaggcttttgtaaaaaggtaattagtttatgataggatagttatgattctatgtatgcttaaaattctgtattttgccagcattttaaaaattgttcttaagctaagagtctgagtttatatttcagtttatattcattctaaggaaaaatgtggtatctgaagctctaaaaataaaggactagatcttttaagtacactttaaaaagtgttgtttctttgttttttgttcagattgtgttatatggcaaattggtagaagctaggcagaaacatgccaataaaatggatgttcccccagctattctggcaacaaacaagatactggtggatatggccaaaatgaggtaaactatcttttgcatgtgttctcatttatttccttctaacaaaatagatttggaaaatatatctaagttgataatatgaccatagcttccactgtcacatctgggaggtgactcagattccccctgctgcgatgcttatctctttgccaagctttagtaccgtgtttctgtatgaataaaaaccagttacgttttcagcaatcatattcaatatttataaaatctaactcattatttacccaccctgcattttatccaaatgccgaaactcctctttttggattctttatttttgattatcttaccatcacatttgtagtcagaggttcctaatgcttaaaacctctgatctgaattttctctcctccaatataaaaccccttcgtcttcctcttcttcttcttcatttttttttttttttttgtctgaagacttgtctcactgtgttgcccaggctggagtgtagtggtgcgatcactgctcactgcagccttgaccccctggactcaagctatcctcgcacctcagcctcccgagtagctgggactacagaacatgccaccatgctcagctaatttttgtattttttgtagagacagggttttgccatattgcctaggctggtcttgaactcctaagctcaagcartcttcccgcctcagtctccaaagttctggcactacaggtgtgagccactgtgcctggcctctttttctcatttaaatacttttcataccttttgtaaaacgggttccttgttgcctgtctatgccttcctcctccttcttaatgacaccacgttaattctgactgttttcccttggcctgttgcagaagcctcttaactattaacccttcattctctctctctgtttcatctgatatatgagtaccaaactaaatcttcctttatcatatcttacttctgcttaaatgttttttttctagcttagaattcaaggccctctatttatgaacttaaacttacttttccctctaagttacagaatttgaaatggtttatcttacctggattgtttatcacttgttgaagatccattttcaacttccatatatttatttacagtgttgcttctccttgtagtttccttgattcctcaaaactccttttaagaattcttgaagatctcgctttattactatttctcgctttattactgtaaagactatgagaaggtctttcatgatcttatcagcaaagtaattcctctctcttgaattcatagaggactttcagatgaattctaaagatgcttctgtagcacttaccacacaatgctatattttatttttttgtaattagtggtaaacaagtattattatatcttctagattttaaactccaaataaagatactagctccttacctttttgtgtgtctcctgtagcacctagcacaatgcctcataaacaggaggtgatcattaaatatttagaagaaattatttcccaagaatagttgcttggtaattgtatttgtcttttacttccttttaaaaaattgtttctgtcactaaattgcatccaatagatgttacttgagtgcagaattttctaatgacattacacagtgctacatctgacactaattcttttgttaaaaaataaatattctggccgggcgctgtggctcacgcttgtaaatcccaggactttgggaggccgaggcgggcggatcacgaggttaggagatcgaggccatcctggctaacacggtgaaaccccgtttctactaaaaatacaaaaaattagccgggcgtggtggcgggtgcctgtagtcccagttactctggcggctgaggcaggagaatggcgtgaacccgggaggcggagcttgcagtgagcggagatcgcgccactgcactccagcctgggtgacagagctnnnnnnnnnnnnnnnnnnnnactccgtctcaaaaaaaaataaaaaataaaaataaataaatattctaagaccatactttaatggaggtgttttttgtttttttttgttttttttttttttttttggtgatagagttctcactctgtcacctaggctagagtgcagtggcgcgatcctctggctcactgcaacctccgcctcctgggtgcaagccattatcctgcctcagcctccggaatagctgggactacaggtgcgcgctgccacccccggctaattttttgtattttagtagagatgaggtttcactgtgttgtccaggctggtgttgaactcctgagctcaggcaatccacccgccccggcctcccaaattgttgggattacaggcgtgagccacagtgcctggcccagaggagatatttaatgaaaaataataatcattagataggcagatttttagaaggagggcatcgaatgggttcttggatattggacacaataagaaatattgagctaaaagtctgaaggaattggcagatatactgttacaggtaaacactttgtagaagaaaataatgaatgagactttcttttgagattttcttagcctcttagttgttcccagttaaagcctcatatttttccttttcatgacaataaaaataataataaaatcagtaataaagtgaatatatgagatgttaacctgttcctttatgacaatgtcctgtttaccaattaacagtgtgtttttgtggtgatgggggcaagacaaatctttaaatggtggaaagcaragaaagaaattataaaacatgattagttgtattatacgttgtttttgkttgttggaaaaactatacatttattgagagaatcattaggaagctgaacatcagctatattgctggagtgatactgtttcagtggtttcttgacctttttgttgttgttgttgttgttgttaaacacagaccaactacggttgaaaacgtaaaaaggattgatggtgtttctgaaggcaaagctgccatgttggcccctctgttggaagtcatcaaacatttctgccaaacaaatagtgttcaggtaaaatactgtggtttgcaggagctcttagagaataagcattttttgtaaccatttcaaaagtaccctccagaagcaacatttgctcactttatttgcatttccatactggacacttagaaaatgaattaaaattgtttttacagtcaatctgttgtaaaaacatgtcagttatctacttttaaagatgatactaaaaagtagttgtccaggctgctgatgtctttctatttcattgggaggttttgtttttaaattggaaacattattttaggttgataaattataattttacattcaaatgtggtagttggaatttaaagctggaaagttatccttgctatgagttggtcaggagctcagccactttcttttggtttagcatcttctctaatctccctccccttccagtaatgctgtcttttgatagtaagtggatttcatattattctcttcagttttaatagtgtttccttcatatccttttattattgcttgttctgccctaagtgaccatttccagaaatgtcatttaggattttctctaaactccacgtagcagactctataatgcatactctgcagaaggtgaggcagtgggaggtagaggggagactactagactaggagtcacggaatcaggactttagttcttccttacagttgttcacctggtgaacctgcacatgtcctttaatttccttgggtctccatttcctcagctatacaatggaaatgacacttcctcccccacatccaggaaacaacagatgacattagaaaatagaagacatgggataagtataaaatgttgaaagagttaaacacattcaaggcaatattaagggattattttttacttccaagaagctcctggaagctttgggcaggcacagttggatcctactttagaaaaatctttctctaactataagtagaaaacccttctgctttttgaatgtagcatttccctcttttgatatagagtatctttggcaactttgaattttctttttcatactcttatataagacatcatgtgaaaattcttatttcttactgagtttttggaaatgaaattataatgtcttaatagtttgagaaagaatatcatacctaccagcggtaattgagtaagttccctctctttggacacttgaaagtagtatcttctttcatgaattagtgatattatttaataatgaatgagtgatctctcctaactccccttcagaagaggaaaatgaagtaggggaaaaggtaaattccccaagggataggtatgaaacctttatgaaccttctggatagagaagatgactgctgatttctgtgattagaaattatacttgggttattctgcaaattgaaatgaattatttwaaaaaaaacaactttaatgtttattaagcaagttttgttattcatgagtttcattagcctttwattttttttttaaattttgaagtaaaatttcttgctgtcacaatacacattaaaaattacaaatatgacacatattaaacacattaagatggccgaataggaaaaatatgctaaaatatttttatataaatacattttttgagaattttgagaatttctggaacaaagtaatgatataatccataaatgtacaattaaagagtttaaggatatccaaaatacttggcaaagtaatctgaaataatactcttaggaaggtagggcaagaatgtgattctagtaagcaaaaatgtratcaaatcgtattctagtcccagctactcgggaggctgaggcaggagaatggcgtgaacctgggaggcggagcttggagtaagccgagatcgtgccactgcactccagcctgggcgacagagcgagactccatctcaaaaaaaaaaaaagactatatgaacwtgtatggcataaatatgtacaaatattatttattttaaaaaaattcaggggtagggacagggtagttagaaaatatctaaggatgttcatgaaataatactggctatgaatgacagttgatgaaaccgggtggtgcccatcttattccctcgactcgtgtatatgtttgatatatcccacaataaaccttaaaaaaaaaaagatgagtggtcaattataggaagatataaatagaaaaggcaataaggacaaaagttggcaaagcttacctaagcactcttcagataaaaagacatttttgctaactagatttgaatattatagtttaattgtcaaggaaaatgcctcaacttaatctttgttaagagactacttaaggcactatcagaagttccctcatggcaaggtgcaatccctcatgcctgtaatcccagcactttgggaggccaaggcaggcaggttacctgaggccaggagttagaaaacaacctgggaaacatagtgagacccgacctctacaaaaacaatttcttaaaattagccaggcatggtggtgctagcctgtaatcccagctatttaggatgcttaggcaggaggattgcttgarcccggggatttgaggctgcagtgagccatcattgtgccacaatactccagcctgagtgatagaaaaaaaaaaaaaaagtgtctttgttatattccaaacttgttctcaactttcaggtgagctggcttcctgtataactcttgtataggacagaacatactggttggggcaagtgaaactgtctagttgtatgcctcataaattaatgaatttcctttctaatatatacactgatatttatacacacatacacataaaaccaagctcaatagatgggtagtgcagctctattccccaaaacccaactaccctgtaacaagacacattagacttttgagattgcaaggatgaggactgaaatgctggcctagaccatggtgttgccatagtggggtgaccagtctgaatagccaacaatgcttcctcagtaaatacccattttgtcttggtgggatttctayaaattgcaaaatgcagctattatgaagctgtaaaagagaaacagaaacatgtaacacctgggactgttttattaggcccaccgtatgctcagaacatgaaatctccactgctagggttatttgattgaaattatcttttgtgttgatgtgagagtttagctctgagattcttccacatgtaaaatgtaatcccccaaagtatttggcaagcacattttattgccttggstcagataattgaaacattaggcatcatatatatagcatgtaaaaagtaaaacagaaacatttatgtttctcaccaagcagtaaattagtactcaactaataaatttcttaaactccctaataacagaatatggaaacaaaaaataaatctttccaaaagaagagctcatggacacatttcctcatatatgtatacataatatagtagaacacatgataaataacctataaaaatgataccaatatcattcatcaagagacgaggctcttctttaaattattaatttcatctgttacaggttttattatgactgtagtatgctgttttcatctaccttttatgtgtagttaaaaaaatagttttctatctctttacctttatttcagcctttaaaaagattccattattttttcattaatcttgtttttcagtttttcccattttttcttttaaacatttcttaaggaaccatatttaagattttatagaatacttagatttctagttgggatgtatcatttaaaattagatatgtagagagagtgttatgatatatttccttacgatatattagtggttatagtacctaaatttgaatagtgattctgttcattcattcattcattcattcaatattcacttccaggagattggggacttatttaaagacagagtagttcacattatagttcctttttttagtccttcttattcgttaaagaaaagactaggaaatgtttgttattacaaatattttattaaaattttgtgtgctctagcattattttaccttttaaaatcaatatgttaaaaatccaacttctttttgagctccccataaaaagggaattatttgttgcttatgggtttaacttgtgttatttttttcttaatggctaattatcatacatatattctattattgtattgatattactgatcatttgtgctacattaaaaattctgtagacagacctcttttcaagtacaaaacctcaagaagaacagaagacgagtctggtagcaaaaaataaaatatgcacactttcacagtctatggccatcacatactctttattccaagaaaagaagatgcctttggtaagtgtgactttcatgttacagggaatttttttagtttacttaaacttgtgttttatcagctttttagtattaaagttctgacttgggatcaatttcctccaaccctacaataaatctcagtttatctttaattttaaaagagaatgttgttttctttttctgttaagcctccctgttaagtaatagcagcaagtttagtttggccatgaatatcttctagagattgtatcggggtactgataaacacatttrtagctcagggatactgcatcagccatattttaaaatgggactaacagtttaaaaactataaatattcacagtgttaagaaacaatctcaagatgcattaagaaaaaggaaggtgcaaaacagaaaaacaaacgtaaacgtgtgtgcatatgcatgcttatatagtcacatattcttgtatgtgtacaaaaaatacacactggatctctgcaagcatagccaagcaactggaaatatgtttttaaaaacttgcttttcattctrtctcttctagtactgttttgatgctctttgaaaacaatctaattgctgtaacaaatgaccatacgtaggccgggtgtggtggctcatgcctgtaatcccagcacttcgggaggctgaggcaggcagatcatttgaggccagggatttgagaccagttggacaacatagggagaccctgtctttactaaaaatacaaaaattagctgggcgtagtgacgcatgcctgtaatcccagatacttgggaggcggagacatgggacttgcatgaacccaggaggcagaggttgcagtgagctgagattgcgacactgcattccaacctgggcgaccgagcaagackcggtctccaaaaaaaaaaaaaaaaaagaccatatgtaatgtttcttcattgttctaagataaatctttaaggctgttgaggttttttgtatacaaaatggagagtaagttttaatgggatgggacaaaatgaggcttacagttgagtttaatttgagttcacatcctgttgacattaagttgatttggaacaagtgatatggtccaatgcctgcttttctattgtctgtggttccatccactagtgcctgtgttacacacctcttgttcaggttttatcatttaaaataaataagaataaacagtccatagcttatcttacttactgaataaatgctctratttgacagtcatgtttcttaaagttccttacaaaggccattgcccaagaaaccaaataattccattatactatttttgaaatagaacacataataaatgggaattttaagttcagtttcttatgtaaacaataacttctatgtacatgttaaatatgcctgtatatacctaatttgaccatgtatgtatagtagaaatgaaaacagttactaagaaaatttgttattggctccaaattttctgaattaagtgtattctaatgctcagccataatatggggtttcatgtgttagtttatgtattcatggttaaaaatgtgaagactgttatatcttcatttgtgtcttttggtattatttggttgtattttattgtgtgatatggtggtataattatccttacctcccaggagtttgagagggtcttgccagttaaccgcagaattaaacatgcytaggactaattaatcaggagcaatactacaattarttggaggtaatttgaaacctggtttcaaataaccctgatattatgcacacatggtgcacacttttctagtagacatttaatgaaagtaatttaaaacctacctttgaaggatgaaaaacattgccttaaatgctctattctgtgaaagtatcaacatttatgcaaatacagtctaaattcagactttgaaaatgtattgaaagagaggatcatgaaataagttagagctgagtgacaaagctttctgagtgtttaaaagaatgttttacctaataaatatctgaaatgtatttggagccacatttgtttaaagaactgtataaatatgtagcactgttcatgtgaagttcaatagtaggaaaatgctgacagcccttgtggaactgtggttattattattttatgaatagagccaatttcaaacacctattagagtcttctcaggaacattttatagaatgcatctggagccttatgttatctctaagcattttaggatttgtcttcttggaaattcatgtaaccaaaccaccatgtgttatttcaagtgtatatagtattgggttacagtttactatgttttcagaaggttgtgacaactattagacttacagagaatgacttctctgccactaacggctttctaaagtgaatagagaggggcgaggattgaattcttcggtaaagctgggtgattttgttttattcaatacagtataataagtataaaaagtagaacctatagagagctrtaatgggggtagttttaaagaaattctgaaaatgaaaaacttaagtaaaggtttagttcattgtttatttcacactgagcatttactacctgaatgttttggacattttatttccatgactgragtggacacttttacaactcactgggttctttgctgrtctttctctagaagagcatagctgagagcaggattctgcctctcatgacaattggcatgcacttatcccaagcggtgaaagctggctgcccccttgatttggagcgagcaggcctgactccagaggttcagaagattattgctgatgttatccgaaaccctcccgtcaactcaggtgagaggcatggcctagctctgcacccttaatgacttgatgaagtaaacaagcaatccactatatttttcactgttaacagcattaatcctttatgctattatgaaaaccttacttttgtgattctttttcttgttttaggaaaacaatctttcttcccattatcactcagaggaaagtatactgagaaatttttttgttttgttttgttttttgagacagagtcttgctctcttgtctaggctggagtgcagtggcgtgatcttggctcgctgcaacctctatctcccaggttcaagtgattctcttgcctcagcttcctgagtagctgggactacaggcgtgtgccaccatgcccagctaytttttgtattttttgatagagacagggttttccatgttggctaggcaggtctcgaactcctgacctctgatgatccgcccacctcagcctcccaaagtgctgcgattacaggtgtgagccatggcacctggccaatacactgagaaatttttattttccttttcagcttaaggttacaacttccccaccatccaaaacgtgcactttcattttttttctaatttctatctcatcacttgcaaaaaccatatttttctccacattcattcccagtagcttcctgactcctagttcttccctaaatccttctgagtccttgtcattggtttcgcttgagtagcctttctaatcaacacagtcattggtatcagttactgtgacatggaagggacagaccaagttctgtgggccgctacgtagaaggatttcctgtcactttgctgcagaacctcagctcgcggagagcaagcccctttgcttgccctgtagaaatattttaaattattatcctttttttttttaacagaagtaaataggagatacgttagaggattttctctcctagatgtgtaaatacaaacttggggtcttataactcaataaatctgataaatttcttttgactgttaggatagagcagtggccataccaatagcctcatctccaaagctgcagtgaagatactttttactaccttaaagtctttcccatttgtgaacaacttgtgaacaattccccccaagaatttggaagatcactctctgaaagcacagtcaatactgtacttaaatggatctgagcaaaaataagtcacttagaagacaggattatttctagacttgagtgtgacttgactgaaggtctaaagaacaaacagctccttcacttccattgatcacggtggaagcacagggaaaggacagacacggaggcaagttggagtagtgctcatctaagttccagggatgcgggggagtggccaggggacttcaggtatagtaaataaataacctatttataagttatgtcaatgtcatgtttgaaatagaaaaccaaatactgcatgttcttacttacaagcaggagctaaagttggtgcatatggatataaaaatgagaacaggccgggcgtggtggcttgtgtctgtaatcccagcactttgggagacctagatggaaggattgcttgagctcaggagttcaagaccagcctgagcaacatagtgtgacccccatctctacaaaaaataagaaaattagccagacgtggtggcatatacctatagtctcagctacttgggagtctgagtcaggaggagtgcttgagctcaggagtttggggttataataagctgtgatcatgccactgtgctccagcctgagtgacacccagagtgagaacctgtctcaaaaggagaaaaaaaaaaaagtaacagtagacgctgggractactgaggggagggaaggaacaatggttgaaaaggtgggaagggacagtggttgaaaaactacgtgttgggtactatgctcactatctgggtgatgggatcaattgtacctcaaacctcagcatcctgcaatatactaatgttacaaacctgcccatgtactacctgaatctaaagtaaaagttataatttaaaaaaattataataaaatcagaaaataaaggtctgagatggaaaattaaaagaccaaagccacccataagcacaataaatccctccycccaaaaaattatatctattaaaaaaaggtgttgcgccaggcactgtggctcatgcctataatcctagcactttgggaggccaagacgggcagatgacttgacttgaggtcaggagttcaagaccagcctggccaacatggtgaaaccctgtctctactgaaaatacaaaaattagccagcagtggtggcatgcgcctgtaatcccagctactcaggagactgaggcaggagaatcgcttgaactggggaggcggaggttgcagtgagccgagatcatgccactgcacttcagcctgggtgacagagtgagactctgtctcaaaaaaaaaaaaaaaaaaagaccttgtaccctgacaagttttagtttgtgcaggaatgacacaatctagaatgactcaagattggaaaaatctttaaatgttaattacacaataagggtaaaaggagaaaaattacctaatgtcatctgagcaacaagaagaagaaatgaaaggcattaaaaattgggaaaaatttatatttgacagtatcttaacaacgaattctgcttctatatcacttcctagctttctgatgataacttcccgtgcagatctgtatgtaaggaatggacgtagtagtcatgctaatctgagtatttatctgtgtgatacttacgaattaacgatgtaagttaataagttagcatttcgtgaacctggttaataccatttgctaaggttaaattagccaaatcctgaagtaagctgtaaaacatccaaggtagggtagagaggcatcttatgagaaagctggccaactctcctggtcaccttctaatcttcctaacttcagaaatcaaggcagagagaggaaaatagtaattactttgtaggattagatttatggttgtcgaaacctttgtttctccagtgcagaatgagatagcgttttagggaaagccaaagactcagatgtcttcttcatgctcatcgtgtggaatttttcttcctttagaaatgtattgtctctcagggcttaaagcaatttgcatctttcgatgagacattgagtaataggcaatattctctgaaataatttgtgcaggctgggcacagtggctcacacctgtaatcccagcactttgggaggccgaggcgggcaggtcactgaggtcaggtgttggagacgagcctgaccaacatggtgaaaccccgtctctactaaaaataccaaaattagctgggcttggtggcacacacctgtaatcccagctacttgggaggctgaggcaggagaattgcttgaacccccatggraggtggaggttgtggtgagccaagattgtgtcattgtactacagtctggacaacagagtgagactctgtctcaaaaaaaaaaaaatagaatttgtgcagttccccccacccccttttttttttctgttggcatttttgctatcatttagctgccttctttatatcctgaaacttacaggtggtgttggtctagtcagtaagagcaaaggctttgggaatagatagatctgtatttagaccttggctctagcatctcattgttatgtgacctccatcaagtgacctaatttccctaatattcaatttcctcatctctaagacagggagttaatattgcctctcttatagaattgtgagaaatatagtcatgtgtcgcttgatgatggggatgaattctgagaaatgtgttgttgggcgatttcattttgtgggaacctcacagggtggacttaaacaaacctagatggtatggcctactacacacctaggctgtacggtatagctcctgtcttcaaacctgtacagcatgtgactttactgaacactgtaggcaattataacacagtggtatttgtatatataaacatagtgaaacatagaaaaggcccagtagaaatacagtgtaaaagattttttaaaaaagctgggcatggtggctcacgcctgtaatcccagcactttgggaggccgaggcaggcagatcacttgaggtcaggagttcaagaccagcctggccaacatgatgaaactccgtttctactaaaagtacaaaaattagctgggcgtggtgttgggtgcctgtaatcccagctaytcaggaggctgaggcaggagaattgcttgaacccaggaggtggaggttgcagtgagtcaagattgtgccactgcacttcagcctgggagacagagcgagactctgtctcaaaaaaaaaaaaaaaaaaaagagataaaaaggtacatctgtacagggcacttaccacgaatggagcttgcaccctgggagttgctctgggtaagtcagtgagtgagcggtgagtgaatgtgaagacctaggactgtgcactgctgtagactttataaaccctgtgcacttaggccacactcacccctgtgatacgagtctacctactgtataacgtacctgcatatgtacccttgaaactaaaataaaagttaaaaaatttatcttcttttgccaataataaattaaccttagcttactgtaatgattyttctttatgaattaaaatctttttactcttttgtaataacacttggcttaaaacacaaacatattgtacagctatacaaatatattttctttatatccttcttctctaagattttttctgtttttgattttgttaaatttgtttttactttttacattttttttgttaaaaaccaagacaaaaacccacacatcagcctaggcctacatgggctcaggatcatcagtctcactatcttccacctccacatcttgtcccaccaggtcttcaggggcagtcatatgcatggggctgtcatctcctgtgataacaatgccttcttctggacacctccagaagggcctgcgtgttttacagtgaacttctaaaaaataataaaatgtatagtatagcaaacacataaacatagtaacatagtcatttattatcattttcaagtattatatactgtacataattgtacatgctagacttttacacagctggcagcaaggtgartttgtttacaccattaccaccacaaacacatgggtgatgctttgcattgtgatgttacgatggcatgatgtcactaggtggtaggaacttttcagctccatgataatctaatggatacttgttcctgttggctgcccgtcgttgactgcaacatcattatgtggtgcatgactgtaaattagatactgttcagaaagctttggcacactggtaatagcaaatggtggtggcaaatatgatgatgatgatgatgatgattgaagacatagatggtaaaattttatggtgtcttaaaagtaccctctaaatatgattatttttatagtctgtccttttgaataggcacttaagaatgtatgaacttaataagtatataagaaagaatgttccccaaaatatatcttacagaggcatacaatttaagaattcaaacaggttgtaatggggtgtgtgtgtgtgtgcacacgcgcacgcatgcgtgctcattcacactaaagaattcttgggcatatgttcctgaatgtcctaaatggacattctaacatcacttcattatgggcagagggaaatggtaaagaaaaatttcatattatattattcagccacatattgacagcatctgttttatttgcctatggtaaagaattgaagcactgttaatttgctttttaaatcatgtaggcacaaagttatcgaactttagatttagaaatgaaactggaaatcattacactttccctttcctatccccaccctgttttggagagaaagagtgtgaggcttagagagttataaaactgttttaataccatgtctaagattaataactgaacaagtttctctttttactcgtgttaaagttgtactgccaattaacttaaaagaaagaaatatgcaatttctaatcctgatataggatatgggtatataaactctaacttgatgagtgaaacaaattaacttatttataatcagtttcatatctttatttattgagtgtctttaaataccccttacctttaaagtaagaaatattaaaatcaagcagaatataataatgaaaaattcttaagatatacttactaaaaacttatcsttcggttaatacactgtatgtaggttgtacatacaatatgaaaaagtatatttttgtagcctacttttaaatccagaatagaggaggttaagaaggttgtgataaccatgagctctttttttttttttttgrgacaaggtcttactctgtttcccaggctggagtgccgtggcacaatcatagcttactgcagccttgaactcttgggctcaagcaagccttccacttcagccttccaagtagctgggaccacacctggctaatttttaagtatttttgtagagatgagttctcactacattgcccaggctagtcttgaacccctagccttaagcgatcctcccacctcagcctgcctaagtgctgggattacaggtgtgagccactgagcccagccctcttttatttcttttgatagtacactcataatcattaaactatcatttctggatgtgagattgtgcttttggattcttattttttctttataaaatactttttgttctcttactggagaaaacattgttggattataaatgatataacaaggaatgaggatatacatactataataacgattcagatatgttattttcatattttatttaactgtagccatgccacaataatttagagttttaaagaacaagtttgattgaaatctaaactttgtacaatcctgaattgagaagtttcctgtattttattatgacacaatatttacctaaaaatagrgtaattatgaattgagaaaacatagctattaatttcatactcttatttgttaagtagattttgtctggaaaactgttcatatttaaaggagctttgtacctttgtattctttttgtttttccttgtttatataattttaaactctgtttatggatttgggattctaactatgctaaataataaattaaggcattgaatgaagtacctagacagtattttgattaattttattcccccattcttaatgtgcatgtaactggaaaattaagagtggcttccaagggatctactacaaaagtaaggttaatatgatctcttttaaaacactgaaggcgtgtagccagtgttgtcattaattctgcagtagatattttcagcacttatttacatgggaagttagagcagagtaagatgcacctgtaaagctaaatgccacttatttgcatatatataaaacgcaggatgaatttaccatagaaatataaagggtacttatagaaatgtattagaaaaatatatgaatttttaacttatatctagaagttaactttatacatttaactttaaatcattaatagtggtttaacaccataagcggatgtttatgcatcatcattttatgaacaaaagacattctaattttagaaataaagtgattcaaaagagaataaaatatcttactttttcttttaaaattaatttgtttagcgcattacatgataatagctcaagcttgtgtgatttttccctaaaaaattggtttataaatattacatttatagtatgaagaaattaatcatacatagtttatttatctaatttctaaatacccatggaagaaaatgaatttaatggaatgtagttgtgtattacttggtttcgagtgtgggaaaatttatatggtctttctaaaacagcactgtcagtagaaatacaatgtgagctacatatgcaattttaaattttctagtagccacattttaaaaagtaaatggatgcaatttattttgataatataatttaattagtctactatatttaaaattttatcatttcaacatgtaatcaatatgaaaattattaatgagatattttacatacttttttctgtaataagcctttgtaatcaggtatgtactttatatatacaacaaatcttctgatgctaaattttaactggaaatacttgatctgtgtttagcttttgtaaaatttactgttgaacaacgtggactaatgtgcctaagtggttccaaacatattttaaaatttgaagacaaataaaagggaactcaaagtaaattgggatacatacatacaacagaatactgagccattaaaaaatgatgaaatagtaaaattgggggaattttgatgatactaggatgatataatgaccaagagacaaatacaattttagtttggttgagagatgtgatcatcacgttgctgattttactatgtatagaggttatcttttcctttctaagattttgaaactttaattagttaacccacttacctagtttctattagctgtgtaactttctcttcctgttttttgttttgttttgttttgttttttgctttttaactgcagtattttgaggagtcttggagtagcaagctaatctttggaagaaaggaaaatataaacctgaaaactaayaatttaaagaacgtcttttcaggttrtcatttgaaaaatacttgatttctgatcactgatttgaattgagtgtcaaatatttgatatgttttgtaaattaggtgaagatgagtgagtaggttctaaactgcttgggtttaccgcactctggagcattgcagragaatgtgatgttggaaggaagtgctgaaacataattattggcttgcctataggagggtgctacataattttagaaggtgtcaagaaaktgacacagtctgaattagttctgttgagttgcaaaaaatgtaaagtttcttgattctgaaaataagaaatatgttcccagaaatctcatctagttaatgtgcttttaaaatcattgatgtctcttgttattacaataatagccattgaaagaatcttttttattagaatgttatttacaggtacgattagcttctatttaaataaattatttttatacttgatcttaggcaaaaggccaacaagtgatcagaataaattattttaagagaaaactaattataattgatatttggaattggaagcacaatttcctttagaacaattccacgaatggttgttttgattctcaaggcagcccacaaaagacagtttgaaacacaatttatgcagtgtcaatagtactgacctgactttggatcttggaggcaggggcttcaggtgatacccgagtggagtttttactccatttccattccgtaaggctataggcatttgaaagaggaaacttttctttggcaaccttccaccttyctttctacagaatatttcagtatttctagctcataggttttctaaaatattctctgtaatttattttgaaatggagtttttttatcgtttacagatatgagtaaaattagcctaatcagaatgttagttcctgaaaacattgacacgtaccttatccacatggcaattgagatccttaaacatggtcctgacagyggacttcaaccttcaygtgatgtcaacaaaaggagatgttttcccggttctgaagagatctgttcaagttctaagagaagcaaggaagaagtaggcatcaatactgaggtattaattatatatagaattttcataaagtgtcagtttgttcaatttgcatatcctagtactagaatgctgtatttttttgaactgttatgaattctgatatgattactttctctatgtgctacatttcctttgcttttcataaatatgatctgagaaaagtgattaaaaaaaagacagtaaaagggaggtttagtccatctgtttagcttattatgtagaatgtcagcttaaattttacctgtacctcatattgaccgtatagcctggaaaatctttcggaggtatagttaatggatttaagcatatggcagtttatgtagttaatgaaagtgaaaacaaattgtattataaatacctcccaaactggtttattatcattctatcattcttcatgctctgttagtatgatattgaatatctgaggtaccaggattattgttgcttgtggctctgagcatttcgtagtgcttttgcatgatgagagaaagattacaaatttagtattatgttagatggtacgttttattaaaatcaaatgcttcaaaaataattgctctgtgtatggcatgagataaatagcaatcagatatattrtttaataatatgactctattaaatgatggcataaatttgaaaatttgaccttcggtatcttccgggtctaaaattatatgactccattataaatattttggaaatgattaactaaaaaattgtttcaattcttagttggtaaattcaatgtggtagtaggtggtggtgattattttgtattagagaattaggaattacacttagttctaaggtaatctttataggatgtccagcaattaaacccctacttttttgaattgcttaaaaataagggaactgatctttttaaattctgtacttgagttacgtctgtatatatagtcatgtcctagataatctaatggaacttaattagttggaaatctttatattgtttataactgaactagctataagaggaacattaaagaaaacatattttgagtggaggtaatgaaatttagcttctaatgctcagccttttatttctgtaatctataccagatacctaagaccctcttattgtttcccagcttcaacctgtcagtatagaaaacggtgtaacttactattttttctcaatattgaagcacatttgtagtgaaatattattttaactatatattgccatttttgctttttccctatttcagtaacatttttcgctatttcagtaacattacatgtcaacaagagaatggtgggtattttggggggggttgggtgggragaaattttactaagcttgctagattctaaaaggtataccttatttggccccttttccccatttaggggaacaagggtgttggggctgggaagtagataagaggtgagtaagtcatccaaagcatatgtcttcattagcctccctgtatgaaaagctgatttctgtagagtgttggaggcctactttcagaatctgtcatatgttaacattcatcttctctactgacctgatttatatcccttagtctatttcattttataattatgacaaaggataaagtcattagaacaaattctttttattagttgacgtattgttgtgtttatatctcttgtgtttgttattaagatggaagctcaatcatgtccttgtttaacagaaaggtgatgtcttggcattgataattctgattcaatatccataggtacatggtggattctttaaatatttagtattcttttatttctggaaagttttcttaaatgatagtttttttaaaatttcatttctataaagttttcttaaatcatactttttagtgttttattccattacttcatatttcttcttcaggaactcctgctatacatgtatgttggatcttcattacccagcttcaatatttttcacttttcatgcattctttttatttcttcatttctctttaaatttttttcttccttttcaccttctatttctcttttaacataattgtatttatttctgtattccacatagcttagtattcacttattttaaaattattttaaaacgttttttagatttaaaaattctttttttatttatatatacatattttatttttaccaaaggagcaacactattaactgaagacttctataatttttttcttttatttctgattctttcttcggttttccccctcagttttgaacttttctaattttgatttgtgatgtccttttgtattttagataattttcctaatgttttccagctcatttggaaaggctacagttttattctgtacctaagcaagtctttctggtgtcaaagatttgaccttgatacttttcttttgctcattttcgtatgagattagttttcctgtactttcaaaagaaggcgtggttcaagatggctttcccaatttcacatctgtctctaatgtttttgtgtaatgtctaaaatatggaaacttggtttatgagatctactctgccatttttatctgggctttctcttccttttgtctctgttgtacctgtcctgcttggttytgatttaaccccagtggtttctcctgaatgtggagccttctcctagaaggcagcctcggctagtcccagggttcagagtagccagctgctctcttcacctaagagaccactgtggattccttgtactcacttgctattggcttggacaaaagccctcccattttcagatgctattatcagattaatctctcattaatctgtctttccagtgtatgcctgtgggctatcttggggttctcttgttatcagacacctccctgctggcctctgctttctcccgtacagatgtcagtactgtgcaggtcttaattgctgttggtggtttgcccctacattcttacagttttagtttcccaaggatacctttaaacttggttttattgtaaatgtcgacaatggattttgggttttactatctagttctgtcttaattctggaattcagaaagattaaaagctctgttgttgcagctgctgccacctcttcccagtaccctctcctcctatgtcatttttttcttcttatttttcttgactgtataagagagaatgtatgacatttcctgcttgaccgctgagtttgattataaattaaawtacacaatattttatacaaattgttttgtagaagatttatttacagatgctcattcacaggtaaaattgacttatgaaaatagttttcatgacaaatgtatcaggctcggtaactaaatatatggattgatcttgtttataaatgaaattaaatgtgaatgtaacttacatatttctgtatttgcttacatccgtatgtacacatataatcagcaaatgagttgatgtttcctattcgtaacttaatggtaatagcttggtaacagagttgggagtattaaaaagatgtaaagagccccttaaaattttgttgctgggaattttagtgttctactgatgaaggaaatagacactggaaggygttgtttctattaggtaacttagatatcatactgaagacttcaaatacttattgttgacactcaaaagacacacttagtgtaagtaagcatttccccgcttttcccaatgaaataagatcattattataattccattataaatgctgatgatcatatttatagaaatatagaagataagacttgaaatgatattcgctaccaattaatgagtttgaagaagaaatcaggatgtgttttgctattttacatttattcttatttaactccaaagaattcagtgatgttatgtactattatttccatttctctgtgaagacgttgaagcttaagtaacacgcataataaggtcatacatttagcaagtggctcaattaaagttcaaacctggttctgcctggtttcaaagtctgtgctactccatggtattaggctacaacatgacttagggtttcttcctctgctctattgctgttcagatgtactcctcttttggcagagtgggagaaaatttttgcaatctatgcatctgacaaaggcccaatatccagaatctacaaggaacctaaacaaatttacaagaaaaaaaaaaaaacattaaaaagtgggcaaaggacttgatcagacacatctcaaaagaagacatttatgtagccaacaaacatatgaagaaaagctcaacatcactgatcattagaaagatgcaaaatgccttttctgtatgccaccttatatccccagtatttattatttctaagtcatagtatcttacagtgtatataagtctcatccgttcttttgattttctcttccctgcttgcaattgggtacctaggaacaaagttgcaatcttagccagttttttctttagcctttgctgatgtgtgaaaagcccttttttctaccctggatttctgtacttaagctggaacagctaagtttttaccttttttaaatataaagtttcagagtcttctgccaaggatcttttgctgttttcctactgttaaatatttcaaagccttttttaaacatagggaatataatcaaacatagcaagcagctgatgaacaatatctagatagtcttcattattgaaatggaataaatggtatttttgtattttaggctaacagacaccttgtaccttagataaggccaaccttctcataaaatccctcagttacttttattaataataaccaaattaactctggattccagggtgtactcatgatggaatgatttctctgtcatgttatcctgaggatctagtactctgagataacataagtgtatgacactttaggcttatgaaacacttagctacttaaattatttaattttttttcatgtgcagatggtattgtacccaaacactacctttgtgtgtgtgtgtgtgtgygcctgtgtgtgtgtttttgagacagggtcttactctgctcaggctggagtgcagtggcgtgattatagctcactacagccttgacctcctgggctccagtgatcctgccaaagtgttgggattgcaggcgtgagccacctcacccagccttaaattatttttttttcaaggatgtttaacctgagggttagaggctctttggcacgtgagctgctgaaatgtgtgtgaaagtgttgtgcacgtgtatgttcctctttttttctgggaagtggatctgtagtgattcttagatgagtctatgagacaagaaacttttatttttttcatttatttagcgaatgtttgttaagcgtactatgccttggccactctacagggtgctgattggaccagtctgtctacctaccgttgtagatgttagaagctatattcttttcacatgcctaatataactctttgtgtatgtatacatgcccaggcatgttccttcctcagaacattaaattcaccattttggtcaactcaaagcaagtacaccatgggacacagatctgaaataatgtccagatttttacttactgaatgaggtgtgttgagtgtataagactacatgatgagatggcaagtaattgcctgaagaaatgatgtagtgattttgtgtgtcttatatttatttactttttgatccagaaataaattatatagataccactattttgtttggatgggggagaaaggatgggtgtgtattcaggaacttatgttacttttttgcaactaataccccttctcagtagtacaaagatttgatttctttttctttctatttcctacagacttcatctgcagagagaaagagacgattacctgtgtggtttgccaaaggaagtgataccagcaagaaattaatggacaaaacgaaaasgggaggtctttttagttaagctggcaattaccagaacaattatgtttcttgctgtattataagaggatagctatattttatttctgaagagtaaggagtagtattttggcttaaaaatcattctaattacaaagttcactgtttattgaagaactggcatcttaaatcagccttccgcaattcatgtagtttctgggtcttctgggagcctacgtgagtacatcacctaacagaatattaaattagacttcctgtaagattgctttaagaaactgttactgtcctgttttctaatctctttattaaaacagtgtatttggaaaatgttatgtgctctgatttgatatagataacagattagtagttacatggtaattatgtgatataaaatattcatatattatcaaaattctgttttgtaaatgtaagaaagcatagttattttacaaattgtttttactgtcttttgaagaagttcttaaatacgttgttaaatggtattagttgaccagggcagtgaaaatgaaaccgcattttgggtgccattaaatagggaaaaaacatgtaaaaaatgtaaaatggagaccaattgcactaggcaagtgtatattttgtattttatatacaatttctattatttttcaagtaataaaacaatgtttttcatactgaatattatatatatattttttagctttcatttacttaattattttaagtacctttatttttccaggatgtcagaatttgattctaatctctcttatgtagcacatgtgacttaatttaaaacctatactgtgacacagagttgggtaaacgatgattatttaactttaagcagttcaccatccatttcaaagcctttgattggcttttttgtaaataaaaataacttgttaagaaacaaatatatctgtcatagaagaactagaaaatccagggaagtgagaaaaatgaaaataaaaatcattcatagttttactagtagctaatcacagtcaacctcttttgtgtatcccaccagacttttttatattcatttgtttttagktaaaatataaaagtctcgtatattcccatttttctgcattgcattachagaaggtagtggcgcctattaaatatgtgatatgttgttgtccagccatggcttctgcatttgcatgcttttgtgtgtgcatctgcaataccctgtgaatatcctgtgtgatggagtggcaagtacgcacagacacgtctgctgcatgcctaggtacgaggctgtctccaggagaagcacttgtttgattatttgagttgccaattgaatttgctgctttttttcatggcttgccattttcactgaaaagaatgactaatgaaaaacgatgattggttattagatttggatgtttggcagacattttctcaaaattgaactaagttggcctcttcacggaaaacaactggtatttgttgtgccaatgataaaattggagatttctagcaaaatgtataattttggaaaagttgtgttcctccactggaagcttgacagctttccttaacataaagacttctctttctcttcgctttcactactactactactaattcttcttctgattcttcttcttctccttcttccttcttccttccttcctcctcctcctccttcttcttcctcttcctcttcttctttctctctttccttccttcccttccctttcccttccttccttccttccttcctgcccgtccgaccgccctgccttccttccttccttcctccctccctccctccctccctcctttctttttctttctctttctttctttctttctctctctctctctctttctttctttttctttctctttttctttctttcaagcagtcctcccgcctcagtcccccaaaatagtgggattataggtgtgagccaccatgcacagccttacataaagccttttctaatgagatggatagtaattaacaaatgtgagtttttgatattatataaagattttttctgtgtttcgaagatccgtataactcagtgaatcagtatgttctggatgactaatatgtgatgttaagaaatcatgactgaggccgggcgcggtggctcacgcctgtaatcccagcactttgggaggccgaggcgggcggatcacgagatcaggagatcgagaccaccctggccaacatggtgaaaccccgtctctactaaaaatacaaaaattagctgggtgtgttggtgcgtgcctataatcccagctactcgggaggctgaggcaggagaatcgcttgaactcaggaggcggagattgcagtgagctgagactgcgccactgcaccccagcctggcgacagagcaagactccgtctcaaaaataaaaaaagaaatcatgactgggtaaaagatctgttcagagtacaagatggaccaatggatttgatatatttgaatataacagagtatgaaaaagtttattgatatagtttcagattacacactgcaactaatctttaagaaactattacttgtccactttttggtaaaatttcagagaacaatgtccaccattatctgaacaggctattaaaatactcttctcttttccaactacgtgcctgtgcaaagtcagatttttttcatatacttcagccaaaacagcatatcaaaatggattgaatgcagaagtagatctgagaatacagccacttttgttaagccagacaatgagatttgcaaaatgtaaacaatgctgctgttctcagtttttaaaaatatgttttttaaaagtatttatgttaatgtgtacttggtttactactgctatttttaaataaaacaagaaacatttttaaatgtctgttttaatttctaaagtggtagtgatagatataacccatattaataaaagctctttggggtcctcagtgatttttttttaagagtatggaagggttctcagacctaagagattgagaaatgctgatgtaatgttttattataaaggtgtaccatgaattatgtaccttacttcatattgttggacattaaagttgctttcagtttttttgttttaaacagcactgctttgaccttttttaaaaaatgagtcagggtcttgctgtgttgcccaggttggagtgcagtggctattcacagacatgatcatagcatgctatagccttgaattcctgggctcatgtgatacttctgcttcagcctcctgagtagctgggactataggcgtgcaccactatgcccagctgctttgaatattcttgaaatgaaatatggtatagtctcataccatatcatagccagagggggagagagagaattttgttgttgttgttatgttatctgtagtggactttatgccttcccagcataaattctctctttccccatttttcgtgacccttgatttttgttggggttcgttccaaggagaataatttccatctggatattggattggcacctgtgacctcttctgagctagaccctagtaacagcgtttggatctggggtaggtgtgtggccaactgagctgctggttcatgcctttcctgaaatgagccctacctctgaatatttcagaaacatgggacattaacttccctttacttacgttaaacccctttgaatgaggagttgtttttcacttccagttgtgttcagttgtcacagaagcacagcgatgtgattggtggaaggacccgtcaacagacccagaagatgtaaagtgtttttaatctcaaaggatgtggaatctcagagatagttacaccgagtagaggatgaagcggctcctggatggaggcagaggcttcctggatcttcaagttctgtatgggttgttgtatgaggttggtgcaaaagtgaggcaggagaatagggtctggaggcaaggaaactaaggccgattcacactgacttcctagaactaaatcaaaaggaaaaccccaattttccagacctaaataacaaaagtaccagatggctcctccctttcaactgcccctcccccacacctttctgcgtgacacatggaaaattgaaagtatctctggttgcttctgcgtaggaatgtaactttgtaaccaatcagacggatcgcaggccaagtcgcctgcatagaaatgtaactttgtaacttcactttagcctctgattggttgctttccacaaccaatcagatgcttgcatagggtgtacctgttgtgacttcacaaagtggtggaagtggtggaagtggtggaagggtggaagggctatttaaatttttattcatcctctgattggttgtttcacttaagcctctaattggttcttgagtcctggagcctgtgaagggtactttattttcagtaaatgcatgctttttttgcttcattctttccttgctttgtgcattttgttcagttcttagttcaagacaccaagagcctggacaccctccactggtaacaaaagtaactggtgtttttgccattagaagtaatggcacagaacaagtacatgagagcgatttcttatggaaaattaaatggcgcataagtcgtgtgctcaggtaagggagctgggaaccggtagaggaaggtctccaacccacacccgtgggatctctgagtctttgaaagtccgtcctcaccctttgtgaagaatgggagcacggctggactcgtcaccgggggttttggggggctgaacttgtcatttgagggtgtagggaggttggatgaatcgcaggggtgcagggagggggcccactggagctccaccaggaccccagcaccctagatccaaacctggtcatgcttcccatgctcagaggcaaatctccctccccttggggggcggagtcagacgagaccccctctccatccttttccaggtccggtgggggcgggactttaaaggtaaaaacagcaattacttttgcaccaacttatcttctaagtttcgctccctaccacctgagtgtgtttggaggctctggctcattgtacctgcctgatcaccaggtgcaagtagctgggccagaaggacctcggcacgttacggaatatttactacaggaacaggtgagctgaaggcgaattccccaggtgtagcctgtgaccatagattcagacaaagccctgactgttgcctggaattcaaaaaagctgtagccctaccagatagaataagaaaagaatataggattcttcctattcaaataggttgcatataattaagagcatgaacgatccaatggaatgaactcaaagtagtttttgagtgtaatagacttgaagtgtcttatggaaaagaattgcaaaaccacagaaacagtgaagaaggttagttatagccttgatggggtagctgacttcagcagtctcagctatctgaaaagttatttaccagattttggttgggaacataatccctaaatcatttgagataatgtacttgtttccttactgggtaaatgtgtttaaaccttgagaaaatgtagacataagtagaatatagaataaattaaacctttggtagttatgttttaggattaaggactaataagtacatatttgatatttaagcatttgtaatgcttgagataatttatcctactcaagtaacagattactcttgtgactccaatgtaaaatatatcattgaaaaattagtatctgcttgtgatttttaagtagaaaccctgccatttgaaaggtatttgcctttattattggagatatttcatatgaatgtttaactttgttattgcatagaagtatttaaacagatttcacttgcaagagaaagatatctaataggttactcttaatcagtactaaattactacaattactatattctattaatatcgattcattaaaacccagagctttaattatgtctcagaaaattaattaaactttagcctcataatcagctttattttctaactcaatgtttaaaaattgacaagtatgtattatacttatttatgtcttcattcagtaaacatttgcatttgtagcatgcaagacaacatgctagacacacgaaagatggaataaatggaagaaaatgcaacacagatctcatgcttaagagggacagatttactctgaagattcaatgaaaaaacatccacaaacaacttttctacaagaaacaaaacattttaaagaaaacatttacttcagccgggcgcggtggcttacgcctgtaatcccagcactttgggagggcgaggtgggtgcatcacgaggtcagaagttcgaaaccagactggccagtatggtgaaactgtgtctctactaaaaatacaaaaattagcctggcgtggtggtgtgtgcctgtgatcccagctactcaggaggctgaggcaggagaatcgcttgaacctgggaggcagaggttgcagtgagctgagatcaggccattgtgctccagcctgggcaacagagcgagactccgactcaaaaaaaaaaaaaagaaaaaaaaaaagaaaacatttacttcacataataagatatgagaaaaaatggactctctgaatgaaaaaaagaggagatcatgtgaaagatttgcgctttttttttttttaaagttatggactgaaacactcctaatcattaacatttgttattttaggggagtggaattggaaaggtggaaagggctatttacatttttataatctccatgtcttttaaatcaatatatattgcatttattcttttagttaaaattttaagaactctataaaaaatagagacagggactccctttgttacccaggctggtctcaaactcctgggattaagtgatcctcccacctcaattagaagggtggaagggccagctgtttaagtttctataatctctgttaaatcaaatgtatattgcatttattattttaaattttaaaaacttttttaaaaatagagatgggatcttcctatgttgtccaggctggttgtgagctcctaggatcaagtgattctcccgccttgacctttcaaagagctgggattacaggcatgagccaccatgcccagcctatttatttgtttatttatttttagaggcagggtctcactctcactagactgaagtgcagtggtgtgatcatagctcactgcagtctcaaactcctggactcaagcaatcaactagcctcagcctctgagtactgagatgacaggcatgtgccttcatacccagctaatatttttgtagagatggggtcttcctgtgttgcccggaagagtctcaaactcttggcctcagcctcccaaagcactgggattgcaggcatgagccacaacacatggccctgcttttaaaaaatatatagtgggccaggctttctgggatgatgggcaaccattacatttgctttctctccattctgaatgtcagcctccatacacctctm

SEQ ID NO: 17562 - DNA, 16220 bp, Homo sapiens
tgaacccaggaggcagaggttgaagtgagccgagatcgcactactgcactccagcctgggtgatagagcgagactccgtctcaaaaaaaaaaaaaagaggtagccgggtatggtggctctcgcctgtaattccagcactttggcaggcagagtgaggtgggaggctcacttgagtccaggagttggataccagcctggtctggtatcaaagggagacccggtttctacaaaaaattttaaaattagccaggcatggtggtgcatgcctgtggtcccagctactccggaggctcatgtgggaggatcgcttgagcccagcaggtcaaggctgcagtgaaccatgatcgtgccactccagcctggacaacagagcaagaccctgtctcaaaaaaaaaaaaaaaaaaaaaagagagagagacagaagacagatatttttaaatgctcttctaaacacacacacacacaaacacacgcacacaattggctatagaattgccagtttgcaactcccctgactttacacgttgttttccctgtgacgtcttacctacttccagtttcaattaccagctacaactcggacctctcagattctggacattagtccagacctttcccaatctcagtccccacatgcccctcggtccccctaggccgctcatatgcacagattcccacattgcactcagcgacatttcccaaacctgcttgccctcctgagctctccatctcagggacagccccactgtgtcccagtcagcagaccatacgtcccggagccatccaccgatggcggcaccccctctctccctcatcaccctcatcaagccccaagctctgccttcctgccccctgagtctttgccccatgccctcctctctgtgtcccgaaagccctgacctggctcaggccactacccctcccgctcagacgctctctacagcctcctcccgagctcctgttcatcctctcccagccccagaaagtttttccacacccagagccaaccccactgctgcggtgatgccccagctcccaaggacaagatcccagccccttagggtggcctctgacaccctgcaagctctggccctgccctcctctgcagcctcttctctcatgacagtgctccctgcaccctgaactttgattcatattcaagccaaaccatatggtccttagcaaggactttgcacatgctgttcaaatcacttttttctttctttctttctttttttttttttttttgagatggagtcttgctctgtcacccaggctggagtgcagtgatgtgatctctgctcatagtagcctccgtctcccaggtttaagtgattctcctgcctcctgagtagctgggattacaggcatgcgccaatacgcccagttaatttttgtatttttagtagagatagggttgcaccatgttagccaagctggtctcgaactcctgacttaggtgatccacccgcctcggcctcccagattgttgggatgacaggcgtgagccaccatgcccggccccaaatcgctttccatgggcctctctccagctcactttcaaatgtcacctcactagccactcttcctccctccagaaaccattagtgacattttgtgtcccctcccagtcttaagcaaacacctcctcccagctctcacagagcccagtggctcgtctttgggagctgcaaccccttgccttactataattatcttctgcgtttcttcctcctcaggccagaccagagtttcctaaattgtcttgaccacactgacctatcagtaaaaaggttttgagcactcacgtccaacaagcgcatatctgtttatttatccatcatttacaagccatactgcactaatatatagtcataacaaaatacacactgaagtaggaatgtggatacttcccgcaccccaaaaactgtcttgaaaaacaactagagggctgggcgcggtggctcacacctgtaatcccagtactttggaaagccaaggcaggtgcattgcctgagatcaagagttcaagaccaacctgggcaacagggtgaaatcccgtctctactaaaatacaaaaaattagctgggcatggtggtaggcacctgtaatcccagctactagggaggctgaggcatgagaactgcttgaacccaggaggtggatgttgcagtgagctgatatcgcaacactgcactccagcctgggcgacagagccagactctgtctcaaaaaaacaaaaaacaaaaaactagaaagcctgggccaggtgcggtggctcacacctgtaatcctagcgctttgggaggccgaggccggcggatcatgaggtcaggagatcgagaccatctggctaacacggtgcaaccccgtctctactaaaaaaaaaatacaaaaaattggcccagcgcgatggctcacgcctgtaatcccagtactttgaggggctgaggcgggcggatcacaaggtcaggagatcgagatcatcctggccaacacggtgaaaccccgtctctactaaaatacaaaaaattagccgggcgtggtggcgggcgcctgtagtcccagctactcgggaggctgaggcaggaamacggcgtgaacccgggaggcggagcttgcagtgagccgagatcgcgccactgcactccagcctgggggacagagcgagacaccgtctcaaaaaaaaaaaaaaaaaaaaaactagaaagcctggatccgcttgagaggccgtcactgaagggcgggagctcctcgcggacgcacacaccctatctagctcaattggtgtccccggccaccaagacagggcccgcccgcggtaataattgccacctcccagtgggagctgcagatatttcccagcgtcctgtgctgggcgctgtgccaggaatatcacaagcattaacttgtttaattctcataataaccccaggagatcaagcctcttttgatgctcagatgagaaacgggacccagagaggtgaaatgatttgcccgaagccacacagcacgtgtcccaggggaaattggaaccctggcagggccgttgaattaggctaaagggaccttgggagcgctgagtgagggtttcttgcatggatggatgaatgaatgaatgaatgaatgaatgaatgaaacagaaatacccaaaagggaaagacagagacacagaaagtgacacgaagagacagaagcacatagaagagacatcggggaggaaagaagcagaaccgagccctggagcgtctacactgaccctgagcgggagaatggcgaatggggaatgaggggtgtctacacagacccaaacgctcctagagggagagcgtcggcaaggaacgcccttgggaaggtccccgagtccaggaatggggaaggagcagggctggggcgtggccatccgcgggcggggtcagcgggccgcggaccctctggggtcagtccaggggcgaactcctcaccccggatctgtggagtcaactatgaacgtcgtgcaggtcttcttcttgaagatcttggggatccagctctggggacaggaacaaatgtaggggtggaagtggggtgagagggcacccagttctgtcctatgggacacagagccacccaccccgtgcgctccccacggacacaggagtccgggcccccagcgccctcccgctccagactcaggagtctcgacccccatgccctggaccctggaacctggaccctcccatccccctcctccgtctgacccaggaatctgggtgtccagcgccctcctctctgggagcctggaggcgaggtccccagctccgcgctcccgcagaccctggtccggcgctcacctgctccttctccggcaccaccatgctgccgcggccgccgcaacctcctgcagcccagggccccggcgctccctccgccggctctgcttccagacccgcccagagcaaaccggatcctccactttccagcctagcctggggcggggcgaggtctggggggcggggagtcttggagacgccaaagcgggaggcggggagagggcgggtcccaggccgcgataaggggacagagggacagcgacctggggggtgcagaggcccgggccggggggagagagacacacaggggagactccaagggcaagcgcgagatgggaacagaaggagttgggggccagtggcggagagggaacagactcagaaaggaggatgccagacagggaggggacaatttaacccaaagagggggagacaaagacttaggggacagagaatcagaaggtggggcagcagggacccagggatagacagagagagagggggacagagacccacagagagagggggacagagacccagggagaggggacagagacccagagagagtgggacagagacccagagagagtgggacagagacccacagagagagggggacagagacccagggagaggaggacagagacccagagagggggggacagagacccagagagggggggacagagacccagggagggggggacagagacccagggagaggggacagagacccacggagagggggacagagacccagggagaggggacagagacccagagagagggggacagagacccagagagagggggacagagacccagagagacggggacagagacccagagagagggggacagagacccagagagaggggaacagagacccagagagagaggaggacagagacccagagagagggggacagagacccagagagacggggacagagacccagagagagggggacagagacccagagagaggggaacagagacccagagagagagggggacagagacccacagagagaggggacagagacccagagagagggggacagagatcccagagagagggggacagagacccagggagagggggacagagacccagagagagggggacagagacccagggagaggtggacagagactctgagacagagggggacagagactctgagagagagtggggacagagacccagagaggtggatgccagagatggggaggagacaccttgactgaggcaaggggcagagggggatgcaaaaaccaaagaattgggggaagggcaggaactcagaaaggaggggccagagatttaggggagagagagggacacagacttgggggaggactgacactaagataagagtgggacagaagcccagagtgagagggagaggcaatcccatggaggagggacagggaccctgagagagcagatgacagaattgaagagagaggaggacccgtgaacaggaaaggagaccctagtgggggcagtcatgaagggtgaggagtaggaaatactgacacacagagacgggcaaggccacttgtctcctgccagccctctgtgatggggacagctgtggcctccgtaacctgagtccccctacccctcccagctgtatttatagccctggcctagcccagtccctgcccccagatctgagttccagggacaggaggtcatgggcacgtgtgttgggggccatgttcctttccccccattctagggcctcaatactgacatcactctctcaccagcacgtatcattccagctggaaacaccccgcaatcgaacccccagtccttccgtcccaggagtctctcccctctgataagtctcttctgcctcccccaggtgccccaggctcccccaaaaacctgctaaaagtctagcctttgtctttgcagctgccaaacgtgagcttgttggtagttcaaagtcaagtcccttggccaccgtctcctggccagggagagacccctcactggtcccctccccagctgggaggaggaggagcaggaggcaggcaggcggggactgacccagaataactcagggctgagagtaaatttagctggagagaggggaggggaaggaccctattggctggggaatggggagggagggccccagaggggggtcagggggctccggagacagcctcagaggggtgtccagagccaggcagcaaggaccagaggaaggtggacagagaccgaaaggacaaaggagagacacagagaaaaaaagagaccaaccccaaagggacaaagaccccaacgtttgtccacattgccgcagaggcagctggagccagtgctgcctgtccgtccccatgggccaccataggccatggctgcacrcttctgtcctctgggctggggtggccagcctgctcctcccccyggccatgacccagcagctcagaggggatgggctrggcttcagaaaccggaacaacarcactggagtcgccgggctctccgaggaggcatcagcagagcttcgccaccacctccacagccctagagaccatccagatgagaacaaggatgtttccacagagaatgggcatcatttctggagccacccagaccgtgaaaaggaggatgaagatgtckccaaggaatatgggcacctactcccaggccacaggtcccaagaccacaaagtcggagatgagggtgtctcaggtgaggaggtctttgcagagcatggtgggcaggcccgtgggcacagaggccaygggagtgaagacacggaagactcagctgagcacaggcaccacctccccagccacaggagccacagccatcaagacgaggatgaggatgaagttgtgtccagtgagcatcaccatcatatcctcaggcatggacaccgaggccatgatggggaagatgatgaaggagaagaggaggaggaggaggaggaggaggaggaagaggaggcctccactgagtatggacaccaggcccacaggcaccgaggccatgggagtgaagaggatgaggatgtctcagatggacaccatcatcatggccccagccacaggcaccaaggccatgaagaagatgacgatgatgatgatgatgatgatgatgatgatgatgatgatgtctccattgaatatagacaccaggctcacaggcaccaaggccacgggattgaagaggatgaagatgtctcagatggacaccatcatcgcgaccccagccacaggcaccgaagccatgaagaagatgacaatgatgatgatgatgtctccactgagtatggacaccaggcccacaggcaccaagaccacagaaaggaagaggttgaggctgtctcaggtgaacaccaccatcatgtccctgaccacaggcaccaaggccacagagacgaggaagaagatgaggatgtgtccactgaacgttggcaccagggtccccaacatgtccaccatggccttgtagatgaggaagaggaagaagaggagatcacagtccagttyggccactatgttgcaagccaccaacctcgaggccacaagagtgatgaagaggacttccaagatgagtataaaacagaagtccctcaccatcaccaccacagagtccccagggaggaagatgaggaggtctctgctgagcttggccaccaggcccccagccacaggcaaagccaccaagatgaagaaactggccatggtcaaagagggtccatcaaagagatgagccatcaccccccaggacacacagtggtcaaggatagaagccatttgaggaaggatgattctgaggaggaaaaggagaaggaagaggaccccggctcccatgaggaagacgatgaaagttcagagcagggagagaaaggcacccatcatggcagccgggaccaggaagatgaggaggatgaggaggaaggtcatggcctcagcctgaaccaggaggaggaagaagaggaagacaaggaggaggaggaggaggaagaagacgaggagaggagggaagagagggctgaggttggggccccactgagcccagaccacagcgaggaggaagaggaggaggaggaggggctggaggaagatgagccccgcttcaccatcatccccaacccactggacaggagagaggaggctggaggtgcctccagcraggaggaaagcggtgaggacacaggtaagtggcctgggctggtgtgggtgggaaggaaccgagtcagcctgggtcactgctgccctcctgtccccgcaggtccacaggatgctcaggagtatgggaactaccagccagggtccctgtgtggctactgctccttctgcaatgtatgtccccagcccagatccacccaccaaggtgtccccagaatctgtcccaggggccctggggtggtgctgtgggagggctcagagcaagggcaggccagggtcagttctgaaagaaaagagatccttctgcaggcatgtgaggtgaggacagactgatgaaggctgggaggctggggcagtggtccaggaaggagaggacaagacccaagctgcatcttggggtgtggggacagagacaggggtctgtggcaaagagagtcgggggaaggagggatggcacaggggctgataggctagggggagaataggcagagagcgggtggagagagcacctgagcccaccctgacagggagacatggggtcgccctgagatagaaaaccaggggcagggccgggtgtggtggctcacgcctgtaatctcagcactttaagaggccagggtgggcggaacacgaggtcaggagatcgagaccatcctggctaacacggtgaaaccccatttctactaaaaaatacaaaaaaattagccgggcatggtggcacgcacctgtaatcccagctactcaggaggccgaggcaggagaatcgcttgaacccgggagacggaggttgcagtgagctgaggttgcgccactgcactccagcctgggcgacagagagagactccgcctcaagaaaaaaaaggaaaaaaagggaaaggaaggaaaccaggggcaggggaggggaggggaggctggtttggggggcagatacagagctcagtgttagagataaagagggtagagtctggggaagcgtccagggtgcaggggtgggccaggggcgggtacctcccaagtggcgttagagtttccatctaaccaggctcccccggtccccagcgatgcactgaatgtgagagctgtcactgtgatgaggagaacatgggtgagcactgcgaccagtgccaggtgagacctcacctcacactcaaggctccactgggcctcaggatgcaccgggaccctctgaggacccccagccctaaatcctggcctctgacccaaccccttacccctgatgcaaccttgactccacaagcgatcctgactccaaccttaacctagacctagcctctggtccgggtctggtcccggccccatcctaactccgcccccggccacgccccacgctcactctctctccccgtccccgcctccagcactgtcagttctgctatctctgcccgctggtctgcgaaacggtctgcgctccaggtgagcatgggcggggccctggaaaaacctgaggaaggtgccgggcccagcgtggtgaatcctggtgggggcggagcctggcccggwaggctggtggggcggggctaagaggggaggcgtggccaaggctctgagcacgtgggccggggcctggctcgaggaacaccaggtggagttgctggagccaagggacagaaatgagtggagggttgagatgcgggcttagagcctaatgggcgaggccaactcaagtaggaatcgaaggggcggggctactggagaacggaatcacccagaacgaaaaaggggtccggtagaagggattcagttggaagaaggaattagggaaaaggaggtggagctagcactaatctcgcacgctatactgagtggctgcctaattttgctcgtgcagtacccctcaagcctcttttctctgctgtcccacaggaagctacgttgactatttctcctcgtccctttatcagtaagtgtgtaaaaggggagcgtgtaaaagccccgtttagagaagtgcttgtctcgctatgagttatcagatgactctgggactccatttccccgtccatgaaatgggcaggttaatgatctctaagcgtcctggggtgggctttgaacaccagctgtctaacttctggcgttctcgtctccagggccctggcagacatgctggaaacgccggaaccctgacccagtcgctcgactgcgacgcaggtgtacctccccctgccttccaacccctttccacgagctatatttatttctccgaataaacgtgctccccgaaacctcattgtcagacgtggggtctgggaatctcagggcatcggggaatgcgggtagggtctagagacctggacctagacttgagggatgaggggcctggactcctggctcgaggtggttggttgaacagccccccccccccccgcaaaaaaaaaatcagtcaacaaggaagctttttgaaacagttctctttacccgtgatcactgagtgacgcctggggcggggaggccgaccgagagtcgggggcgagggctcccccaccgtccccctgcccccacgccacgtcgcccagcggmatcgtggaaagaggattctcccatgcaaaccccggagccagaggagaaggggaagcgccattctgcgccccctacccccggggcacggacacggccacagcacggggggcggtgaggccccggggacacgagacacgggggagggagaggggamcccgcccgcagatgacccgggggaccggcgaccggacgcggcggggcggagctgagtggcacagggggcgaggcttgtagcagcgagtcccccctcccctcctttcggacgaagaaggaagacttgggccccgcgactgsgcaggaaaaaggggagggagcagcctctccccgcatgcggcccgggagggaagccccgcccccttcccgcgggtaaaggacacccgtctcccaacagaaactgatcaataaattacaaagtagagaaaaggaaagcggacgtttggggcgggatttcttcctccccgcttcttccccctctcagtccagttcatgtggtttggtccaggccccggccctgtgcgaggcgggcgcgcgcactcccgctggtctgtacagatggtccagtcctcggcgcgagctcccccgcccgctctccccggcgaggccacagtccgggcaggagagggaacagcccagcctcgggaagattcttccgtccgagtgaggtcacctgcatgacgccgggcagcgcgtggagcagtgaagatccaccgtgccgccccgcacccccaaggtcgcccagcacggtcctcacctggaggcctgcactagcaggaataggtccggaccgaaacgccgtctgcccgggaactcccagaagtctggcctggagggagagcgagcagcggttcagcctggagcaccctcctccctgttcctctccaggattcctccctttggacttcccttcccgatgtcacaacgatcgccgggctccacatgggtttccctcccttccccgcagccaaggactcaaactcgcattgggcgagttcactcccgccctgggaagggggagtgggatttatccatttcatcctgacgggggagtccggaacgttggagcagtccattcctcaggggtgggcgagaaaggactaggccattccagaacccggactactgaggtggtccatgccccaccctagggaagcgaggaagggctgtcgcatttgggagccccccaccttctggctgcagcttgcggagagggagccccggagagcccagggctcccgctgcagccgaacgaaagttggggggcaacatctcagctgagtcgggagttacgcctcggaggtccttctcccggaacatcttccgccaggatggggagcggctgaaagacttggcgctgtcctaggtataggagccggacagccggtgagggactcctgccttgtctgactccgccccttcctttgactccacccctctccgggtctcacctctcctttaaccccgcccctctcctggccccgcctccaaccgtgaccattaatagtcaggccccgccccctcagctcagcctctcgaggagccgctgggagcagagccctctgagctgttgccgcgcccacctcgtccagccgcctgtctgtgcctaaggagataaggttgctgaattccttctccagaagctgccgggcctggaaagaggaggtggagggggcggttggagcgtgcagtctgcgaggtggggacgcccagcatgctccgggcccagcggcagctcacctgtgcattctgcgtggggatctgcaggagcaaggccaggtcggagtagtcgaaggtctcgtccagggcgagcagtgccccgtgtaccccgctctccgtgaggttcgtggcaaattccttcaggcccagcccggacacccaacccatgacccgctcattggaccacaccatcacgtctggggacggaagggaccctcagccgtgcccctcccgtggcctggagagttcagtttagcccatacctccacctccatttggtctcttcgggccacgccccccacgctggctccacccccacggttatggtgccaatttgcttctccggtctccccctaccccctctcctccccatccagctccacgccctccacctggctcccaaagggacccttaggctctactcacctcggatctgggtctgactttcttcccgcctccgctccaggtccttccggtcatagttgagccgtttcaggcacataatcccataatgtagactcaccctgagcagcaggggaagtggagtcacggatgagctttccagtcccctagactgctgctcctacgggtccctccccactggctgcgctcttcttggaaagggtggggagctgataagttctattgactgttgatcccctcaggaggtgaggcattttcaataataggcacttcctactggccagcctggaaggggtccagggttaactagccaagccatttcaggatctgaacttttcctgtggaccatctcattggtgaaaggagcacagagtcaggatttcctgagaactcaggctaaaagggccaagataagcctgggaatctcccatggccaatcctattggccaaagactctctggggtggggcttccctttggactgtccccactggccaggcagcccccacctgtgaaagctgtccaccatcttgagttggccccggagctccttcttgttaaggtgatctaacattcgagcgtccaccagcgactccatgaagtagctgcggtaytggggcagccccaggctgggcagccagtcgttccccacccactcgtggttcatgtcgccatatgccaggatctggggccatgggcaggtgagggaagagtcaggccctctggccccttcccactgtgcatgagaggggtacagtccaacctcccaatccaaggttttttcccaccccatggtaggacaatgaccaatctctgctcaggataatggaccaatccagagttgtctcctagcccttcatgacagcatatactcttggctactcaaacagttgtcctgagacctagagcgtcaccatcacctgtggacttgctggaattgcagaatctcagaccttactccagacctactgaagtcggtatcggcattttcacaagaccctcaggtgattcgaaatatacattatatttatttttaaatttctttctttctctctttctctctctctctctctctctctctctttctgaaagagtctgctatgtcacccaggctggagcgcggtggcacgatctcgtctcactgcaacctccccatcccaggttcaagcaattctcttgcctcagccttcgagtagctgggattacaggtacgagccaccacgcccggctaatttttgtattttttagtagagacggcgtttcaccatgttggccaggctggtctcaaactcctgacctcaagggatccgcccacctcagcctcccaacgtgctgggattacaggcatgagccaccgcgcctggctgtatttgtttattttttagagacagggtcttactatgttgcccaggttgacctcagcttcgtgggctcaagcggtcctcctgcctcagtcttccaagtagctgagactacaggtgcgtgccaccccactacacattaaatttggggaagcactgctttaactctgtctcactgcagtccaacgtcactaaacccccaagtcaggacaatggactctttcaaggcagctctcccactaagaaagggccatcactcttgcaatgtcctgaaaatacttgtctaatgttatatctggcccaggacaatattccagatgagtcccaagtccctcactcctttcagtatcagcacaaaatccacgcctccccctggctggaaatatgtgatctatgaccacagtcaaacataattcctccgtggacagtgagttcatgcctcttgggtttttttgttagtttatttgtttggtttttatgagatggaatctggctctrtcacccaggctggagtacaatggtgcaatctcggctcagtgcaacctctacctcctgggttcaagcgattctcctgcctcagcctcccaagtagctgggattacatacgctagccactgcacccggctaatttttgtatttttagtagacacagggtttcaccatgttggccagactggtctcaaactcctgacctcaggtgatctgcccacctcagcctcctaaagtgctggaattacaggcgtgagccactgcgcccggccgcctcttgtttcttgagaacaaagtgtagctcctcctccccaacttctcattcagcctggctgcctcaccaccaccacagccagtgtgtcctccttggccctggtacactgagcagtccactgtagcccccgccccctccactatagggacaccggctgctcagtctctcctgagctacagaattgaagccccttagagcccccacaacccacgatgatgaaatggtccatgcataaggctgactatgcaacagtctgggcttccacatcgcatcccctctaccctccccaccgccaagccataatggaacagtccagagccaagcttggcgcagcgcccccccatggggatgatggcatgttctggtgaaggcaggggcagggctcggaggaggggcatccatgcrtcgtgcacagcctgttcatgcgctcacgccccgccccgcgccccctacctgctcccagctgatctccttggtctcctgacccgttagtaggaagaggggagagaaggggtgagttaaggggcaggcagaggaggacgcaaggagcggacttagggatggccacagactcggtccccgcccccacccccaaagaaggttagtgccacccccaaggcggccggcagggggcactcacgggcttggtcgtggccgtaagggactccatctcctcgtgtgtcatccacacgtttcctgtggactgaggggcagggagtgttaatggatggtgggagagggcttcgcgtgggggagaggaaggagggtgtcctcctgaaggccctgggccacacgtttatgtccctcctgctttctggggcaagcagtaacagagaaaaggaatgattcttattatagggcacctgccatgtaccaggcaatgtgactttggagttgaacaaattcaggttggaattgggaccctgccatgcattttgctgtgtggccctgtgcaaatgacgtcacctcgctgacctcacacagaggtacagaatgaggattcagaagtgggggacagacacagccatggtgcaaatgtttagggagtatggcggggggggttcacatttattgagcttctgctcccaacaacctcacgagttaggaatccatacaaggataaaaacatttatgtacttctggtgagtgtcaggcaccagtcaccgtcatagggtgtgggatatggcaagggacacgacagacacttttcgtcctagtgggggagaaacaatgaacatattttaagtatgttggggaaatttgaatacagagtgaatagtaaatgaaattaacaactgtggccaggcgtggtggctcacacctgtagtgccagcactttgggaggctgaggcgggcacatcacttttggagattgaagactagcctggccaacctggagaaaccccatctctactaaaaatacaaaaattaggctgagagtggtctagcact

SEQ ID NO: 17563 - DNA, 23107 bp, Homo sapiens
gagcagtggtccaagctctatcttggcccgtttgagccaaggctggagccagagcagagtggcctggatgcgggcagcagtgtcccaaagctgtgcatagcagtgtggccctggcctggcccataaaacctctgggcctagtgcaccaaacctctgcacctgtgatgggaggggctgcttcatagatctctgaaatgccctcaaggcctttttaacattgtcttgaatattagcacttggctcccttttagtcatgctaatctctctagcaatgattgctctgcagcctacttggattctttctctgccacaaggccaggctgcaaattttccaaatttttagactctacttccattttaaacataggttccaactttaagtcatttctttacccctgagcacaggctgttagaagcagacaggccatatcctggcttagaaatttctaagcaggccaggcggggtggctcatgcttgtaaccccagcattttgggaggccaaggcgggtggatcacgaggtcagaagattgagaccatcttggctaacatggtgaaacctcgtctctactaaaatactaaaaaattagccaggtatggtggcaggcgcctgtagtcccagctacttgggaggctgaggcaggagaatggcatgaacccaggagacagagcttgaagtgagccaagattgcgccactgcgctccagcctgggcgacacagcaaaactccagctcaaaaaaaaaaaaaaaagaaagaaagaaatttctaagcaacacactttgttgcttagaggtttcttccactagataccctaccgtaagtcatcactcttacattcaaacttccacagatccccaggacatgaacacaatgcacccaatttctttgctgagtcatagcaagggtgacctttgcccagttcccaacaaattccccatttccatctgagactttgtcaccctggacttcattgtccgtatcactatcagcattttggtcacaaccatttagccagtctctaagaagttccaaactttccctcatcttcttgttttcttctgagccctttaaattcttccaatctttgcccattacccagttccaaagttgactccacatttttagatatctttatagctatatgccccattcttcagtaccagttttctgtattaagccattcttttttttttctttttttcttttttttgagacggagtctcactctgtcgcccaggctggagtgcagtggtgcaatctcggctcactgcaagctccgcttcccgggttcatgccattctcctgcctcagcctccagagtagctgggactacaggcgcccaccaccacgcccgactaattttttgtatttttagtagagatggagtttcaccgtgttagccggtggtctcaatctcctgacctcatgttccacccccctcagcctcccacagtgctgggattacaggcgtgagccaccatgcccagcctgtattaagccactcttatgttgctataaagaaatatctgaggctgggtaatttatatggaaatgaagtttattttggctcacagttctgcaggctgtacaagcatggcacccacatctgctcagcttttggcgaagccttaggaaactttcaatcatggcagagagcgaaggggagcagggatgtcacatgtcgaaagcagtaacaagagagcaatgggggagtgccacacacttttaaacaaccatatctcaggagaactcattcactattgagaggacagtaccaagctattcatgagggatctgcccccatgatccaaacacctcccaccaggccctacctccaacactggggattacatttcaacatgagatttggagggaacaaatacccagactacatcaatcacccatctccagagaaaaggaaaagggaatttagaaacaaaaaaaaaaagcacatccatcagagaacagatgagctaaggtgaagaggtaattgtagctaaatagaaatttgctgactgaacgtgaagctgtcccttcctgctatggacttcagattttagcccacttgaattgctccatatcctccaagccatggccatcccttgactctctgggctcccaagcacttgctgccttcatcacacagtttgagttaaggcagaaagactggtttccatgtacactttgtggaagctttctcatttctttatataatctctgtcctttgtctactgctttaaaatctagaaattgtttacaaacacaaaggtgatcctttaaaagctcaaagctgattgtgtcaccaatatataccactcttaatggcttcccattaaactttgagtaaagactttatggagcctacataaggccatgactacctggctcttattttcctcctcatcctcatctcaccaactcactctccactcctatacccctcactccttccccctcctctctctgagctccagactcccaattacctacttccaccctttttgacccccagggacttatctcagcctggaattttccctctttgctctccactgaactgtccactcccagtctaagacatgtgcttatgtcacacgcccttaccgtgcttatctcagtttgtaattatctactcatttagaaaagtgttgatgaaggtcttcactgtcagctttcaggatagcaggaatcatagctgattttacttacttaacggggtttcattctttgtaactttttttttttttgagatggagactcactcttgcccaggctggagtgcaatggcatgatctcggctcactgcaacctccacctcctgggttcaagtgattctcctgcttcagcctcccgagtagctgggattacagatgcctgtcaccacgcccagctaattttttgtattttttgtaaagacggggtttcatcatgttggccaggctggtctcgatctcctgacctcaggcgatccacccacctcagcctcccaaagtgctgtgattacaggcatgagccacggcacccagccactccttttttacttatgggtgagaagccattagagattatttcttcttttctttctctcttcactaaggcaccagggtcactaagtagtaggatactttgaactagaattcaagaaattgagttttaattttacctcacactctcatatgaattctccatgtgacctcgggccatacttcccctgtaccctgtttcctcttttataaaagtaagagtttaaactagatggtctccgacatgcatccttctctaacatattctgggaccttcaataaactaagataaagcagaataattaaaacttaatttaaaagaacacaggaaaggaagcagctacattaagcaaaagagacatcctcatggttgaagaagtgtatgccctggtgtctggatcccatttaggaaacttggtaaccttgcaatcttgggcagattgcttaatttctctagaccatgacttcctcttctgtaagatgtgataagaacatctacctcacaggtttcatgagaggattaaatgagataatgtattataatcccttgaacatggtaggctgttatgttaagtcctttcctccttctctgtagctatcatggaatttaaaaacacattataactagagcatgagttgcgactaaaggctcaattgtctctgcatgtgttggctcatgcatgctttattcctctgaagagcttttataccaagtgaaaggaaataattgcatttccctgaaaattcacaggaaaaagttatgtttttctcttcattcaagtgattctgttagacccaaccacatgcaacaattttaaagttgcttccaaatatatttacaaatatttcctgtcttcaaggaacaatggcaagaccatgactcaggttcacatccggattccaccactaaccatgtacccaattacttcagtcaccttcattcaggtcttacatatcacagaataaaatcagatttcatcagaggaggtgaagacagggagaggagatatttcaatcccttctccgcaacccccgtttttttttttttttttaacaaggatcctagagttactgaatgatagcacgtttgagggggaaagaccctaaggatgatctttataagccatcacttggtgttggtggtgataagagactcgagtatctttatgcagtggaaagagaagattggactcggaatcagaagcttgagttcaagcactggtttcatcagtcttgtgatcttgggttggtcacttaacctcttcaagggtcctcagctgtgaaagaggatagtatcagctaattcttgtaggtgcagtgaggaggcagtgagatagtgcaggtaaactataaaacaattgtcacatgaaacgcatcacagtgattctttggacccacaagctccaatcttataaaacatatccagtcacccaccaacatagatcatctcaccttgcatatctgattttgtggatcatggggaaaaactgctgattcctagcaaaacccatggcataggataagtgcacaataatttttttttcctaaatgatttagatgacagtgactcattaagggtttcctgaggcctcctcagagtcgagaggtgggtgcctgaagccacccaaagtccctgtcacaggatggctcccaacgcacacaccacaggcctgcccagtatgttccactatctacccagtagagccctgcccagtacgttccactgtcccttccctagaagaggtgactgttgttcacagtcccagaaaagcgggctccccaaaacaatgcaaggacccacctctctctgaacctcacccaccctagttttcctttaaaaatcaatttacaagaagatcatgtgaaggaaaaggttgggtgatattctaacccaagttagctgtttctcaaccaagttctctttgaaaaattcaacaaccacctttggggaattatttacaacagaggagtgaggatgggaccaggataggtattgcctatgttggtggaaccagggtttttttcctggattaccaaagagatggtatgcattgctcccagaagctaaatatcttcaggctttcaatggtggccttcacctgaaaatgttatccctgttgaagctttcaagccagtattttcataagaactatattttctttggtgaactgaggcattataatgatgactatacaggttcttgagtgactgaagccatcattagcattgtcattatttttgtttagttgcatctccatagcagctcacattcacaatgtgctttgcaattgttccttagcaatagccctcacaagattctcaggaggagagggttaatcaggattaacatttctgtgttgcctaaagaggaaccaaggtaagcagaaatgtagccagttggctggcatcactgttgcttcaggattcatccttagacacccaagcttctaccctagtctggtgctacacttacattgcttacatccaagtgtggttatttctgtggctcctgttataactattatagcaccaggtctatgaccaggagaattagactggcattaaatcagaataagagattttgcacctgcaatagaccttatgacacctaaccaaccccattatttacaattaaacaggaacagagggaatactttatccaactcacacaagctgctttcctcccagatccatgcttttttgcgtttattattttttagagatgggggcttcactatgttgcccacactggactaaaactctgggcctcaagtgattgtcctgcctcagcctcctgaatagctgggactacaggggcatgccatcacacctagttcatttcctctatttaaaatatacatggcttaaactccaactgggaacccaaaacattcatttgctaagagtctggtgttctaccacctgaactaggctggccacaggaattataaaagctgagaaattctttaataatagtaaccaggcaacaycattgaaggctcatatgtaaaaatccatgccttcctttctcccaatctccattcccaaacttagccactggcttctggctgaggccttacgcatacctcccggggcttgcacacaccttcttctacagaagacacaccttgggcatatcctacagaagaccaggcttctctctggtccttggtagagggctactttactgtaacagggccagggtggagagttctctcctgaagctccatcccctctataggaaatgtgttgacaatattcagaagagtaagaggatcaagacttctttgtgctcaaataccactgttctcttctctaccctgccctaaccaggagcttgtcaccccaaactctgaggtgatttatgccttaatcaagcaaacttccctcttcagaaaagatggctcattttccctcaaaagttgccaggagctgccaagtattctgccaattcaccctggagcacaatcaacaaattcagccagaacacaactacagctactattagaactattattattaataaattcctctccaaatctagccccttgacttcggatttcacgatttctcccttcctcctagaaacttgataagtttcccgcgcttccctttttctaagactacatgtttgtcatcttataaagcaaaggggtgaataaatgaaccaaatcaataacttctggaatatctgcaaacaacaataatatcagctatgccatctttcactattttagccagtatcgagttgaatgaacatagaaaaatacaaaactgaattcttccctgtaaattccccgttttgacgacgcacttgtagccacgtagccacgcctacttaagacaattacaaaaggcgaagaagactgactcaggcttaagctgccagccagagagggagtcatttcattggcgtttgagtcagcaaaggtattgtcctcacatctctggctattaaagtattttctgttgttgtttttctctttggctgttttctctcacattgccttctctaaagctacagyctctcctttcttttcttgtccctccctggtttggtatgtgacctaraattacagtcagatttcagaaaatgattctctcattttgctgataaggactgattcgttatactgagggacagcagaactagtttcctatgagggcatgggtgaatacaactgaggcttctcatgggagggaatctctactatccaaaattattaggagaaaattgaaaatttccaactctgtctctctcttacctctgtgtaaggcaaataccttattcttgtggtgtttttgtaacctcttcaaactttcattgattgaatgcctgttctggcaatacattaggttgggcacataaggaataccaacataaataaaacattctaaaagaagtttacgatctaataaaggagacaggtacatagcaaactaattcaaaggagctagaagatggagaaaatgctgaatgtggactaagtcattcaacaaagttttcaggaagcacaaagaggaggggctcccctcacagatatctggattagaggctggctgagctgatggtggctggtgttctctgttgcagaagtcaagatggccaaagttccagacatgtttgaagacctgaagaactgttacaggtaaggaataagatttatctcttgtgatttaatgagggtttcaaggctcaccagaatccagctaggcataacagtggccagcatgggggcaggccggcagaggttgtagagatgtgtactagtcctgaagtcagagcaggttcagagaagacccagaaaaactaagcattcagcatgttaaactgagattacattggcagggagaccgccattttagaaaaattatttttgaggtctgctgagccctacatgaatatcagcatcaacttagacacagcctctgttgagatcacatgccctgatataagaatgggttttactggtccattctcaggaaaacttgatctcattcaggaacaggaaatggctccacagcaagctgggcatgtgaactcacatatgcaggcaaatctcactcagatgtagaagaaaggtaaatgaacacaaagataaaattacggaacatattaaactaacatgatgtttccattatctgtagtaaatactaacacaaactaggctgtcaaaattttgcctggatattttactaagtataaattatgaaatctgttttagtgaatacatgaaagtaatgtgtaacatataatctatttggttaaaataaaaaggaagtgcttcaaaacctttcttttctctaaaggagcttaacattcttccctgaacttcaattaaagctcttcaatttgttagccaagtccaatttttacagataaagcacaggtaaagctcaaagcctgtcttgatgactactaattccagattagtaagatatgaattactctacctatgtgtatgtgtagaagtccttaaatttcaaagatgacagtaatggccatgtgtatgtgtgtgacccacaactatcatggycattaaagtacattggccagagaccacactgaaataacaacaattacattctcatcatcttattttgacagtgaaaatgaagaagacagttcctccattgatcatctgtctctgaatcaggtaagcaaatgactgtaattctcatgggactgctattcttacacagtggtttcttcatccaaagagaacagcaatgacttgaatcttmaatacttttgttttaccctcactagagrtccagagacctgtctttcattataagtgagacyagctgcctctctaaactaatagttgatgtgcattggcttctcccagaacagagcagaacyatcccaaayccctgagaactggagtctcctggggcaggcttcatcaggatgttagttatgccatcctgagaaaggccccgcaggccgcttcaccaggtgtctgtctcctaaygtgatgtgttgtggttgtcttctctgacaccagcatcagaggttagagaaagtctccaaacatgaagctgagagagaggaagcaagccagytgaaagtgagaagtctacagccactcatcaatctgtgttattgtgtttggagaccacaaatagacactataagtactgcctagtatgtcttcagtactggctttaaaagctgtccccaaaggagtatttctaaaatattttgagcattgttaagcagatttttaacctcctgagagggaactaattggaaagctaccactcactacaatcattgttaacctatttagttacaacatctcatttttgagcatgcaaataaatgaaaaagtcttcctaaaaaaatcatctttttatcctggaaggaggaaggaaggtgagacaaaagggagagagggagggaagcctaatgaaacaccagttacctaagaccagaatggagatcctcctcactacctctgttgaatacagcacctactgaaagaactttcattccctgaccatgaacagcctctcagcttctgttttccttcctcacagaaatccttctatcatgtaagctatggcccactccatgaaggctgcatggatcaatctgtgtctctgagtatctctgaaacctctaaaacatccaagcttaccttcaaggagagcatggtggtagtagcaaccaacgggaaggttctgaagaagagacggttgagtttaagccaatccatyactgatgatgacctggaggccatcgccaatgactcagaggaaggtaaggggtcaagcacaataatatctttcttttacagttttaagcaagtagggacagtagaatttaggggaaaattaaacgtggagtcagaataacaagaagacaaccaagcattagtctggtaactatacagaggaaaattaatttttatccttctccaggagggagaaatgagcagtggcctgaatcgagaatacttgctcacagccattatttcttagccatattgtaaaggtcgtgtgacttttagcctttcaggagaaagcagtaataagaccacttacgagctatgttcctctcatactaactatgcctccttggtcatgttacataatcttttcgtgattcagtttcctctactgtaaaatggagataatcagaatcccccactcattggaytgytgtaaagattaagagtctcaggctttacagactgagctagctgggccctcctgactgttataaagattaaatgagtcaacatcccctaacttctggactagaataatgtctggtacaaagtaagcacccaataaatgttagctattactatcattattattattattttattttatttttttgagatggagtctggctctgtcacccaggctggagtgcagtggcrcaatctcggctcactgcaagctctgcctcctgggttcatgccattctcctgcctcagcctccygagtagctgggaatacaggcacccgccactgttcccggctaattttttgtatttttagtagagacggagtttcaccgtggtctccatctcctcgtgatccacccaccttggcctcccaaagtgccgggattacaggcgtgagccaccgcgcccggcctdttattattattattactactactactacctatatgaatactaccagcaatactaatttattaatgactggattatgtctaaacctcacaagaatcctaccttctcattttacataaaaggaaactaagctcattgagataggtaaactgcccaatggcatacatctgtaagtgggagagcctcaaatctaattcagttctacctgagtaaaaaaatcatggtttctcctccatccctttactgtacaagcctccacatgaactataaacccaatattcctgtttttaagataatacctaagcaataacgcatgttcacctagaaggttttaaaatgtaacaaaatataagaaaataaaaatcactcatatcgtcagtgagagtttactactgccagcactatggtatgtttccttaaaatctttgctatacacatacctacatgtgaacaaatatgtctaacatcaagaccacactatttacaactttatatccagcttttcttacttagcaatgtattgaggacattttagagtgcccgtttttcaccattataagcaatgcaacaatgaacatctgtataaataaatattcatttctctcaccctttatttccttagaatatattcctagaagtagaatttcccagagccatgaggatttgtgacgctattgatatgtgccactttgcactctctgtgacatatataattatttttaatgcattctttttttctcagagtgcattcrtttgaaaacatagacgggaaatactggtagtcttccttgtcagttagaaacacccaaacaatgaaaaatgaaaaagttgcacaaatagtctctaaaaacaatgaaactattgcctgaggaattgaagtttaaaaagaagcacataagcaacaacaaggataatcctagaaaaccagttctgctgactgggtgatttcacttctctttgcttcctcatctggattggmatattcctaataycccctccagaactattttccctgtttgtactagactgtgtatatcatctgtgtttgtacatagacattaatctgcacttgtgatcatggttttagaaatcatcaagcctaggtcakcaccttttagcttcctgagcaatgtgaaatacractttatgaggatcatcaaatacgaattcatcctgaatracgccctcaatcaaagtataattcgagccaatgatcagtacctcacggctgctgcattacataatctggatgaagcaggtacattaaaatggcaccagacatttctgtcatcctcccctcctttcatttacttatttatttatttcaatctttctgcttgcaaaaaacatacctcttcagagttctgggttgcacaattcttccagaatagcttgaagcacagcacccccataaaaatcccaagccagggcagaaggttcaactaaatctggaagttccacaagagagaagtttcctatctttgagagtaaagggttgtgcacaaagctagctgatgtactacctctttggttctttcagacattcttaccctcaattttaaaactgaggaaactgtcagacatattaaatgatttactcagatttacccagaagccaatgaagaacaatcactctcctttaaaaagtctgttgatcaaactcacaagtaacaccaaacyaggaagatctttattatctctgataacatatttgtgaggcaaaacctccaataagctacaaatatggcttaaaggatgaagtttagtgtccaaaaacttttatcacacacatccaattttcatggcggacatgttttagtttcaacagtatacatattttcaaaggtccagagaggcaattttgcaataaacaagcaagactttttctgattggatgcacttcagctaacatgctttcaactctacatttacaaattattttgtgttctatttttctacttaatattatttctgcaattttcccaatattgacatcgtgtatgtatttgccatttttaatatcactagacaattcaatcaggttgctacgttggtcccttgggtttactctaaatagcttgattgcaaatatctttgtatatattattgttttttctcctatcttgtaatttctttgagcacatcccaaagaggaatgcctagatcaatgggcacaaataatttgacagctcttattaaacattattctgtaagtaaaaactgaactacttttcagtatcactagcaacatatgagtgtatcagcttcctaaacccctccatgttaggtcattatgaacttatgatctaacaaattacagggtcttatcccactaatgaaattataagagattcaacacttattcagccccgaaggattcattcaacgtagaaaattytaagaacattaaccaagtatttacctgcytagtgagtgtggaagacattgtgaaggacacaaagatgtatagaattccattcctgacttccaggtatttacaccataggtggggacctaactacacacacacacacacacacacacacacacacacacacmccatgcacacacaatctacatcaacacttgattttatacaaatacaatgaatttactttctttttggttcttctcttcaccagtgaaatttgacatgggtgcttataagtcatcaaaggatgatgctaaaattaccgtgattctaagaatctcaaaaactcaattgtatgtgactgcccaagatgaagaccaaccagtgctgctgaaggtcagttgtcctttgtctccaacttaccttcatttacatctcatatgtttgtaaataagcccaataggcagacacctctaacaaggtgacactgtcctctttccttcctaccacagcccccacctrcccaccccactcccattgattccagaggcgtgcctaggcaggmtctatgagaaaatataacagagagtaagaggaaaattaccttctttctttttcctttccctgcctgaccttattcacctcccatcccagagcatccatttattccattgatctttactgacatctattatctgacctacacaatactagacattaggacaatgtggcctgcctccaagaaactcaaataagccaactgagatcagagaggattaatcacctgccaatgggcacaaagcaacaagctgggagccaagtcccaaaatggggcctgctgcttccagttcccctctctctgcattgatgtcagcattatccttcgtcccagtcctgtctccactaccactttccccctcaaacacacacacacacaacagccttagatgttttctccactgataagtaggtgactcaatttgtaagtatataatccaagaccttctattcccaagtagaatttatgtgcctgcctgtgcttttctacctggatcaagtgatgtctacagagtagggcagtagcttcattcatgaactcattcaacaagcattattcactgagagccttstatttttcaggcatagtgccaacagcagtgtggacagtggtgcatcaaagcctctagtctcatagaacttagtcttctggaggatatggaaaacagacaacccaaacaaccaacaaaagagcaagatgctgcaaaaaaaaaaaaaatgaatagggtgctaagatagagaaaagtgggagagtgctatttagacaaagtggtaaaaacaaagccccttgtgagatgagagctgccgacagagggggcgggtcrtggttgtgggtttttgggtaggacattcagaggagggggcgggtcgtggttgtgggtttttgggtaggacattcagaggagggggcgggtcgtggttgtgggtttttgggtaggacattcagaggagggggcgggtcgtggttgtgggtttttgggtaggacattcagaggagggggcgggtcgtggttgtgggtttttgggacattcagaggagtctgaatgcacccaggcctacaacttcaagatggtaaaggacagctccaaggatcagaagaagcattcttggaactggggcattttgagaaggaggaaaaatatgcagagactagtgcttgcagagcttgcatttggatttcatttgaggtacaatgaaaacccattaatgggtttcacacagtgcaatggcctgacctcacttatatttcctaaaatagaaaacagatcagaaggaaggcaatagagaagcagaaagtccaatgaggaggtttcacagcagtcatgggggtggggtaaggaaaagaagtggaaagaaacagacagaattgggttatattttggagatagaaccaacagaaggaagaggagaaacaacatttastgagaagggaaaaagtaggagaggaataggtttgggaaataaatcctgctgacattggaaaccccaaggaagcctcaaaagtatatttacttgctttagatttaaaagaataggaaagaagcatctcaacttggaatttgaaatctatttttccataaaagtattgttaaattctactcatactcacaagaaaagtacattctaaagagtatattgaaagagtttactgatatacttaggaattttgtgtgtatgtgtgtgtgtgtatgtgtgtgtgtgtgtttaaccttcaattgttgacttaaatactgagataaatgtcatctaaatgctaaattgatttcccaaaggtatgatttgttcacttggagatcaaaatgtttagggggcttagaatcactgtagtgctcagatttgatgcaaaatgtcttaggcctatgttgaaggcaggacagaaacaatgtttccctcctacctgcctggatacagtaagatactagtgtcactgacaatcttcataactaatttagatctctctccaatcaactaaggaaatcaactcttattaatagactgggccacacatctactaggcatgtaataaatgcttgctgaatgaacaaatgaatgaagagcctatagcatcatgttacagccatagtcctaaagtgctgtttctcatgaaggccaaatgctaagggattgagcttcagtcctttttctamcatcttgttctctaacagaattctcttcttttcttcataggagatgcctgagatacccaaaaccatcacaggtagtgagaccaacctcctcttcttctgggaaactcacggcactaagaactatttcacatcagttgcccatccaaacttgtttattgccacaaagcaagactactgggtgtgcttggcaggggggccaccctctatcactgactttcagatactggaaaaccaggcgtaggtctggagtctcacttgtctcacttgtgcagtgttgacagttcatatrtaccatgtacatgaagaagctaaatcctttactgttagtcatttgctgagcatgtactgagccttgtaattctaaatgaatgtttacactctttgtaagagtggaaccaacactaacatataatgttgttatttaaagaacaccctatattttgcatagtaccaatcattttaattattattcttcataacaattttaggaggaccagagctactgactatggctaccaaaaagactctacccatattacagatgggcaaattaaggcataagaaaactaagaaatatgcacaatagcagttgaaacaagaagccacagacctaggatttcatgatttcatttcaactgtttgccttctrcttttaagttgctgatgaactcttaatcaaatagcataagtttctgggacctcagttttatcattttcaaaatggagggaataatacctaagccttcctgccgcaacagttttttatgctaatcagggaggtcattttggtaaaatacttctygaagccgagcctcaagatgaaggcaaagcacgaaatgttattttttaattattatttatatatgtatttataaatatatttaagataattataatatactatatttatgggaaccccttcatcctctgagtgtgaccaggcatcctccacaatagcagacagtgttttctgggataagtaagtttgatttcattaatacagggcattttggtccaagttgtgcttatcccatagccaggaaactctgcattctagtacttgggagacctgtaatcatataataaatgtacattaattaccttgagccagtaattggtccgatctttgactcttttgccattaaacttacctgggcattcttgttthaattccacctgcaatcaagtcctacaagctaaaattagatgaactcaactttgacaaccatgagaccactgttatcaaaactttcttttctggaatgtaatcaatgtttcttctaggttctaaaaattgtgatcagaccataatgttacattattatcaacaatagtgattgatagagtgttatcagtcataactaaataaagcttgcaacaaaattctctgacacatagttattcattgccttaatcattattttactgcatggtaattagggacaaatggtaaatgtttacataaataattgtatttagtgttactttataaaatcaaaccaagattttatatttttttctcctctttgttagctgccagtatgcataaatggcattaagaatgataatatttccgggttcacttaaagctcacattacacatacacaaaacatgtgttcccatctttatacaaactcacacatacagagctacattaaaaacaactaataggccaggcacggtggctcagacctgtaatcccagcactttgggaggccaaggtgggaagatcacttgaggtcaggagttcaagaccagcctaggcaacatagtgagatctcatctctacaaaaaaaaatgaaaaattaaaaaatgagctggacatggtagtacacacctgtagtcccagctactcgggaggcttgaggtgggaggatcacttgagcctgggagatggaggctgcagtgagccataatcacaccattgcaccccaacctgggcaacagagtgagacccagtctcaaaagataaatttttaaaaatgttaaaaaatatataaaagagaattttaaaagaacaactaatagatcaaagcatggatgcaagatatatttagttggaaaatcaaggttaaaatcaagggatcttggaattaggtgtggtagatttgggtaaggagtagtctaagatgaccctgtttcttggtactggagactggatgagtggcagcgtcttaaccatatttttggtagaaatatggaggtcttctccattccaggatgaatgatgagtaaaattttaggcatgtaatttgagctactagaaggacactcaattgcagatgtacaatggggagatgataacctatctggaactcagaaaaataactgtatatagatatgaaagacatcagtaggtatgtagtagataaaatcctaaaagtgatgtcaaagggagaagagaagtatatggtgaacactgttgtttgtccatgcaattgccatctcttcttcttccttactgacagaaccctgatttcactgagaagtcaacatgcccttccccaattgatgaatccaattggtttaagattatgttcattctattcttacatgactaagtcacgttgacttaatcctatcaaatgagatgtcgatctggaaacaacttctggaaaagattttctaccttgataaaataaagagccatatagatggtcctttatcttccttcttccttgaatgagatatgttctatgaggaagtgaagcttagaactgtggtcagcaacttgcaacgactgggaagtcagagccacacaatgaagaatgcagagtggaaggaaaaaaagagccagcatctctgacaacattgttacaccgagaacctacctccagattttaagaaaacaagaaatgctactgttattaagccatttcactgggtttgctatgacttgcagtcaaatctagcttaactgatacagagcaccacagagaactggtctctcatttgtctcatcctgttctttctagcagccacgactttcctagggtttccttagcccaagtctggctagagcaagactaagtaagacttgattccttaatgtccttttgttttaagaaatattaaagaattatttttatattaatatattttaagaaataaggaaatacaaaacactgagcaagcaacacaaattcaagaaatcttaaaaagtataatagctgctcagtctctgattaacagtgaaatatggaatcattgtagaaatggccttggagcgttattctcccaggccagctatccttatggtctgccccacctccctcattgcctaaacagtaagagagtcaccatggtgagactcaacagtcttagcacagaacttgttacagtctatttcttttcttacagtcctatatatcaagttccaaatcaatgagagtaaagccaaatccctgcctttaaacccaagggacagaagcaaaaagccaaaagatatttccctaaccttcctcccactgagtagactcctctgacatttaaaaacccctacgcttgaaatttgaggggtgatggaattgttgagatggtaataattattgtggtggatataaaatatgctcgtgtatctatatctctgaatgactgaatgatttataagtttaatggttatatacatttctgacttttaaaaatgaatgtatgagtatatgacaatataataatttacaaaaaaaatttattatctatagcacctcattgaactatacataaaatagattaaattatacctcagtaacaaaggattttttttaatttacaaggaaaaaactctttattccatttatcgcgttgtgtatccagagtggtcttttttttttttttttttgtaccctctctcaaccctaggcatgagatgttcatttatcctaaaatgctctatagggtaatttacctttcttgtggatacattgtttgcatttccctgtcattggctctcactggccaagaacacctttgctccttcttctctaaaacttattcctcaccaatttttctttttatcagagtggctgacaaagggtgttatgcaaccttatgagctctgcagggtaaactgaggtctggctcaaaagtatacatccctgggcctcacctctggagattcagtcagtttgggtagaccttgagcatcttaatttttttaagctccaaaagtaactctcatgtttatcactggttaagaaccactgcatgaagagagtcccagattaaggatggttttattatagtgttaataatggcttccttttgggcaagtcaatccagggttagaaaagatgagaacacacaacttccacctatccagtagaggccttctcacagccacagggacaccggcaggcctcatttggaaataaggtactcaacagcacaagtacccccattttatatactcacttatacttgcgtagaagctgaggggcctgccaagcaggtgcttgcctttggtgtcactcttccaaaaggtctggagtgctttgcccaattgagagaggcctatggaataagaaaaacatgagtggatggtccctgtcttatcttctcaactgtccacactctaaaaaacgactttggctcctagcatgacaagagccttgattttcagaggaacactcccttctcatctccaccaagaagtagagctaatttccttccacacagctcctattcactatttcgtagatggtgaagtcatttctttgtcatgtaaggagaaatgctgttactattttttaaaacagaaaggagagggtttatggagattacagacaggtattcttgatacgaatgtattgcatcaatttagaagatttttcaacagatgttttgtgcatatgtagaataaaatgctgcaatctcaaggtctcaggctgggatcactaagaacaagtcatgctgcagacctcattaccacttttgatgggattacctgagtggcattggcaggtatatctctattgtggcagtgagtggactgtggcttaatgtcattaagcatttggatcagatagataattcatcttgttctgatccataccaaaggagttttcttgaagttgttttgtgtttgtttttgtttgtagagacagggtctcactatgttgcccaggctgttctcaaactcctgtcatcaagcgaccctcccaccttgacctcccaaagtgctggaattacaagtgtaagcccctgcacctggccttcaccaaaggacgttcttattatagatttcctgcatatttgcctacaggaagatgatgcactggctagaggtgtgaatgtcaggtctcttctgccattctaaccctgttataaagtaaaattggctctccatcttataatttagtctccttgaatttagaatactgtagagtttggaatcaagaccggattcaaatctcatttactttgtgatttgtgctagtcttttaatctctcaatgtcagtttccttacttgtaaaaatggagatagtcattactattaacacatcaaatatttgtaatatcaaatgagataaaatacagaaagagcttagcatagcaccatggatttagagtgtttgattcattcattattttacttaaaagtagctattatcacttttacttagtgaatgcatccctgagaatctaatccacaatcacgataccaattaaatcaagttcctgaatccacactgagggttggctcaagcaattctcccacctgggtgaaggtaaatattctacaaaccatcaggtaaagttacttgaccagccagtcagccatctttggtgacttcaacccagccatacttatttcttttctgggagggttgggggtgtggttcatagagatggggtctctctatgtttcccaggctggtctcaaatgcctggcttcaagcaatcctgccaccttggcttcccaaagtgctgggattacaagcatgaaccaccgtacccagcctgtattttgatttttaccattgcatttagcaaagtctctactgatattgtggtagacaaggcagagacatatgggctataagagctagtagtattattgaatgggcttgtggctacttatatatagtgtggttactgtattgaagggatctttaaaaggagaaagccctattcattcaaaagacattaatttagtttctatttggtgccaagaacaatgaatatagtggcctaccctcagtttacagactagcagggagaaagataagcaaataatcaagctaatcacaatccttgagaaagggatgttttgtctgagactgaaggatggttaagagtcaacaaagagactagcctggccaacatggtgaaaccccgtctctactcaaaatacaaagaaaaaaattagctgggaatggtggcaggtgcgtgtaatcccagctacttgggaggctgaggcaccagaatcacttgaacacaggaggtggaagttgcagtgagctgagatcacaccactgtattccagctgggaaacagagtgaggctccatctcaaaaaaaaaggaagaagacaactgacccaatttaaaaattggcaaagactctgaatagagatatacaaatggccagtaaacacataaaaagatgcttaacatcattagtcatcaaggaaatacaaataaaaaccacaatgtgataccatttcacaaccactaggatggttgtaatttaaaagatggacaataacaagtgttgttgaggatgtaaagaaactggaactttcatacactgctggtaggaatgtaaaatgctgcagctgctttggaaaacagtctggcagttcctcaaatggttaaagatagaattatcgtatgacacagtaattcctctcattaggtatatacccatgagtgttgaaaacatatgtctacacaaaaacttatacatgaaagttcataacagcattattcataatagccaaaaagtggaaagaacctagatgtccatcaactgatgaatggcaaataaaatattgtatatccgcacaatagaatacccagtcataaaagaatgaagtactgacacatgctatgtggataaaccttgaaaacagcatactaagtgaaagtgaaacttaaccaatagtcccatagactgttctttcggataaacatagaaattgacgcttctggtcttaaagctggaagcttgtatttgttttgtttgagttccttcctggggaaaagacttcaggcctctcaaaaaaagtatcaaagaactgaaactcgccagatcaccacatccaggcaatgagactttggaccactcattcatcaggattgcttccttgcccctccctggttcctgttttcttacgcattgttacatttcttccctgctatccaaacccctggttttaggtcagggagat

SEQ ID NO: 17564 - DNA, 45268 bp, Homo sapiens
  misc_feature (1)...(45268): n = A,T,C or G, or insertion/deletion polymorphism (see Tables 1-2)
aggaatttatctatttcttctacattatttaattagttgatgtactgtttttcatagtagtctcatgattttctgtatttctgtggtatccattgtaatctttcctccttcatttataattttatttgagttttttttctttttctcctaattaggctaaagatttcttgatttatctttttaaaaacaataacagtgtcattgaccttttctgttgtttttctagtctctatttcatttatctctgctctgatctttattattttctttcttcctctgtctttgggcttagttttttttttttactttcttattgcttcaggtgtaaagttaggatatttcagatctttccattttcttaaggtaggtatttatcgctataaacttccttcttagaactgcttttgctgcatcccataaattttcaatgccacaaattttgtttctcttttcatttttctcaagacattttttgattttccttttgatttcttctttgactcattggttgttcaggagtatgttaattttcatgtatttgtgaattttccatttttccttctgttactgagttctacttttatgccattatggttggaaaagatacttgatatgatttcaatccttaaatttgttaagatgttttccatggcctaacatataacctatcctggagagtgttctgtgtgcacttaaaaagaatgtgcattctgctgcttttgaaaggaatgttctgcacatgtccgttaggtctattggtttatagcattttgaaatccacagtttccttgttgattttctgtccaggtgatctattcattgttgaaagcatgttgctatttatttctcctttagttatgttaatatttgctttatagatttagatgcactgattttgggtacatgtgtatttacaattgttatatcctcttaatgaattcacccttttaccattatataatgaccttctctgtctcttgtgacagtatttgacttaaactctatctcatctgttataaggatagccacctctgctttcgtttggttatcatgtgaatgcaatctctttttcatcccttcacttccagcttatgtctgtccttaaagctaaagttagtctcttacaggcagcatatagttagatcttgttttttattcactcatccactctctcttttgattggataatttaatacatttacatctaaagtaattattggtaggtaaaggcttactactatcatgttgttaattgttttctgattgttttgtagttcctttgttgcttctttttgtctcactgtcttcctttgtgacttaataacttttttggagcaatttgctttggttcctttctctttatgttttgtatatctactacagactttttctttgtggttatcatgaggtttacataaaatatttcatagttataaccatccattttaatctggtaacaactttgactgcatttaaaaatactgtattttaacttctcctcctcccacattttattattcatgccatagtttatatcttttgtatgttgtgtattcattagcaaattgttgtagttatagttatttgttaatactttggttttttaacttttatactagagttaaaagtgactgttgcacaataacagtattggagtattctgtatttgactgtataagaatacctttaatagagttttattctttcatttgttttcatgttagttagtgtccttttgtttaaacttgagaattccctttagcattttttgtaaggcaggtttaatggtgttgaaatcccacagcttttatttgtctggtgatatgatttgttcctgaacttccacccaaatctcatctcgaattgcaatccccaggtgtcaaaggagggacctgttgggagatgattggatcacgaggtgttttcccccattatgttctcatgatagtgagggtgttctcatgagatctgatggtttaaaagtggtggttacccctgcgcacatgctctctctctctcctgctgccttgtgaagaaggtacctgcttccccttcaccttccaccataattgtaagtttcctgaggcctccccagccatgaggaactgtgagtcatttagacctcttttgtttataaattacccagtctcaggtgatatcttttagcagtgtgaaaataaacaatacagagaattggtactggcagagtgaggtactgctataaagacaacctgaaaatgtgaaggcaactttgaaactgggtaacaggcagaggttggaacagtttggagggcttagaagataggaagatgtgggaaagtttgaaacttcctagagacttgttgaatggttttgaccaaaatgctgatagtcgtattgacaatgaagtccaggctgagatggtctcagatggagacgagaaactattgggaactggagcaaaggccattcttgctatgctttagcagagactggcagcattttgcccctgccctagagatctgtggagctttgaacttgagagagatgatttagggtatctgtcagaataaatttctaagcagaaaagcattcaaatataacctggctttttctgaaagcatacagtcaagtcatatgcgttcacaaagagatggtatgaaattggaacttatgtttaaaagggaagcaaagcataaaagtttggaaattttgcagcctgaccatgtggtagaaaagaaaaaccaattttctgaggaggaattcaagccggctgcagaaatttacataagtaatcaggagctgaatgttaattgccaaacaatggggaaatgtctccagggcatttcagaggtcttcaaggcagcccctcccattacaagcccagaggcctaggagggaaaaatggtttcatgggccctgctgctctgtgcagccttgggacttggtgccctgtgccccagccactccagctccagctgtgactaaaagggtccatagctcaggctgtcgcttcaagggtgcaagccccaagccttggtggcttccacgtgctcttgggtctgcgagttcacagaaaacaagagctgagctttgagagcctctgcctagatttcacaggatgtgtggaaacacctggctgtccaggcagaagcctgctgcagggacccagccctcatggagaacctctattagggcagtgcagaggtgaactgtggggttggagcccacacacagagtccccactggagcactgcccagtggagctgtgaaaagagttcccccatcttccagatgccagaatggtagatccactgactggaaagttgcaggcactcagtgccggcccatgaaggcagccgtaggggctgtaccctgcaaagccacagggacagagctgcccaaggccttaacagcccacaccttgcatcagcatgccctgggtgtgagacaggggctccaaggagattattttggagctttaaaatttaatgacttccctgctaggttttgcatatgcttgggacctgtggcccctttattttggccaatttctcccatttggaatgggaacatttacccaattcctgtacccacattgtgttttggaagtaactaacttgttttttattttaaaggctcattgagggaagggacttgccttgtctcaaatgagactttggactcggacttttgggttactgtggaatgagttaagactttgggggactgttggaaagacatcattggttttgaaatctgaaaaggacatgagatttgggaaaggccaggggaagaatgatatggtttggctctgtgtcctcatccaaatctcgtcttgaattgtaatccccacatgggattacatgggaggggcctggtgagaggtgattggatcatggaggtggtttcccctgtgctgtgatctcatgatagtgagggatttaaaagtgacagtttcccctgcacatacacactctctctctcgtatcaccttgtgaagaaggtgtctgcttcccctctgccttccatcgtgattataagtttcctgaggcctccccagccatgggtaaccgtgagtcagttaaacctcttttgtttataaattacccagtctcaggtagtatctttacagcagtgtgaaactggactaatacatctgggaaattctttttctctccttcctttctgaaggacagctttgcctgatattatattcttggttgccaggttttgtactttcaatactttgaatatatcatcccactctctcttggcctacatgatttctgctgagaaatccaccaataatcttatgaagcttcccttgtatgtgaagaattgcttttctcttgcttctttgaaaattctctctttgtcatggtgaggatttctttttttttttttttttttagatggagtctagctctgttgtccaggctggagtgcagtggcgcaatctcggctcactgcaagctccgtctcctgggttcacgccattttcctgtctcagcctctggagtagctgagactacaggtgcccaccaccacgcctggctaaattttttttgtatttttagtagagatggggtttcactgtgttagccaggatggtctcgatctcctgacctcatgatccacccatcttggcctcccaaagtgctgggattacaggcatgagccactgcacctggccgaggatctctttatatttaatctatttggagttcttttgggcttcataaatctggatgtttatttcatttatgtctccaaattttgagagttttctattcttatttttttaaataagtttctgcaactttctctttctctacttcttctggaactcttctaatgcatattaattttcttaacagtgtcctataagtcttgtcagctttctgcaatttttatcattccttttattactctgactgggtaatttcaaatgacctgtatctgagcatgctgattctttctcctgcttgatctagtctgctgctgaagctgtttgtgaattttttcaattcagtcattttgttctttagctccagaatttctgtttcattcttttttatggttcctatctatctttttgttgaacttctaattttgctcatgtattgttttcctgattttgtttactgtctatctatattgttttgtagcttattgagctttcttaaggcaattatttttagctctttgtcatgcagtaaagatctccatttctttagggtcacctcctgctgctttatttccttcctttggtggtttcttgtttccccgattatttgtgatcagtgtggccttgcactgaagtaggcacctatttcagtctttacatactagcttcagcagagaaagccattcactagtcagattgaccagagattgttggtgggctgtctgttggggtctatgcacaggatttctgctggagttctaaggtgggaagggctggattctgggttcattcactgtggttgtctgtattctgtgcacaaggactggcttgaagcatggatccttgggggctgacttggcactgaaatgagccttaagcctgcgtctgcaggggccagcctaacatggggatcacctggcacctgagttcatggggataggcctgttcctgagtttattcaggctgtcctgggaacaaggtccactggggtgagcccagcatctgggtccacatggcccagcatggagccaagatctctggaggctgacctggtgctggatctgcaggggatggcctggattctaggcccatgggtgccaacttggagcctggggttgctggggctaacgtggaggctagatagagtcttgggggccaggctagagctggagcaggcctgaagtctaggtcttgtgtggccatcttggagcctgaagccccaggggctgacctggtctggggtgagcatggggctgaggccacagaggctggtctggcctgtggcaggcctgaatcctggtgctggggtttactggagtgggcttggtgcttgggatctgtggtgaagttaggttctatcttaactgtccctcctccatgcaagagggcatctctctccatactgtgctgcccaggcttgaaggtgagatgacaccggtaatgtgaaattgtccttcctatacacttctatgtgtcttttcttatttctgtgctgcaaccaggtggcataacctctcacctgattccttagctctagtgaagttattttcgtgcatggatacttgttcgaattgatgtttctgcaagggatgagcgctagaaactcctgttctgacaaactcctattcctattcttgctgacatcactccctgaaatagttaatatacttaacagctgaacacggataggatgttcatggaatatgttgacaggacaaaaagttgaaactgttggcagaaacccaaagtcaatattgaagccaagcaaaatattgcctgcagtgccacattagaacagcttgaagaccgttcatttttaagtgacaagagactcacctccaagaagcaattgtgttttcaggtagcaaatttttattattctgattgtttccaaataaactataatttttaagtataattttttactttatgagaaaattaatcatttatattctaatttcctgagtatgtagagagtatagataatgttcctttatgtagaaatatttaaatgtaagatgattytaaatcagaaagaatatttgattgatttaaaatttttaaatgggctttaatattttcagaggttttctttacttagggatttttggactgacattattgccattatttattaattttgtttttgcccaaatcaagaggtttcataattgtttactctctctctaccaattccctttccaacattactagccacagagttggccaatgaacaataaacacaacagtagtctggaggtctcaatttgtatcttgggaagcattataaattttccaactccctagacacaaatgtaccaaaaaaaamcccttgttttctataccagtaatygtgtgctttgtcttgcaattcagacatttacaagaaaatctaaatcaccttaaattaagatttatgttaaatgtggtctaaaaccagcagagttatgtattgttttcttttttagaatgattttattcaagcaagcaacttatttcatttccttgtttgctacagtttcctgtggtaagtgaattatctataaaacatggaattcaggctaagacaggagtagccaagcaagtggcaccacccctggagaaagctattgaacatacagcttcgggggtggagattgtccctgatgattcaggacacrtgtctatttaatgttccacaacaaggaccacttgtcaggtatattgctgtagacatatgttgcagaccagaggaaggagctcagaagtaggaatgtcttgggacttgtgttaacaaaaacttctgttcgcagatgacactctgcaaagcaaaacttgaaacaaaaaaaaattagtcctctatttttattatcaacagtaaaaaattaaactttatctgaaaattcaaaagagtgctaggcattttatagtgtctgggtccaatccaagtatctgttaggaacaccatacatagttttactctggaccgctagggaaccatttcaaaaatgaaagtaactggtttaaatttaacttagcaaaccatgcatttggatagttctaggtgaatagctttcaacaccagatttagatctcatttctctattaatttcattaatttttggagaataaaaatgattctggacatttcattaatcattacagagggagttttctctgtgtccccacaaggcatgattctgggtctatggtgacttaagagggccacacaacaatgagtatttaattttcctcagatgtatggctacaataaacatctataggtaaggtttacattcataaagagacctttttttttccaggaaaaaagacttttattccccctaaatcacaactcccctgtgtctgtccctcaaccctgatttctcttctaaaccgtaatttacaaacccatgtgcaaacccactgaaaggtgagaaggagcataagccagagacactgggaaccacagccaactacagggggtttttcatttttttgttttgttttgttttttggcaaaataaatcatgattatggctaggaaaatcagggatgtaagtaagcaaaaatttagaaactacatattgcatgtagtccccaaattcagaaacagtcrtcgttaaacatcttttatttagtctttcagatatttttctacatatacctatttgcacatttcacaaaaaagagttattaactgtggacactctttgacttgcattttccacttatagctatcttttggtgcaaataagtaatatattttggagcttgctattcttctctttttatggtatttttgtgtgcacattcttatgctcttattcagttatttctgtagaatacawtttttgaaataaaaatactagattcaaaggtgtgaatatttttgaaggttttgtggtgtggtatcatgaaattaggtttcagaaagtttactccayagttgactttttctaccagctaataagagtgctcatttaccccacttaggccaactctaacaggcttctgttgctttgcatcctgacatatttatctttctggaaacagtgtcctaatttatttctgcagagctactgcctctcagttttggtccatgtggttctggtgaccctgattcttctgctgaaccagaaagtgcacacatcctcctggctgtggtgacccaatcagagccaacgtcttgcaatgaagcttttctttagacatctagaaataagactcttatgttttttttttccaatttgacttgaaacttaagacaatacacaggcctgagttgttggtactattttgctactacgtggagcttgagagtaatggtaacaccaagactggagcaagtggaaggagacatattgtccactgatgctatcagttgagcacaatgtgcagttactttttaagccagattcaccatgggctttttggctcctgaaccaatagatttcatttgttttcaagccactttgtactaggttttccatcatttgcaatcaaaaccagtatacaaacactggttatttaatttttcatttttgctaatctcagggataaaatggcttctagttgttttaacttggctatatttgtgattcttcccattttcatatacttactaatcacttctatttcttttgtaaattatcttttcatatttgttatctaattctttaaaatttgagtactttaattctcattattgtttgtggaattgttaaacaagactgaataatctgcccaaagtccatggacatgggggcccatgtaaaagctttgaaagccaccatcattatgagataaattatataatagtactttacataggctccaaaatacagcacagacacagctatcattgtcatggtcatcattatcatcatgatcaccaacttatgaggataagcaagaacacctactagaagtttctttccattcagcaacaaaattggtgtctttctagtcactcccttccctgactgtcacatagcagttcacagaggctcagttgcagaatgagaagctctgggccaggacctgccattgtatgcatccttgcatgggaactgggggctggaagaggagtgactgcttgataattatgagtcagtcaaaaccaccaactgtctgaaaaaaataggcctttttgtaactagtattgtcactaaaccaactcctccatgttttgtgcatacatgaaatctaggcaatacacttgtattcccaaaagcttccacttgaagagatctgtgctctttccaaatataaaccttaccygagaggtggtcatcttggccacacctcagagagggagagaggcagtcttgttgggttgggtggtcataatggggctcagggccaaatccccagggggtaggatagtgcagagaagatggcactctccagtgcttaataaaatgcacgtggtctaagctgcccactccctcaaaggcaataaaaawtaggtactatttaaattgaagagtaactactgccccagggaatggacaggttgtcattggaatagccatggttaatggtcccagttgacaactgaaatgaatgtgctacctgaacaggaaagcttattaaccagatttcaaagacagtctttcccggtaaatccaaatttacaaattaaagccagtaaagacaccgaattctctaataatatgtggggtgcagtatattttagagctgggaataattccaaacagcaaatagttcaaaatttattttcaatttagcatatgcatgcatttgcttaaactgtcttaaaaatgagtaaaaaayactgtcagtttgtttcaatcatactgagatgaggaacaatgtttagcattgcatgctagaaaaggacacaggattgggagtcagggctgggtgaccgtcacaggactttcactaactgtgtggatcttgggcaagtctgtgtgccctgagactcagttatttaactttcttttaaaaaacatagtccagatgcagataacaaagcctgcctctaatttcccttacagaattgtgagaagctggtggagatgtttgttacaaaagtgttttgaaaatagagcaaatattattctttttaaggcatgatgttttcatagcatgtcaggcaacaggaaaaaactaagttaggattttattttattgtggggaatttatgtgcaaattattgtgcaatttaatgaaaataagccaatgttttatacagaagtacccagaaaattaaataacactatacattgttcaaatagttgccttaatatattttattttctcagcataattagagttgtattatacaggtctttgagtagtcagtcagtgggagaagttaagacaacagatatctttttattaaaattattatatgaattatcgcaaattaatttttatggttctgtcacaggatgtctgactcaactctatgaaaacgccttcttcagaggtggggatgtagcttccatgtacaccccaaatgcccaatactgccagatgaggtgcacattccacccaaggtgtttgctattcagttttcttccagcaagttcaatcaatgacatggagaaaaggtaaaagttggtatttcattattggagaagctgtttttcaaaactgaatcagttttgtgcagaaaggtgtagtataactgagagttcttcctcacacggggttcaaggaccagcttcagcaaaatcccgtcaagtggttcttacaaatgcagattcctaggccacaacccagatctgctgaaccaaagtttcttgtgaccaggaatctgcattttaaacaatcactgtgtttctttaaagtagtagaagctagtcattttctattcaaagcctcaaaatgcttgaatatcattgggctaagggattgtctcaagaaagagtctaacaggtgaacatttcatcygaataaagaaacagatttaactgtgtgacccatgatcacattagcggatagcacagtccaaagaaaataacataagacaagcattttgctgagaatgtaattgagaaagatctagaacttgtgattttgggacagggcagttctaaatggggcctatagtgagccagtttgggcacctgtggcatgatgctatgtatggtgtgtgtgtgtatgtgtgcttgtgcttgtgtgaatatgtattattaactggaaatttgtaaaagtattggaaaaatagtacttacgattttgtgtgygtgtgtgatggagtctcgctttgtagcccaggctggagtgcagtggcgtgatctcggctcactgcaacttccacctcccaggttcaagcgattctcctgcctcagcctcccaagtagctgggattacaggcacgcaccaccacgtccagctaatttttgtagttttagtagagacggggtttcaccacattggccaggctggccttgaactcctgacctcgtgatccacctgcctctacctcctaatgtgctgggattacaggcatgagccaccgcacccagcggtaattacaatttttattaggtcagagagatgcttattaatcacgagccacagtttcttcttaatgatttttccttttgattaatatccagagtaagcttttctttgttgttcccatttccatgttcataactctttactcatcttcactctatgtgagtttaccaactagaaattggatagtcattctctgatcccacatgttaaacttgtagagaaaactcagattgtatgtgaggatcatcatattaaaagtggaggaaggttctagaattcttataaataatgaaattaacatgaaggtggacatctaagacagagggaagtcttccattaagtgcagactacaaggagttaataagcaagatgaacacgatatacaaatccagctcttatcactaagttaactttttaagtaaatgaaagtatttgcaaaaataattaccaattgagaacatagttgcctgaaagtttaagaacacaggaaaaatcattaactctttaatayggttgatttcctgtacttaaaaaatgtgagtgtaaagaaaacgcagtgatggagttagatattatggggtgttataaaattagctctaagagtgttctttccagcaagtattggggaagctatattattttccttattcctggttttatttgttagtgtgtagaaaatgctagacatttcctcaatgtatgtttattattctacttcctaagtaaagctacttttaaaataggtttggttgcttcttgaaagatagtgttacaggaaccctgccaaaagtacatcgaacaggtgcagtttctggacattccttgaagcaatgtggtcatcaaataagtggtaagttgtgaatttcttagctacatttgagttaatattggatctcgcttagaacagcttttgctcaaagtttgtactgctacagctttttggaaggcatcactcataaagataggagatggggcagtattctggacacaaaagagggacccatattcatctggacacttctattgtctttataaatcaacacatacttaatgagcctctattatttatgaggttagcgctcaagtgtaagatttgcagaaaatgaatccaaataattgtgtctcgtttccagataagaatttttaagaaaacacaagggaacatctctctcaagttcacttgagggtaatttttacatcagtgattctcaaccagcagtgattttgtctcttccactggggacatttgacaatgtctggagacatttttggtggctacaactagggaggatgctattagcatttactaagtagaggccagaatgtttgaatgctgaccaacattctacaaggcacagggcagtcgtccacagcaaataattttctggcccaaaacgtcaacagtgctgacatcaagaaactctgtgatataccactaggcccaaattgaagaactgagttctgcaaatcttgctaagaataatacttcctaaaggaaacttgaggactaggatgctagagaactttgattctgacatctgaagctactgatgtcttgggaaacagtttccaatgctatcctaataaatttaagacaaatgaactatttctcaaacatgactgggactgataagaaagtgaaaagtgctgaaaagattcaactgatgggttgtcagaatcttaaaataactgctgttattctatgtatgactatatatcattactattttattttcattatgcacaattaattttgtaggttcaaatttcagatgtttttaaatttgtcatcctttcctccctcattgatatcacctcttcaatacgtacacactttgagcctgctgtttgcattttaaccagttatcaaaggatggcaatgccttcattataaatgtgggcctgacttagccagtataataggtgtagtctacgtgaggtggagtacatttcctattttaaaagatcaatttttatgttaatccaatttggtataaattattcgagtaagtgctatttctgattgttgtatcttgtagcaaaatttaaagaaaaagtaatttgtgcctttctcaatattcctgttattgttcatgtattctaaaactcastgttactcacttagcttgcttttaatgttttttaaagtgaaaaattgttcccaagtacataaaatctctacactcaagaacaattctagtcaaaagcatttagagcttccgtatgaacacttaaagagtttttatttgtaagagtcgcatcccaactcttagcctgttcttttctcacatgcagaaaaataggaaagagacttcgtttccacagtctgcaaattcctgtgtttaagaaccacagtgaataatccacctccctgcccaactcatcgtactgtcatatagttttcctgacagtttgtgtattttctgtctttcccacccttaaatttagttttatgacttcaaccatacttcttaggagtggaaaggtatctgtagtagattatggtttattccacataatcttggggaataaaactttaaaaaagtatacagtttatacttctggttacattacttccttaaccaaaagtctaaccaagaaatttgaatctttaaaaaaaaaagaggccgggcgcggtggctcacgcctgtaatcccagcactttgggaggccgagacgggcggatcacgaggtcaggagatcgagaccatcctggctgacacggtgaaaccccgtctctactaaaaatacaaaaattagccgggcgtggcgcgcgtgcctgtagtcccagctactcgggaggctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctaattttgcttcactgtctgtgaaaagaattatctgtatcttttgcatgtaagacaaatctcaatgaaaagggtgcttaaatagaagttaacactattttaaagcaagaatggaagtggtttcatcatgcgtaaacaacaactctccacattttgtaatgattgatctggatgcaatttgtcatcagacaggagaagtcgaaagcaaagaaataacactgggagatagagaagctctttcattcaatgcgaaaggtcaaaggcacatcagtttctttaataatgcaaacctcagcacacattatcagtgtcctcattattattgscttgtttatttcccactgctcattgataatttcaaygtgaaatttacctgtattgctgcatgcatcttgcagtttaagaagtgaagtaacccaatttcaaagctagtgctttagggaaaatattggattgtatttacttcaagcagagttcgataatttatgtacataataaaaattttaaatcccttasttaatatagcagttgccaaaactgggctattatcattctaaactaccaacccaaatggtagtgggtatctaatctacctctagaaagaaaatggactgtatttgctctatgtatttttcttgtacagcttgccatcgagacatttataaaggagttgatatgagaggagtcaattttaatgtgtctaaggttagcagtgttgaagaatgccaaaaaaggtgcaccartaacattcgctgccagtttttttcatatgccacgcaaacatttcacaaggcagagtaccggtgagtacaattcaaggtgtgtgttctttgtattggtgcctccaggatttcactgtattcttcttaacctcttttgttcccaaactaaaaaccaaacagggcttttattctaaccactttcctcatttacttactctattttatttttttatcttttatttatttatttatttattgagatggagtcgcgctctgtcgcccaggctagagtgcagtggcgtaatctcgactcactacaacctccgcttcccgggttcaagcgattctcctgcctcagcctcccgagtagctgggattacaggcgtccgccaccatgcctggctaatttttgtatttttagtagagtcggggttttactatgttggtcaggctggtctcgaactcctgatcttgtgatccacccacctcagcctcccaaagcgctgggattacaggcatgagccactgcggcctcgcccttcattttttaattaaaataattcatttaatttcatttgtttctctactcttttcccctggcatgtaattgtaccgcatcttcaaagcctgacatcctcttcccctacttctccaaagctgattcttgcaggtctttcctcaaataccgtcccctccaaaagcccatttctgagcattctcttttaagtcacactcagctctgtttatttcattcatagagctaatcacaatttgatattaacttgtgatttttttccttatttttaaatcttatttttatttgcatagatgtatggggtacaagtgtaattttgttactttgatgtattttacagtggtaaagtctgggcttttggtatatccatcactggagtcatgtacattgtacccactaagctatttttcaacgcccgcccccttcccacctctctgtcaccttcccagtctctactgtctatcgctccatgctctactcaattttggtgtcattttttcctgaagcaaaattttggtgtcattttttctgaagtcattttctgaagtctgtgtcatttttcgctttcctgaagcgaattttggtgtcatttttcctgaagttccgtttgccccacacataggccttgcttatagaatgagggtttagtgtcacggagtctcctgcctcattctcaccctaacttttcctttacccctttgcgaggggaaggatgtccattaggttaataatgcagacccctaacccactcattatcagggtcattgtttttccactgtgcattttaatactaactgttacctgcactgctccctgcccctcaaagtgcagaaagcaaagtaacctcttttcttcccattcaggaacaattgcctattaaagtacagtcccggaggaacacctaccgctataaaggtgctgagtaacgtggaatctggattctcactgaagccctgtgccctttcagaaattggtaattgtaggactacttcactttgtgattgtggtaggtggaataggagcccccagagacgtccctgtgctgagccctgggacctgtgcgtgtgttcccatagctggcaaaagcgtttctgtcaatggcatgcagttacgggcttcgagatggggagtttactctggattttctgaatgggcccaatgtactcacagggttgagtgctcacaaggctcataagaaaaagagagaggcggaaggctcagagccagagagagaggtttgaaggtattacactgctggctttgaagatgaaggtccgtgagccaaggaatgcaggcggcctctagaagttgaaaagggcgaggaaagagtttccctgtggagcgtcctggaggaagaagccctgctgatgtcttgattttagcccagtaagacccaatctctagaacagtaagataattaatcatgtgttgtttttaaccactaagtttgtggttatgcccnnnnnnnnnnnnnnnnnnnnattatgtctgacagaagggaagaaatgaccacggtggccttctcagaccctgtgggaaaggcctctacccatccagtgaaagtgtctacccagaccaagaggtattttagtttcctgactccgggtatgtgagtaaagtcaatctgccagtcctgggcgggggcaaatccccgagcttgatgtgtagggaagggagggggcctgagcaatccctgaggaggagtgagtagcagatggaacactgagcagttattttttgaggatagatttttacgacggaaaggaaaagtgaggttttaagaggtgggttagtggcttgtaacttacatggaagagtttatgaaatgatgacagaatagaatgggcctgtgaggctggaggagatattttccttggtccaagaattatttgccttgtgtgggaagagattgataggtggaagtttcaatgggggagtagatgggagtgacagatgaggaagaaaaaaactggctgtgagggatagaagttggaatgctcgctgcttttttagctaccttatcagcataggcattgtcctgagcagtgggatctgatgccttttggtggcccttgcagtgaatggcttcagcttcctttggaagtaaagtggccttgagaggagtttttattaaagaggcattaagatggagaacccttgtgtagtgaggaaacctccttcagcccatataaccgcatggtggtgcagaatatggaaggcatatttagagtcagtataaatattgacacgtagtccctttgcaagagtgagggcctgagttaaggcaatgagttcagcttgctgagaggtagtggagcggggcagagcagtagcctcagtgatagatgtggaagatactacagcatagcctgcctttgctggtgagtggtgattaggcctggtggaactgccatcaataaaccaagtgtgatcagggtaaggaacaggaaagaaggaaatatggggaaatggagtggatgtcaggtggatcagagagatacagtcatgggggtgggggccagcctaaaacagtaaggtcaagttgtttgaacagaaaggctacagggcgyggtcctggctcttgtgtaagaattttgactgcgcagccctgcacttcggctgtgtgtaatgaaaagggttgggatgagttagggagagctagtgtgggagcagtttctagggctgtttttaaggaatggcaagaggagtggctaaaggatttaggatctttggggtcagctagctttgcttttgtgagtttatataatggtttagtcaggatggtaaaactwagtatccaaaggcggaagtacttaaccatacctaggaagaaaaggagttgttttgtagaaggggttggggtttgggagatgagccagacacartcagcagggagagcacatgtgttttcatgaagaattatgccgagataggtaatggatgaggaagaaatttgggcttgactgaagtaatgggggctgtcctcgaagccttgtggcagtacagcccaagtaagttgctgaggctgacgggtgtcagggtcagtccaagtgaaagcgaagagaggctgggatgaagggtgcaaaggaatagtaaagaaagcatgtttgagatccagaacagaataatgggttgtggagggaggtattgaggataggagagtatatggctttggtaccatggggtgaataggcaagacaatttggttaatgaggcacagatcctgaactaacctgtaaggcttgtccggtttttggacaggtaaaatgggggaattgtaaggagagtttataggcttcaaaaggccacgctgtaacaggtgagtgataacaggctttaatccttttaaagcatgctgtgggatgggatattggcattgagcggggtaagtgtgattaggttttaatgggatggtaaggggtgcacgataggttgccaaggagggagcagaggtgtcctatacttgtggattaaggtggggacacacaaggggaggatgtgaaggaggctttgaactggggaaagggtggcattgaggtgtggctgtggcctaagaacagtcagggaagcggataattgagttaaaatgcctcgacctagtaagggagctgggcaggtggtgataactaaaaaggagtgcataaaagaatgttgtccaagttggcaccagagttggggagttttaagaggtttagaagcctggcggtcaatacctacaacagttatggaggcaagggaaacaggcccttgaaaagaacgtaatgtggagtgggtagcctctgtattaattaagaaggggatggatttaccctccactgtaagagttacctaaagcatctgtgatggtccaggaggcttctaaggtgatcgggcagcgtcagtcttcagccgctaagccaagaagatctgggaagcagtcagtcagagagccttgggccagagttccaggggctctgggagtggcagccaggccagttagacagtccgatttctagtggggtcccacacagatgagacacagcttaggaggaatcccaggctgcgggcattccttggcccattggccagatttctggcacttgaaacaagatcctgatggaggaggtcctgtaggaatgcttgaccactgcagtttaggcattttgaagtttttgtgtgtgstggagatgtggctgggttttgtctcacagcagaggcaaggaatcrcaactcagaaatacattgctacttggctgcctctattattgtacaccttgaaggcgaggttaattaagtcctcttgtggggtttgagggctggaatctaatttttggagttttttgttttttgttttttgttttttkttttttaatgtcaggagctgactgggtgataaaatgcatattgagaataagaggccttctgacccttctgggtctagggctgtaaagcgtctcagggttgctgccaaacgggccatgaactgggctgggtttttcatatttgatgaaaaagagcctaaacgctaactgatttgggagaggtcggataaataaaaaggaacattaatcttgactatgcctttagctccaaccacctctttaagaggaaattgttgggcaggtgggggagggctagtcgtggaatgaaactgtaagctggaccgggtgtgaggaggggaggtgatagaaggattatagggtggaggagcagaggctgaggaagaattgggatctggcttggcctggcaaggagcagcctggggaggaggggagaggtcagatgggtccatagaaaaggaggattggaaagactcagcaacacttggggttgggattgagaggacagatgggttgggattgaggggacagatgggagggaaagaaggaagatttgggacaagttgcattgggaacagagactagggagggaccaatgtgtaaaagaatgcctggacgtcaggcacctcagaccgtttgcccattttatgacaagaattatctagatcttgtaggatggaaaaatcgaaagtgccgttttctggctatttggaaccattgtygagtttgtattggggttaagcagcattgcagaagaaaataaggcatttaggttttaggtcaggtgtgagttgaagaggttttaagttcttgagaacataggctaagggagaagaaggaggaatggagggtggaaagttgcctatagtgaaggaggcaagcccagagaaaagagagggtagagacatggagagaaggggtsggggggtgcttgcccccaggaaagtggttcttgccactaagggtgaaggatcaaggcaggcattcgcgcggtgatcagatacctctgaaacgtgggtgaataatcaagcaggtgtccctgcagtgattaaacagcaaggaaagactatcttcccaagtccatgaccagtgccagagttttgggttcatggataaaacgcgtctcctctgtctctaccagaaaatgaaaggaattgaaattaagagaagggagagattgaaggatggcgccaagattgaaaggaaaaagaggttgagggatagggagagaggttggataagagagtaaaaagaggctgcttacccaatttaaaatcggtgagatgttccttgggcttgttggtctgaggaccagaggtcatgggtggatctttctcatggagcaaagagcagggggacaggggattgatttcccaagggaggtcccctgatctgagtcacagcaccaaatatcacgtgtgtccatgcgaagagaccaccaaacaggctttgtgtgagcaagaaagctttttaatcayctgggtgcaggcgggctgagtccaaaaagagagtcagtgaagggagataggggtggggacgttttataggatttgggtaggtagtggaaaattacagtcaaagggggttgttctctggcgggcaggggtggggggtcacaaggtgctcagtgggggagcttctgagccaggagaaggaatttcacaaggtaacgtcatcagttaaggcaggaaccggccattttcacttcttttgtcattcttcagttacttcaggccatctggatgtatgcatgtaggcttgggcccagaggcctgacatttaacatggataaatgtaaagttcttagaatcatacatacacwttggaaaagatggggcttaatcgcactttataagacttgaaggatgtttgagaatcactatgaaactgctgaaaataccaagaaaatttaattcttatgtatataaataatgtgtctgttttacatgaatcccttctacaagcttggtatttaatatggcatatattgttttttcatagtagatttaaaatttttgatatctaatttagataacataaaattaaccctttgaaagtgtacaactccgtggtttttagtatatccacctgattgcacaacgatcaccactgtctagttccagaacatttttatcaccacaaaagaaaggctgtatccaggcygggcacggtggctcacgcctgtaatcccagcactttgggaggcygaggcgggcggatcacggggtcaggagattgaaaccatcctgggtaacacggtgaagccctatctgtactaaagatacaaaaaaattagctgggcatgrtggcagatgcctgtagtcccagctactcaggaggctgaggcaggagaatggcctgaacccaggaagcggagcttgcagtgagccaagattgcgccactgcactccagcctgggcgacagagcaagactccatctcacaaaaaaataataaaaataaaataaaaaaaaaaaagaaaggctgtctttctcctttcccattggccrtctttctccattccctactcctccaatcccctggcaaccactaaatctactttccatgtctgtggacttgactcttcgggacattttacataaatggaatcatgcaatgcagcacattttgcatctggcttttttcacctggcgtgttttcaaggctcattcgtattctagcatatatcartactttgttcctatttaggactaaataagattctattgtatgaataaaacatattttgtttatatacttagtttgatgaacatttgagttgtttctggatttttttttttttttttttgcctcttatgaataatgctgctatggacaacagtttttgggtaggcatgcattttaaattctcttatgtatatacttaggattaaaattgctggatcacagagtaactccatgtttaactttttgatgaattgccaaactgtttttgagagcagctacacaatgttacattcttaccagcaacaattgagggcttcagtctctctacaaccttaacaacacttgttattgtctttgtaattattgcctttctaggcagtgtgaagtggtgtctcactgtggttttgatatgcatttccctaatgactaacaatgttgtgtatcttttcgtgtgctcattttcaatttgaatacattctttgggaaaatctctgtttaaatcttttggccattaaaaataattgggttattttcattgttgagttgtatgaactctttatatactctggatactacactcttatgacatatattattttcaaaaattttctgtgcatctgcaggtcatcttttcactttactgatggtgttctttgaagcaccaaagtttttaaacttgatgaaatccagtctggctttattcttgcacgtgctttacctaaaacgccaaaacctaattcatggttttgaagatttttgcttatgatttgttcttagaggtttatagttttagctcttacatttaggcatttgatgcattttaaattaaattttgtatatggtgtaaagtagcaatccaacttaattcttgcatgtgggtattcagttattccattgycttgaaacccttttcaaaatcaattgtctataaatgtaagagtttatttttggaccatcagttctatcctgttgacctatatatgcctatcctaatgccagttacacacagtyttgattaccataactttgcagtaagttttgaactcagacagtctgagtgcttttattttgtcctttttcaagattaatttggttattcyggatcttttgcatttccatatgaattttaggatggttgtcaatttctgcaatagaaaagcagcaggattttgatagagagtgcattgaatctgtagaccaatgagtatcaatggaattatgtgttatcaaatttagtaaactacataaacgatatgtacacaactaaaacaaaactaagatataagatcatattaatgtaatgataataaaagtggattgtctcctgttctaattttaataggcacaaggcatttttgttaatcacttcttattaaagaattttttataatattcaggaaaatacaacaaaaaaacccttacattcctaaggcctcagagtcagagtaatataaaggaaatgtaaacacatgctgagtaatgcaagcatttggcaatggtggtgactggagctgggagcacagcttttatttctctgaaataggaatttgccccttagagttagaccaattttgccttcctctaaatggcaaacagtttggagatactttaaaggacattttttcacttaggatgtttagtactatgaataataaatagtcacaatttccttaactatggtgacaaaatacaagcaaattyagcctcrtgtcatttcctaaggaacatcttctctctgtgagttcacaggttgccamatgaacatcttccagcatcttgmgttctcagatgtggatgttgccagggttctcactccagatgcttttgtgtgtcggaccatctgcacctatcaccccaactgcctcttctttacattctatacaaatgtatggaaaatcgagtcacaaaggcgagtatgcatggaaaatcgcatcacaaaggcgagtatgcatggggagcacttgctgctgtactttcatcacttttatagtctgagttcttaaaagtttcgttcatttccctcaaaacacttgaacctgcagtttcagtaggtactgttctgccaggtgcagattagttaagagattagcagacttctctgcctatcttctcttactttaaaacaaatgttaccattgaatcaaggaagcaatagccatgagaaaaaagaaggatctgacgcctttgaatgaagattcaaaacatgatcttcatgttttgtattagcttggagtaaaatccacttgctggcaatatagcccttaagcttgttgcctcttctctttgtttcagaaactagagccctgtttattctgatcaaggctctggcccactgtctttatctcagataacccaccctcttctgcacacagcatggagctaagagaagggtgtctagttatgtaatatcatcggcagcataaattcccagaatttgttctttgatttttttgtttgtttttccagttagaaggtggaacttcatcattgtcctcttttcaggttgtctgtgcctattagttttctccagagggagaggtggcttgatttacatttaatctctgcaatttattagagtcctgtagttggatttactttgaagagagtttcccagaagaataaaatttgctgcrttgctttttgggtgtgagctgcttttgtatttgcctaatgcctttaatgcaaatttctttctttctctcttgcttttttttaaaaaaaatagaaatgtttgtcttcttaaaacatctgaaagtggcacaccaagttcctctactcctcaagaaaacaccatatctggatatagccttttaacctgcaaaagaactttacctggtaatgtgatttgataataatattacataaaatgtaacctatttcatgacttttaacagcaacagtgatgaaacaatcctcaaggtaacagaaacttgtgtaaatgtcgttcattgcttttcccatctgatatctttttgtgtttataattgacacagaaccctgccattctaaaatttacccgggagttgactttggaggagaagaattgaatgtgactkttgttaaaggagtgaatgtttgccaagagacttgcacaaagatgattcgctgtcagtttttcacttattctttactcccagaagactgtaaggaagagaagtaaaggaaattttatttttcaaagacagttgacatgaccatttcatattctctttccccctgtgaaggcttactctttctactgttcatttcatctaggtgtaagtgtttcttaagattatctatggatggttctccaactaggattgcgtatgggacacaagggagctctggttactctttgagattgtgtaacactggggacaackctggtgagtaacctcactttttcgtggwcctgtcagggatgtctgtcatgttgatagtttgcttagtcttaaggaattatgtgtcttgttctccttggttagaagggactttgattcacttctaattccaaccattagcgtcaacgctctcttttcagtctgcacaacaaaaacaagcacacgcattgttggaggaacaaactcttcttggggagagtggccctggyaggtgagcctgcaggtgaagctgacagctcagaggcacctgtgtggagggtcactcataggacaccagtgggtcctcactgctgcccactgctttgatgggtaagtgttggatgcatctcatccagagtcttatcttggcttttcattttgaaggatctatgatcagctgcttcaccgccatgtgactttatgaatagagacgtgttaaagcggggatggtattcacaacatttaacttatagggtccaagcactgaccaacctgaccattagaacagagtgtggtctctgtacagggcagatggcrctgagtgggtattctccacagaaasagaaacgaagacagtaccccactcctccaacccaccacccaccaccaatcccaccaccaattccaccaccaatcctgccacccaccaccaatctcaccaccaatcccaccaccaatcctrccacccaccatcaatctcagcaccaatcccaccaccaatcccaccaccaatcccaccacctaccccaccaccaatcccgccacccacgaccaatcccaccaccgatcccgccaccaatcccaccaccaatcccaccaccaatcccaccacctaccccaccaccaatcccgccacccacgaccaatcccaccaccgatcccgccaccaaccaccaatcccaccaccaatcccaccaccaatccctgatgtgttcttcaaagacttatttgtcaggcccatagaaatgttacttcttgctctttgattcataaatatactaagtcataataatttttaaaagtgagagtttcgtactctgtatatttcaatgtatataatttgatctatttcaatttattggtcaaatagtagacatgttaggtaagtcttaaaatactgaggctttggagttagacagaacatggcttaagtgacagctttgctgcttattagaggtgtggccctagaagatttgtaaatccctctgagctttatttgatctaaaatatgaatagtaatagtcccgaatttgtaacgttgttgggaagattaagtgacacatttaaaatgcttagtactgtgtgtagaacataaacacttcaaaaaatgtaaactgtgatttctatattcaataagaaatgtagmaatggacaaagcatataaaaagcaaaagaaatactagaagacacttgatttttctcaaaaataaacacaccaagtatttttgttttagtgaaattcatgcttacatgctgtatactaggattgaacatactgccaccaaaatatagcagtcggtggtacatgtgggtggagcaagacccctccaccttgtcatcgtgtgaaggggctctgccatacatgaccttgcatgtgactttaaggtggttggcctggaagaaaagtcccaagatgggaaatagtaggtgtcttttttactaaatgcactccaatttgggaccaaraattttcattcttgaaggctcagtattgtgagtttataagagataatagacataaaagtgtaatgatttcattgcaaataaaaaaaggcccctttgcacctgatatctccatcatttttctagaattttgtgcacacatgccttgcactacttggtgatgataaagatttccagatctttgcacagaataaggctttgctttagatcagaattttggatgtacttagtatacattcatcttttaaataatctatttacattttcatactttccaaaatacagatatattttattttatttatatatttatttaatttattttttgagatggagtctctctctgttgcccagagtagagtgcagtggcacaatcttggttcactgcagcctctgcctcccgggttcaagcgattctcctgcctcagcctcctgagtagctgggattacaggcgcgcgccacacctggctaatttttgtatttttagtagagacgrggtttcatcatgttggtcaggctggtctcgaactcctggcctcaagggatccacccayctcggcctcccgaagtgctgggattacaggtgtgggccactgtgcccagctgtatagagatattttaaacaacactaaagtcctcctactttgactaattagaagagcattagaagatcagcctgacttcttgacagttctgaatttagtggagcaatgaggttcagctttggtgaatgagcttaatttttccatgataaactgctagtttcttcccactayagtgtctctcaaaaatgggacagcaacattctttttgttttcacttgcagtaagcatgatgcaattacataaatgtacacttttcaatttgttaaatagaatcttcagagattcactactgccgctattggtgatgaaaaattaccagaaggaggaattaggtaggagaaaatgtgtcctatgtatttccttcccagttctttgaaagagagtgataggaaaaaggaacactattgaaggaaggactgcccagtttcaaacaggwatttatttttctcycctaggcttcccctgcaggatgtttggcgcatctatagtggcattttaaatctgtcagacattacaaaagatacacctttctcacaaataaaagagattattattcaccaaaactataaagtctcagaagggaatcatgatatcgccttgataaaactccaggctcctttgaattacactggtatgtagcatatgtaagaaggtggagagcagaattgcgctggttgatattttcatatcagtttgaacaagagggcagacctagagagactgtcgtcgttttctgactggtggagttgagggaaacgtgagggttgctgggaagtgaagaccccgcgacttgccgtgaaatctcttctacttaaagagcaagacatgtgaattaattctttcagggagggatacaactgcatgcaggtgatggaaataatgggcgtgggaaatgtctgtgccgtctgagaggcactgggcttgctttgacaagagtagcagaactgtcattgctttgggcttagggatattcgaatgtgtgagggcaagtgggatcagatatctacttccaggtataatttgggtaggaaagagactcatgcagaaagaagccctggaaggccagagcatcgtggtcagaggtgttgcctttggagggtcattgctgccaggagccgaatacccactgtatccaataacattcatggtcaggaatggtggctcacacctgtaatcccaacactttgggatgcccaggtgggaggattgcttgaggccaggagtttgagaccagcctgggcaacacagtgagaccccgtctctacataaaattagaaaaaaacaattaactgggtgtggtggtgtgcacctgtagtcccagctagtcaagaggctgagayaagaggatctcttgagcccaggagctcaaggctgtagtgagccaagatcgtgccactgcacacaaacaattatgtgacctcgggcaagttgctttacctctttacacctcttaatttccttatctgtaaaatgaggatgataatttcttcctgggtctgttgtaataattaatacatcaaagcacttcatgtctggaacagtgaagayaccctgctatgactattaaggatagtatacatggaataagacacaggaacttctaaatgcttttgaccatagatttaggttctgagttttaagaatttaactcaggaaattgtaacaccaaaaatgtcatgtgaaaaatggtggtgacaaattttcttgaatcattagccttagaggttgggcagaaagcaaaaaattattcttgatgctactctatagaaagagaagacagaaaaagagaaagatgtatttttaaagtctatatccataactttatttgaccaaactctaatttaaaaattatgtttcagaattccaaaaaccaatatgcctaccttccaaaggtgacacaagcacaatttataccaactgttgggtaaccggatggggcttctcgaaggagaaaggtaagcatgacgctttaaatattgcttctagagtaagtctcacatgttgaaatacatggagtgggtcgttttaatcggtttctgtctgaaattatatckaaactctttatctttcctatctatttattcccaaatatttattcagttattcttaaaaaatgtatttttgctttggcttgaaaaaaaattttagggagacttttaagcatcttacttcattataaagatcagttgcttgactttgcatgaagcagattgggcccttctagggctgacaagcccgtgcaagaccacccgctcctcagtgttagtagcgttcccgtctcccaaaaccatgttctcccttgatgctaatggccgggagcacaggcaggtgtgtcgtctcactatggagaataatatttgtgtcattctttacagaagaaggtagcttgccaaactgtctccatctttcccgattcagtcttttgttcaagtaattcacatttttagattttttattggtaatctgagacaagaagaaatttaaagtaatcttcactaagccatgaaagctcccaacattgttctccrtgagagatgctggcctgcatttattcaaaaacaaaagacccctctgttgccaaagctcggagggcttttcagaaacgatatagttgtaaattataattttgaatatataaagcaaaaaaatgaaaagtgagaacttccaggctttggattgttgtaggtgataaatataaaatgggatttctggggggctgctactgagwtgaggggatggcagaaaacatggaagcaaggtctctggtcagcccagggtgctgggcttgtcccaacaccacgtaggcaataagaggacagtacagggkgccgtctctctccctcttcctctctctgtctctctctctgtgtgtgtgtgtgtgtgtgtgtgtaacactaycttcccaatttttactgtctatttgtattcaaagataaggtccttatgaaaaatacactgctctgattcactttaaaacttatttccatatttattatttattgtgggaataayaatattcccaatattattatttattatttaagttattattattaacttccctctgaggttatatattggttactcacaggtgaaatccaaaatattctacaaaaggtaaatattcctttggtaacaaatgaagaatgccagaaaagatatcaagattataaaataacccaacrgatggtctgtgctggctataaagaagggggaaaagatgcttgtaaggtaactcatgagattatgaaaaacacaataggctgcttgagaaaattcatttcaaaatatattttccaatagcataattyaatcatagtttttwaaaaaattcagagacaaatgatctgataaattgataagcaacttttaacaaattgaatatacataatatatatttatattatttatgatatatgtcacaatctatgcatgtgctatttaagaggggcaaatatacatgcaataattgtgctagaatataaaaacattagacttctttrtcattgggatgatgatatcaagatttctttgttagatttatttcagatagaaaaggggatacgaaaaatgcaggcacatgagatacttggagaactttaagaaagagtgagtgtgtgtgtgtgtgtgtgtgtgtgtgtgtgtgtctggcaagcaaggtcttgcacacacrcagcactttgggaggccaatgcaggtggatcacttgagcctaggaatttgagaccagtctgggcaatgtgatgaaacccatctctacaaaaaaatatgaaagtatctgtgtgtgtgtgttgctgtgtagtggactacagaactttagaggcagtcacttatttgaaycccattgycgtaactttctactattttatttttccactgtgactcagggagattcaggtggtcccttagtttgcaaacacaayggaatgtggcgtttggtgggcatcaccagctggggtgaaggctgtgcccgcagggagcaacctggtgtctacaccaaagtcgctgagtacatggactggattttagagamaacacagagcagtgatggaaaagctcagatgcagtcaccagcatgagaagcagtccagagtctaggcaatttttacaacctgagttcaagtcaaattctgagcctggggggtcctcatctgcaaagcatggagagtggcatcttctttgcatcctaaggacgaaaracacagtgcactcagagctgctgaggacaatgtctggctgaagcccgctttcagcacgccgtaaccaggggctgacaatgcgaggtcgcaactgagatctccatgactgtgtgttgtgaaataaaatggtgaaagatcacgattagcaagtgttttcttctggttgtgaaacagaactgaaagtaagtggtcgaggttccagcacagttcctgggatccctctaattgcactgcttcctctggaactcagtatatctcaaagatgtaatttcctctccgtgctgcacctggtcggccactgaaacccactattgcccgcttcacgtgtggcaaagagctagcgggcttgggttttgttctgccgagaggaagggagaacacccacttttataagaaagagatgggttacctgaacccatgggcacctttgcctcttggcctcctaactttgctaccagggcatggctaggagggtccaggctgcgcgtgctgaggagctcgaggggctgcagcattgcacagccttcatggcaggcaaggaatctgctttgcaaggggcattagccctggaggctcagtggatatgggctattgcaatagtaattcaaggagcatttttaggcctggcatggtggctcacgcctgtaattccaacagtttaggagatcaaggcaggtggatcacttgagcataggagttcgagactagcctggccaatgtgacgaaaccccatctccacaaaaattagctgggcatggtggtgcgcacctgtaatcccagctcccccagaagctgaggcaggaggaccgcttgagcccggggatgtcgtggctgcagtgagctgagatggcaccactgcatcactgcattccagcctgggcaacagagtgagactgtctcaaaaaaaggaagcattgttaggtataaattattattattattattattagtagtagtagtagtagtagtagtactgagacggagtcttgctctgttgcccaggctggagtgcagtggtgcaatcttggctcactgcaatctctgcctcccgggttcacgccattctcctgcctcagcctccggagtagctgggactacaggcacccgccactgtgcttggctaattttttgtatttttagtagagacgggtttcaccatgttagccagaatggtctcgatctgctgaccttgtgatccacccgcctcggcctcccaaagtgctgggattacaggcttgagccaccacaccgagccctgttaggtataaattatttcataaaattcagacttgtaaatttatggtagcctttggaatgggtgatagatgtcctatgccacacaaattcctcacatgccgaggctcaccgtaactgataccagctcgcttgattcagttcagttaaactgaacaacatttacacagaattggcgatttacaaaatcttatgtaagttaagtagaaaaacagaaaaaagttttctgaaagagtttgggtttttccttcaatgctcaagacagaggtccccaacctttttggcaccagggaccagttttgtggaagacagtttttccatggaccagcatggtggtgggggatgattctggaatgattcaagtgcatgacatttattatgcactttatttctattattactacattgtaatatataatgaaataattatgcaactcaccataatgtagaatcagtgggagctctgagcttgttttcctgcaactagacagtcccatctgagggtgatgggagacagtgacagatcatcaggcattagattctcataaggagcctagatccctcacatgtgcagttcataacagggtttgagctcctatgagagtctcatgctgctgcggatctggcaggaggcagagctcaggcggttatgcttgctggcctgccactcacctcctgctgtgcggcctggctgctaacaggccatggaccaggtactgttctgggccccgggggttgggaacccctgctcagagacacaccgggtggtaggaggagctaaaggtggagaggctgaaggaaaatatgaggtctgggctatccacaaaccagatagcaggaaactgaagagttaaacatttacttcagaattgaatggcttttgtaaaatctggctagattccatgaaacgattttaaaaatgcactatttaaattttgcctttgcatgcgatgaagacattagtctttgttcatgtggatgtttttttatgtttaaaagggaaaaaatggtttgcaatgaaacttttatctcagtctttgagtattgatcatggggtgttggaacaggactttggaatgcttgcagggtaaacctttggcctctgttagtcagggaatgaccyagtttggcaaaacagaggagagttttgaaatatggaactttcccgaggcatacattgtcattttaaagtggtcaatcaaagcccagtaggactgggctggtgtcttggtgactcactgtgtgctcatatacaggggtaactgaggagcccttcacacaggtctagcctcgtgggactaaaaagtgtgacatgggctaggaaaatgcgaggctgggatgccttcactcccatgaggaagcgtgacgggaggaggcgtgggccactggcagttctacttcacaaaggctgctggcagtgtcaatcctgcaagctggccttgccctcctgtggcggcagtgtacacgtggcatgcaagcacatgcacaagccacctggctccaaggtcagccaagggctccaacatctgtctcagtccctgccaaggcatgggaaccccccacgtaaacttggaacttttcctttcaattgttgcttatgtctgtcactttacttgactgtgagcagcttctagggaggctctctcattcatagtgcatatcatgggcatccagtaaacggctaatgatgatgatacacctttattacaaaaataaaggcaatggagactgaagaggtgaaatgattagctcaaggtcactggcaaggacagagctggaacaaagctcagcattcctatgccaggcaatgtcctctcactgatatccggttgcttctcactaggagaaggatgaaagatgacagagcatttataaccaccatttgttattttcattatcaactgacactggtgtttctcygcccggagcgattttgtcctcccttcacctcaggaaacattcggcaacgtctagagacacttttggttgtcctaatgggagagggtatgcaactggctgtagtgggtagaggccagggatgcagctaaacatcctgcagtgtgtgggacagcccctcgcaagagagagttatcctgccccaatatcaataatgccagggttgggaaagcctgatctcatgtcagcattaaaaccttgtaatgaaaagaggacatttcggccgggcgcggtggctcacgcctggaatcccagcactttgggaggctgaggtgggcggatcgcgagatcaggagatcgagactatcctggctaacacggtgaaaccccgtctctacttaaaatacaaaaaaaaaaaattagccgggcgtggtggcaggcacctgcagtcccagctactcgggaggttgaggcaggagaatggcgtgaacccgggaggtggagcttgcagtgagccgagatcacaccactgcactccagcctgggcgacagagcgagactccgtctcaaaaaaaaaaaaaaaaaaaaagaaaaagaaaaacaaaagaggacatttcaggaacagcaagaaaggggttgtaggacatggcgggctgtgccctttctcttcctttattttttactttttgatacattctatttgtacatatttgtggggcacatgtgaaattgtgttatgtgcatagaatgtgtaatgatcaagtcaggatgttggcatacccatcacccaaccatttctatgtgttgagtacatttcaagtccttttctagctatttagaaaactataataccttgttgttcactgcagtcaccctactcttctgtcaaacattagaaagcattccttctatctaactctgtggttgtaccccttcaccaacctctcttcgtcctcaccaccccccccacacacacacacccttcccagcctctcgtaaccaccatatactctctacggccatgaaatcatctttcgtgggatcacgcaatgtttgtctttctgtgcttggcttactttacttaacataatgacctccagttccatccacattgctgcaaatggaatgatttccttcttttttattgtgtccattttcaaagcaagttctgaaagacaagagaaggagctctgagagttgattatggccatgcctgagaaggggtctcagtcaactaatgccgttgtggacattcctgtcccaagcagaaggctttaggtcacaatatgtccaaatgtccaatacatctcccacctatgatccattggaaagaaaacaaacctcgggacccccaaaatcactaagccacatggaaaagtaaagctgggaactgcattgggcaaaccttcctcccattctattcctaaataaaatagctttcttaagctataaaaaaccttttttaagctttaaaaaggttttaaaaagctacattcctcacaatttgcccatgaggaaattccttgtggaaaaaggacaggcagaagtcagagtcacccctctgctgacatgagacaggtgcgtatctgattgcctcgtttgccatattgtttcactgggccacactaaggcatgagtgactattcttgtaaattgcgtatttggtgaaaggctaattggaaactcgaaaaaatgcttctgtttgtctcttatctacctatgacctggaagcccccttcccttcttcgagttgtcccaccttttaggaccaaaccaatgtacatcttgcatagattgattgatgtcttatatctccctaaaatgtacaaaatcagcttgggccctgaccaccttggacacatgtcatcaggacctcatgaggctgtgtcataggtacatccttatccttggcaaaataaactttctaaattgattgggacctgtctcagatactttttgatttagaatcctaacttctgacttgtacttgggtctctgcagactaacttctatattcttcctaagactttgtctagttattcctcattttcatcagtcttcgaatattcaaaaacatttcatttcattgaaaaaaaattgaaaaaagtagttgatatcagaattttaaactgcaatgcattagttgaaaataattttttaaggatatctatggtcagtttaaaagaaaggtctatttaatctcaaagagtttctatgtagtcaagacttttattctaggctgggcacggtggctcatgcctgtaattccagcacttgggaggccaaggcaggtggatcgcttgtgcccaggcattccagaccagcttggggaacacagcaaaaccctgtctctacaaaaaatacaacaattagccatgcggagtgacatgcggctgtattcctagctattcaggaggctgaggtgggaggatcacctggtggctgcgttgagtggagatcacaccactgtactctcgtctgggcgacaggagtgagaccttgtctgaaaaaaaattattctacttttatttgaatagacaaaatttttttgaatcctgatactatttcaaagaccttaaagatttcactaactagctaaatcaaacttaggaaaatattatttggttttccagtgaagcatttctcttatttagagcctttctgtttctctcaatagggttggagagttatccttatcttctttttattggggcttaagaagagagatgaggttccatggagtaaacaatwcaaggatataaggacctcatataatctcacgtatccattttccatgaaagccattcttggcacgaatttgccattctatgtttgagcctcataaaaggcaatgcatcataaatatgcactttttgggtagctggaatgtactttaaacgggaaactcaagaaaacagctaggaactctttatgccaggataagtcaaatgcactggcaatagatcaaataaaaatatctgagtaaatgccttccaga

SEQ ID NO: 17565 - DNA, 16524 bp, Homo sapiens
tcaggaatctagtttcatgcttttgcatatgaatatccagttttgcctcaaccatttattgaagagactatcaataagggttcttggcacctttgtcaaaaaacagttggttatagatacatggattaatttctgggttctctattgttccagtgttctatgtgtctgtttttatgccagcgccatgctgttttgcttactacagctttgtaggatattttaaagtctggtagtgtgatgcctccagctttctttttgctcaagattgctttgactatttagggtcttttgtggttccatatacattttaagattttttttctatttctatgaagaatgtcgttggtattttgataggaattgcattaaatctataaatttctttgtgtagtaagattttgttctgaatgctaaaactgtaggtataaataggatggcactgctggcccagaggaaggcctgattagccagggtgccccctaatagctctgacttcactagtacccaaccttctctcagtactttgagggattaagacaaaaatatcacatcataagtctgatgctgaaacaagtttgttcctttaatgagatagtttttgacaaattggatccaacatctcctgttaaaatggaaatacatatttagagtcgtggtagggcaggtagacaagtaacaagcctgagtggccatcaccacattggtatgaattaatttaggaacaaagaaaaacttcctgggaggatatgatctataatgggatggttgggggggggggttgttagtggtggtggtaatgggttattttagttttgaatgtgtgtgttgcagggaaggaaaaaggttggtggagagttcagagccaaagccatgctgaatgacaggtggaagacagtctgatggatcatagtcactgttcttaaagaatacataattcaggcttgcatgagacaagatgaaccactgacatcctaatytctcaaagtagtcattggaaatggaaagaagagccaggatttattggagggtatattcacacagaaggggttcatgaaggtgagggaccctttcacctccccactgggcagaaagcacttgccagaagaaagggttgcaaaagaaggttgaactcagcaagaaaagtgccttgggtcagtctctgtactgctaaatagggcctaccaccctaccctgccaatccctacataggccctgtcttcagtaaacactagagttcgcttaccttccattccaagaaccaatctgacatctgctgtattagtctgttttcacactgctgataaagacatacccgagactggctaatttacaaaagaaagagctttaatggacttacagttccacatggcttgggaagcctcacaatcatggcggaaggcaaggaggagcaagtcacatcttacatggatggcagcaggcacagagagggcttgtgcagggaaactcctatttttaaaaccatcagatctcatgagacttattcactatcatgagaacagcatgggaaagacctgccctcatgattcaattatctcccacccagtccctcccacaacatgtgggaattcaagatgagatttgggtgggaacacagccaaaccacatcatctgctgtgcctcatcccacagatagcagagcttcctcctaatctatcaagagttcagcatttagtgagtggtcaggatctcacccttcatttaaccaactaaccaccaccaaccaaccaccaccatcagaggtgggcctaaggcaggccttggggtctctgggaagtgggccatgctcagtctacatcccaatgtgctatggctcctgacaccctgagcaggggctctcccttgcacacaccaaaggaatgactgggcttaaaaaacgtgccaacttgcttataaatcagtctcctcagattctacaattcaccgagccataaaacctcagagcttcaaagatgcttagaaaatatcaaggccagggttcccaggaagcctcaatgctgccattttacaaaggaagaaactgaagtgcagagagattaaggggcttgtccaggtcacacagctacttagtggtagatctgtaactagaaaggtttcagttcacactcaatgttctttcctctagaatctaacctctgcccccttgttatttttggcatgagagaggaggattatatttatgtctctagaaaagctgtgcttttggattgaattctgattttctcttctcaagtctcattgagaaccacatgaaaaaactctgctggatttgagttaaaaaaaaaaaaaaaagaatctgaagaaaaaaatagcaaatctggtatcctaatgagataatgaatgcacaagtactttgaaagaggtacagcacttcagtgcttttcagatatgaggttttgtcatgctcttgaaagaaatgcataggctttactgacatgggggctggggctggggctggggccctggcagaaatggggaagcacaggctgtggcaaggggggtttctccagaaggctgactcatttcttggctgtcccaagcttagagagccagatttcttagggttgtttaccaccttagtaaggaactggtggagggtttttttctggagttaagcactgcaggaagagctgcccacagtatgggggtgggtcatctgcttctggactgcccaggccaactgtggttaccccagttaactgtggtgaactgtccacataaccagccttctggatctgcctttcaaggagtcccactgtgcttctccctgctgaggccgctgaaagggcataggcaattgctagaggtgaagaaaaactctgtagctaagctataaaaacaggcatcctgaatctggctacatcctggtaatcttgcacataggatgaatcctaagaaaaggtgagtcttgttaatgtgcacagcacacaagccagcgggatggcgtgccagtcagcagattttcagtttcaagataactgaaaatccatttttatctgacttagacaaaatgaaacaaaacaccaaaccaacaaacaacaaccacacaatttcactgattcgcataactgaaaagtctaaggttagggcttgtttcaggcaccactgatcttgtggctcaaactatgtcactgggacttggtttaaccctgtctcagctctacctttcctcagtgttaccttctctctcaggagccctggggtagcccccagtggctgcaggtcatctgtaatcccagggggtcccagcaaaagagagagggaatccctttcagtaatggtcctcctccccaactaaattagaggcttcattctgactggaccaagttagagcgcataaccatccctgggctctgattggccagaacagagtccggcgttccacctgccaggtggaagggtagatctctcccatgctcactgagcctgagacaggaggtggggtggcatcccaaaggaaatctagcatgctggtaccagaacggggaataggtgctgggcttggaaaaataacagacaaacactcagtgctacccatttaagcatttgaaataatttcacttcaaaatcagagtggtcgagtctcagacacatgagattctgtctcagatttctggtggcttgaatggagggtgtacagaatcatgtcttgataaatgtttaacttctaagatttgaagtgcagatattggtctgggtatccctcctagaaatctttgcattttctgcattttctttttaatattttatttttatttttatttttatttttttgagacagtgtctcagtcacccaggctggagtgcagtagtgcgatcttggctcactgcaacctccgcctcccggattcaagcgattcttgtgcttcagcattcggagtagctgggactacaggtgtgagccaccacggctggctagtttttgtatttttagtagagacagggttttgccatgttgcccaggctggtctcgaactcctggcctcaagtgatcctcctgcctcagtctcccaaagtgctgggattacaggcgtgagccactcactgcacctagcctatatttgaattttaaatagtgattccacaccttaacctaaccataatgggaattggattagagaatggtgggaatttcagacaagttggtgagggtgagaagtaagggaagagaaacgttatggaacctctcacataaaaagtgcacagtggcctacccctatatggatgtgagactgctcctgataggaaatatccccaaaccccttgtttgcagtccacggccccagtctcaactccaccaaatcatgatgcttcccctgagatcatgattgcgttgcccagtttcctctctgaccagacctgattctacagacaaaagccaacctcctcacttcgattcccctggatcctttcctcctcttcacatctacagccgctcttctaacttcttactcccgttgcaattccagatattccagagacaggatatctccaaggcactccagggccccaaataacaaaccttatttgttttccacctcacacaatctgaactcttctgcctgccctttgaaacccttcgcgaacacctccaaccttatttcttgctcctcctcaatacagcctgttctggttggcacagcctcacctcttacctttgccacgatgctactcctgctgcgtcactcagttctgcatggtgagtctcctccatccactgtgatctggaaccacgtcattgtcagtggaggttgaatacaactggaattttttatgggattctaacagacctgtccctgataatggcgtgcccctaatttccgttctttactgactactcattggctgtatcactctagttgcacaaatgatctctatctccctctatgcatgcctactaggtccagggaagtaatatagtgtttgtaactaggagtggtaaagatgatggctaattggagagagtaagctcaagctaaaagcattcaaattcaattttttttttttttttgagacaaggtctagctctcttgcccaggctggagtacagtggcatgatcacagctcgctgcagcttcaaactcctggactcaaatgatcctcccacctcagcctccggagtagctgggactgcaggtgctcaccactatgcccagctaattttttttaaaaaaaaaattgtggagacagaggtctttctatgttgttcaggctggtcttgaactcctgggctcaagtgattctcccatcttggcctcccaaaatgctgggattacagacatgagccaccgtgcccagctcaaattcaaaaattttaagacattatgggacaaagaaaattcacctgtccatccaaataatgtaatgtgcaataaatctgcaaccactgcttaagcttgtcttgaagtttttctgttttgcaggactcttcctgagcagtacattttcttctcttctaacagagttagaatttattgcttacaactctttcagaaaatggcagtaattagaaatggagtctgaggagggggatttgctcaaaatacgagtatcgtttctttaccatttttctttagcaatgtattctgtaatcataaatgagctacatgaagatctgagcacagcctggaaatattgcatgtttaatatcagcctcctttcccttcttcagaattaaactctggatccttcctagacttggccagttccaagtcacgacttcgtcagatacactcttgctgtaagaagcagtaaagttcagtggttatgatcacagacctagagctggtctatctgggtttaaagccagactctatagctttctggatgtggctgtctgtttaaccttgggcaagctaggtgacctctgtttgcctcagtttcctcatttgtgaagtgcggataataatagtacctacctcatgtcatcgttttaaggattaaatgaattaacacatttaaaatataagaagtttgaaaagctcttggactccggctgcagcgtcagcctccctcgggcctcggcagcggcggcggctcgctcgcctcagccccagcgcccctcggctaccctcggaccaggcccgcagcgccgcccgccctcggccgccccgacgccggcctgggccgcggtcgcagccccgggctcgcgtaggcgccgaacgctcccggcccgcccactacgggcccaggctagaggcgccgccgccaccggcccgcggagcccggatgctggcccggaggaagccgatgctgccggcgctcaccatcaaccctaccatcgccgagggcccgtccccaaccagcgagggcgcctccgaggcaaacctggtggacctgcagaagaagctggaggagctggaacttgacgagcagcagaagcggctggaagcctttctcacccagaaagccaaggtcggcgaactcaaagacgatgacttcgaaaggacctcagagctggacgcgggcaacggcggggtggtcaccaaagtccagcacagaccctcgggcctcatcatggccaggaagctgatccaccttgagatcaagccggccatccggaaccagatcatccgcgagcaccaggtcctgcacgmgtgcaactcaccgtacatcgtgggcttctacggggccttctactgtgacagggagatcagcatctgcatggagcacatggatggcggctccctggaccaggggctgaaagaggccaagaggattcccgaggacatcctggggaaagtcagcattgcggttctccggggcttggcgtacctcygagagaagcaccagatcatgcaccgaaatgtgaagycctccaacatcctcgtgaactctagaggggagatcaagctgtgtgacttcggggtgagcggccagctcatmgactccatggccaactccttcrtgggcacgcgctcctacatrgctccggagcggttgcagggcacacattactcggtgcagtcggtcatctggagcatggacctgtccctggtggagctggccatcgaaaggtaccccatccccccgcccgacgccaaggagcyggaggccatctttggccrgcccgtggtcgacagggaagaaggagagcctcacagcatctcctcttggccagggtcccccggcgccccaacagcggtyacgggatggacagcckgcccgccatggccatcttcgaactgctggactatattgtgaaagagccgcctcctaagctgcccaacggtgtgttcacccccgacttccaggagtttgtcaataaatgcctcatcaaaaacccaacggagcgggcggacctaaagatgctcacaaaccacgccttcatcaagcggtccgaggtgaaagaagcggattttgcctgctagttgtgtaaaaccctggggctgaaccagcccggcacacccacgcgcaccgccgtgtaacagtggccaggctccccgcgtcccgctggtgacctgcccaccgtccctgtccacgccccgcccttccagctgaggacaggctggcgcctccacccaccctcctgcctcacccctgcggagagcaccgtggcggggcgacaactgcgcacgcaggaacgggggtctcctctcctgctggtccctgccggcgtgcctctagggacgggcgacgctgctgtgtgtggtctcagagcctctgcttccttaggttacaaaacaaaacagggagagaaaaacmaaaaaaaaaaaaagaagtttgaaaagttgggaaacactgggtaaacttatttttaaacagtgtattagtcagcttttcaaataatatggtcagtatctttttcttcaacccttggacaaccccctatttaagacaatgagtccaggccaggcacggtggctcacacctgtaatcccagcactttgggaggccaaggaaggccaactgcttgagcccaggagttggagaccaccccaggcaacatagcaaaatcttgtctctaccaaaaagataaaaatacaaacaattagccaggtatggcagcccacacctgtggtcccagctacttgggaggctgagcagggagaatcacatgagccctggaagctgaggctgcagtgagcagtgatcatgccactgcactccaacctgggtgacagagcaaaaccctgtctcaaaaaaaaaaataaaataaaataaagcaatgaatccgattttaatctttaaaaagtataataaatacactaaaaagtgtccaaaaattctggaaatataggaaaaatatatatatttaatctgaagtaagctttttttcacattaacaaatggattaattacttcaaatttagagatatttcacctgaaaagatgtcctggggttaaaaaagttgaacatattggctgggtgcggtggctgacacctataatcccagcactttgggaggccgagcgggagtggatcacttgaggtcaggagttcaagaccagcctggccaatatggtgaaaccccgtctctactaaaaatgcaaaaattagccggacttggtggtgcatgcctgtaatcccagctacttgggaggctgaggcgggagaattgcctgaaacctggagacagaggttgcagtgagctgcgatctcgccattgcactccagcctgggtgacaagagcgaaactccatctcaaaaaaaaatttttttcaattgaacatactatttgaaaagttaaatgacatgcaatttaaaagtctgtttatcctttttcccaacttttcagataccatgtgcttagcacggtgactggcacttagtaagcattgttgcaaatgtcattttcctatgactcattgtcccttcactttatgaggagggtcccctcctctgcctggaccattgtccagtctaacgtatcccactttggaaactcttaaagtagcatgtctccaaagagctgcgtcggctaacactattcctcactgtcatgggaggtgaagtgatatgtatagaaataatgtttgtctcagctcaggctactgtagggtctcactgttgcccaagctggagtgcagcagaactatcatagctcactgcagcctcgaatcctgggctcaagtgattcccccacctcagcctcctgagtaaccaggactataggcacgtgccaccacacccaagtaattttttattttactttttgctgagacagggtcttgccatgttacccaggctggtctcaaattcctggcctcaaatgatcctcctgtctcagcctcccaaattgctgggattacaggcatgagccattgcactggcctcttcttataaagacactaattctatcataagggccctatcctcatgacctcatctaaacccaattttctcccaaaggcccatctccaaataccatcacactggggttacgtatttggtgggaggagcaattaatctcatagtaatattatatacctgcccaaaaaggtaggggagcaacttaaagtgatactggaaaccaaagatcttatatgataaatagccaggaaacttaatggtactagatgcataaagacaccaaatgaatgcttaccacttattttccccaataatttctgtattgttttttgttttttgtgttgttgttgttgttgttgttgttgagacggagtctcactctgtcatccaggctggagtgcaatggtgcgatctgggctcactgcaacctccgcctcccaggttcaagtgattctcctgcctcagccgcccaagtagctgggattacaggtgcctggcaccatgcccagctaatttttgtatttttagtagagacagggtttcaccagtttggccaggctggtctcaaactcctgaactcaggtgatccacctgcttcagcctcccaaagtgctgggattacaggcatgggccactgcgcctggcctgtatttgttgtttgagtagctggtcattcacatggtttacagtcaaaagaggcaaaaggatatgcagtgaaaactctctctcctatccctgctttccagccaccagtttccttccccagaggctgtggctggggcctttgtctccttccagagatagcctgtgtacatccaggtcccttggagacatgggtttcagaatgaagaacgtttcaggtttaggcagtaataaggtgcatatagcatgtattccgcaacaccccaggctctgtctaggatggccagtcatcccagtttatcccagactgccccagctttagcactatcagacaaaccaggctgatttgaccactttttagtttaaccaagtttttgtgaatgacttatctttgctgcttcttaatatctattcaagattgttttaagatcactttattcttccttttcctttggttttcaggcttgccttctctcaaaccatcaggcaaaacataccctgatgaacacatcaaattcagcatcaaagtggacgcttacaactttaatgctcactacgaattaacctcaaaatagctacgtaaataaaattagcaggattatcagagaattgttcaaatagcaatcacagaattctttccctgttctttaaaaactccagagattggctgggcccagtggctcatgcctgtaatcccagcactttgggtggctgaggccggcagatcacctgaggtcaggagttcaagaccagcctggccaacatggtgaaacccccatttctattaaacatacaaaaattagccaagtgtcgtggcgggcacctgtaatcccagctactcaggaggctgagacaaaagaatcgcttgaactcaggaggtggaggctgcagtgagctgagatcgcgccatgcactccagcctgggtgacaagagcaagactgtctcaaaaaatataaataaataaaataaaaaataaaaacttcagacattgttcgtgatgttgtttaggtctctggaaacattaaatgtcaggcttattttttgtgaaaaatacgtgtttgtatatgtgtatgcatgtgcccagagaaaactctggaaggcagtggcagtgattttcattttcttccttttttattgtttatatatttttatgatgaatatgtcctaattgtacaatagtttgaagtaattttttttctatttaaaaaggtgttggtatgttgtttctggaattatcatgattcttttcaaatttacattctggacattattggtaaagcagaagtcacttgtgttttgaatccaaacaatgtagctaggcttgtggctagatcgcatgctccttaggtcagggctaaggctgtgttgttcaatttcagtgtatgtgctgccaaagcgagcacaggctgcctcattcacgtttgtaccccggcccttggtacaatgcctgacatgaaatgggtgctcacagcttgtttgctgtgctgtgtttgaacactcctgtaagcataacttcattctggatgcaaggatccaaattcttttcacagattaaatctattatcacaggtttttatccacggtgagtatccacacacagtaccaccgagaatagtatcctattacaaatacatcaccttgaaaaggtgagtcacaattctcctataatcaaggtgacataaaatccaagactaatcttagtcaaaattgccagaggtaatttctaccccctgcaagtactatcacaaatacatgaatttaataatagaggtaatgtagtctatgaaacccaattatatccgacctctttcaacaagagacaaatttcatctttattttttgttgtttgtttttagacagagtctagctctgtctccaggctggagtgcagtggcatgatctctgctcactgtaacctctgcctcccagattcaagcaattctcctgcctcagcctcccaagtagctggaattacaggcccccgccgtcacgcccagttaatttttgtatttttagtagagatggggtttcaccatgatgaagatcatgatggtcttgatctcctgacctcgtgatctgcccacctcagcctcccaaagtgctgggattacaggcatgagccactgcgcccagccaatttcatctatttttatttaacaaaatcatatctgtaatgaactgatcatacttgaaatgcaaaattcaattatacttcaatattttttatttctttttcctgtgtcattccattaggagtttgtgacggactccccttgcctgaagaacccttaatggtcttccccagaggtagacactttgcaaggggctgcaggtccccttaggactgatatctactactttcattgctcctagacctatgtgatttagcttatagcaggtccctcagaatgaggtacaaagtgtaacctgtgaagagacaaaacacacgttgaagaattacattgttttaccaatttatgtcaaccaattcccggactgaaaacagtttacagatgcagaacctctcgcatataccaatttatatcaaccaatttatatcattctggagaatatgtgtgggattgggtcctcagagtatgggatcagggtgaaagaaatataaagtggggccaggctaaatggattgctatgagctcactaagcagagattctggacttcatattgttagctcaagttgttagaaatggttctgatagtttgtttggttagttaacttgaagtctggacccaaaggtggcttaggctgaataaagtttccttggtatactatggagcagaatttctcaatcttggcattattaactacgaaagaatcaaaatggagccacttatgttaaaaaccctggcaaatagagtggcaaagtccatgaaggaagggttctcatgcatgaatccctgataataagaactattacaaaaaactctacaaaaccacaaccttgcacaaaggccatctcaactttacacagaaaaatacttctgcaaggatgtacatctgcacagcaactgaccatccagcctcccttgttattgatccatgtagctgagaataattatctcaaaacaattatgtaatccttctcacttttcctttaaaaacctttatcttcctttacctccctgaatatgcctcagttactatggcacgtgtattcttattgcaatgcctcttccccaataaaatgattttcttttggagagtctccctttctgtttgctatttaggttgacataacgtaagactttgtggtggggtgctgtcctgtgcaccgtagaatgtttagcagcagtgctgagactagggtgagttgagtgagacagctagctttgggccctgggtacctcactcacctaatccttgtcctggcttcatttagcagtagccgtggctcctagacactaggtaccagtagcacccactagctgtgacaaccaaagatgtttccagacattgccaaatgtctctaggaggcaaaatcacctttagtagggaaccactgctatagaggaaagtttccaaagttttcataattactcgtttctatcatgtgtaatatgtgttatgaaaactcgcagtgcaaggaaaatgcctggaattctgcctagatgtaaatttataagaatgtaataatgatgactagtaaatacataattcaaaaatatcatcactttggaaatgatatgccatggatttacttcaaaatagtcctgtggtgggggcagtaagtgcgagtggtgatgaaataagaatggctacaagtcgatgactattgtagctgggggttgggttcatgggcctttgttgtactattattatctttacctcatatatatttgattccatgacataaactgttttgtttgtttttgagatggagtctcgctgtgtcacccaggctagagtgcagtggcgccatctcagctcactacaacctccacctcccgggttcaggcgattctcctgcctcagcctcccgattagctgggattgcaggcatgcaccaccacgcctgactaatttttgtatttttagtagagacggagttttgtcatgttggccaggctggtcttgaactcctgacctcaggtgatccacccacctcagcctccccaagtgctgggattacaggtgtaagccaccgtgcctggcctataaagttttttaaaaatcatcttttcctacttaagcccattcttttgtttaaattacttgtttcagttgtttcacgttgactctgcctattatttcaagttcctctgatcttttattttgctgccttatttagcataacttttgctatatgacatacttaaacaggtataaccatgctgacaagaacagacatgcttaatcttatcctcaggcatggttgggtgccagtctccgtgggtagcctcatctgccactcctttcataggccttacgcatggaccactggctgcctcctgttgaccatacgtttgcacccctctggatcaccatgcactttcctgtcttctctgttcagcaaaatcctcctccttcctctagctcagctcaaatgccactgctctctcctcttcagcacttcgcttccctttcattccggcccacttcccttctagccatgtcaagttctcttttcctcctgctccaaaagagctttgctcatattttccttgtactatttattgcatcctatagtttgccattgtaataataagaattatttggttgaaagaaagagaaactaacttacactagattaacaggaagtctattaaaagaataacaaggaaactcttcagactaaactgcatgtggccagctgggcctgagggattaatccaggaattaaacactcttctctccaagtctctctcctctgtgctcttccctgggtgactggttcattctcctgcagcaaatcaactatttcactctttagtccccatggcaaaaaaacatgggtgtccctctgctaccaagtgtatctgttagaggtttagccacacaaagagtgagtgagtatctctgtgttttgagagggaaggaattcattggcccagtttagatcaggacttatcttcagggagtggatggtgggtgggcaggatcacatggtacaaaatagccaccacatctatggatggggatggagcagttatgggtacatagggatatggtagaccatccaaaacttccattacagttatacacatgtctaactccccagttagatcgtgagcttctcaagggtactgacagtggctccttcatcgttgtgtgcttttgccaagaaatacatatttattaaatgaatttataaccaattctgtggaccttaacttacacattaggctcacacaagcatctgaaataatgcatacagatattctgatagacattttaacatataataaacactttgtgggccgggtgtggtggctcacacctgtaatcccagcactttgggaggccgaggcaagtggattgcctgaggtcaggagttcgagaccagcctggctaatgtggtgaaactccgtctctactaaaaatacaaaaattagtcaggcgtgatgtcgcacgcctgtagtcccagctactagggaggctgaggcaggagaatcacttgaacccgggaggcagaggttgcagtgagcccagatcgttccactgcactccagcctgggcaacagagagagactccatctcaaaaaaataaataaaataaaataaacaatttggggcagacattctagtttcctactcatatcatttctgcccttctttcttaatagaaccccacttttttttccttcaggggagtagtaccttcagttagcaatatttactcagaggtgatgatgtggcccagttctagccaatgagatattagcacaagttactggtaaagcatctgtgaatattttgtaaaagggacaaatgtgtctggcgtgtaacttttgcttctctctttccttgcctggaatgtgagtgtgatgtttggatgtgcagcagctaccttgtgaccatgagaatgaagtttgctccctaagatggggtagcagaaaaatagaaggagcctggctcctggctccttgaggactttagtaagtctttgagtgcaaaggatcagccctgaacagtctgtccccagacttcttgttgcctgagacaaaaagcaaataaaaacaaaacaaaacttgtttaagccatggttggttgtttttctgttacttgcagctgaacatagtcctaacaagctttttttaaaaaagaaaaaaaaaaaaaaagattggccaggtgcagtggctcacacctgtaatcccagcactttgggagccttagagggtgccgattgcttgagcccaggagttcaagaccagcctgggcaacatggcaaaactccatctctacccccccacccccccaaaaaaatatatatatataatatatatttttatattatatatgtgttatatatatggtatatttatatatgtgtgtgtatatatatgtgtgtgtatatatacatatatatatattcagctgggcgtggtggtatgtgcctgtagtcccagctacttaggaggctgaggcaggag

SEQ ID NO: 17566 - DNA, 321019 bp, Homo sapiens
  misc_feature (1)...(321019): n = A,T,C or G, or insertion/deletion polymorphism (see Tables 1-2)
gcacacccatctcagagactaaccaccgcaaatgacaagtgaaaaagacagagccgttacagctatcctggtcgggtttattttcccagactaccatgtggggagttgaacatacccaccctcaggtcggggacaggctcgtgacgatgctcagggtagtggtggagccccagaagcctccagtttccattttggacccacggagatctccagggtgcctatcactcttggcccaggcctgggctttccaggaacttccccgattgatgttttactgaacgtggtgccgaaagttagtcacaggaagacattatctcagctgtctctgcgcaaatgctctctgaaacctccacgttgcttttaaagcatcatggagaaatgtagcatttatgccttgggagccagctatctatgcagagctaaaatagaaaatcttctcaagttgagtataaacagatcctcaacaagactgagactcttgttgcttgtggctgtgtggggataggaatcagctacagcatcacttgtatttttcctgcccttggggtgctctgtggagaccatgtgatgccttccacagctaatgcccctaaggaaagaccttaggcagatacacactgaaagtatacacatctgtagacagctgtgggcaaggatgttggagtttagcatctctactaactcacctaatagtaaaaacgggaagcattgtgctaacattttttttagaacagctgcaactatctaaattataatacaatcttaacaatttaacattcagatacaattatgcagaatgaagtgcacccatcttaagtgtacagtctgatgtgtttctgctaaatgcatatactagcatagccaacaccccatcaagatatagagcattgccatcacccaagaaagttctttatgcctctccctagtcatttgaaactttccctctctacccacccagggcagccatgattctgatttctagctctagatcaatcttgcctgtttttgagctttacataaatgagctaatacagtatgtactcttttggcttatacattatgctttggagactcatttatgtttttgcatggattagtagtccattcctttttactgctaagcagtattgcattgaatggatatatcatgatttgtttatccattctccttttgatttacatttgggttgttttagtttttgctattatgaacaaagcacctattgacattcccatagaagtatttttgtggaattttcatttcttttgggtaaataactagggctagacttgctggatcgtaagttagttgtatgttttaccttataagaaactgtcaaacagttgacataatgcactcttaatgaagcttattacctgtgaagtgaggtcttttaaattttttgtcttttgatttttgtcttaaattgcatcgatattagatgtgtggacattcttctgaaatatcttaaggatcagaccttgattaactgtgttattttagtagatctttaatgcttctgagttatttatacggacagctcgaaatctgaacgactcccattggaaaaccagaatgatctctttcatggatctctcccatatttttatttatcttctttaatgttttatacatacaaaaatatgtagaacatgtgttagttattaagcatacttataaaatggaaatttgtaaatccgtcactcaatccaagagtgaactcatttccaaattacaatggaaacccatgtgcctatgggcttctcatcctctccaaaggaattcacatccttcattaattcttttgctaaaacaaaagcaaaacaaaggaaaaatattattttattatttaaagcaaaaaaaattttctgtaacttttaaagttttccttgctttttaagagctttatcaaaatggtgttacgctgtgtgcgtttttgatatttgtatatttttactcagtgtgtttcaaagatctgcccatgttgtgtggggctgtagtttattcacttttgctgctaacattcctttctgcgaatacatcacaatatactgtattacttgatacttgtcaattgttgtgctgtttctcacgtttgcacttgatgtatatgatatacattacattttttggggagtctggtacatttagcagaataatttgagatgaaactgttatcaagtaaacggcgtttttaaaaaatgaaaacaagcaatcagtttctgctccaaaagagggagaacctataagatacctgagtaaaatggtataaaataaaaagtttggtgcattgtcaatgtgggtataaagcaaagactccaattaatttttgtctacatgattttatttcaaggttgaaaaaataagtttgacttgtgtatgtaaaatataatcattgaagaaatacaaatcacctcctttgtccatgtggtcaagttagagcgtaaagacaacctaaatttttgttccttttttttccctaaatattaagctatataatgatacatctcccacttcactgtttaaaataacttaatacgattgatttcctactacttcaggaaaacacaaacatttaaaaaattcacaaataaaaatcattttagtaaaaaaaaaacacacaaaaacaaatcctacaacccctacaacaacctatatacatttaaaaattctatagacctctttatgttcttggggacaaataaacaggcatatttattactaatactaaaaatacattgggtagtatttgaagattttatattagcactagccttttaaaaatcagctctaaatttttgtcttacaagtatgtattaaaaattctgaaatcaagtataatgaaattatatatcaatattcctttgcatttaactccagagtggatctgcaggaatcaagaccaacctcatgcagagaacttaagaaatatttaaaaattagtagactggactttaattcttcatgtgtagtgcctaatttttaaataatacattttaagattctaataaatttatttcactgttaaatctaggaacatccaaaactgaaactctttatttaaaaatcaagctgaatttcagttaaacaaaaccatcccatcatatgaataactttcttaggtaaaacaaggtttattttctttctatacaactgactctgaattgagctagaaatttccaaggaggaaaatgatctaggaaacaactttagaaaaaaagggctaagtttccgttatgatagcttttgacttgttttcagctcttaaaaaattatttacgaacgatggatacacgttctaatgcagaagtattttagaattagagagtaaaagaaacctactaccttcctttacatcaggtcccttcttaccatcctacccgattgtttgagacaaccacttcttatctcgacaattcacaactcttttattagctatcttaaaaaaatttattactggcatcaattagcctgagtcatgaaaccggaccacattaagggcgacacayggtccaatcactgtttgtaaaagtccacgtatttcaaactcctctctcctgccactgctgrgctgtttccctctttgaggacctggtctccgcagcatttattcattagatggcagtcctaggggagtctcgctttggggaaacctctsctcctgcacattcaagaaaacaaccgcggagacttagggtcggtactggtttccagtcacttacgtagcaaacgaagcaagaggaacgtgcctgggaggacccgagacaggtgcgggtgggtttccgcagtagccgctgatcccgagtgcatgcggcgtgttcccgggtcgggaccgcagccaagggaggcttcccggccccagcctccaccccctcctcggcgccccgggacccggacacgccccccgagcttcggagacccgcagcgtgcacgcgccccggccgctccccgcagccgcccacgtggtggagccctgagctgcgcgaggccgcggagagcgctcagggcgggcggctggtccgggaggccacgccagcgcgacccagccgagtcggcccccagcccgggcccccacatttcctcccccggagggagggaggcgactctccgcgggctgccctccccagcgcccgccgcgccctctggcggccgccgcggggacgcgcccggggcacgcggcgctgcctgtctgggccccccttccggggcgcggggcccgcgaggggcggcggggtcctctctcctcgagccactctgggccgagccacacgggccgcgcccttccccctccgctccccctgagcccccaaactccgggctccacggtcgcaacgccgcgggcaccccagcctggcgtgaaagtgcccggcgtagtagcctgggggggggggtcccctttctcccaggtgcgccccttccgccacgttcgggctttccagtacgcagcgaaaaaaatgccgcatgcacgcatttatttattttgcaacagctgcaagaaacaatgaagcttttcaagaaccggggaaacgcgctttccagccgcgctgttgttgttttcaatgaacctctcccagccccgcactccccgcccacccctcccctctcctgcccacccctcccctgcctagcctttccctggctacccacccctgccccgccgagaccggaccggcggcgggggcattgtttttggagtcgggcgggaggggagggcgcgtgcggggtggccggcgcagtgcggtgggggcgggagcgggtgggcacgcgcgcgtgtctctgtgtgcgcgcgggaggcggtggggcgggagatggggggcggcgcctcgcagtctcgcgccccacgcccgggctccgctccgcacgtcttggggaacccgggctccggttttttgcgcgcgccggcctgggccgggccctcggcgcgccgctgctgcggcggtggccgctcgagtgtgcgagcgggcgcgtgtgcgcgggccagggcgcgcgcgcgcgcgcgcgagcccccagtgtgtggcagcggcggcggcggcgcggcgaggctggggctcttgtttaccagcattaactccgctgagcggaaaaaaaaagggaaaaaacccgaggaggagcgagcgcaccaggcgaactcgagagaggcgggagagcgagagggacgccgccagcgagcctgcccacggccggcgctcgcagaccctcggccccgctccccggatccccccgcgccctccacgcccctcccgcgcgggggcagctccacggcgcgcctcgcctcggctgtgaccttcagcgagccggagcccccgcgcagagcaggcggcggcgggcgggggccgggcgggggccggcgcggggcgggcggcggcgcagagccgggcggcgcggcgggagtgctgagcgcggcgcggccggcccgccgctttgtgtgtgtcctggatttgggaaggagctcgccgcggcggcggcggcgctgagggaggaggcggcggcgagcggagccaggaggaggaggaggaggagggggagccgctcattcattttgactccgcgtttctgcccctcgccggcctcgcctgtgacccggacttcggggcgatcttgcgaactgcgtcgcgccctcccgcggcggaagctcgggcgtccggccgcctcccgcgcggccagggccgggcttgtttttcctcgcctaggcagatttgggctttgccccctttctttgcagttttccccccttcctgcctctccgggtttgaaaatggaggccgacgacgccgacagtccgccccggcgcgcctcgggttcccgactccgccgagccctgggccgctgctgccggcgctgaggggccgccccgcgccgcccgccccgtccgcgcacccggagggccccggcggcgccgccttcggagtattgtttccttcgcccttgtttttggagggggagcgaagactgagtttgagacttgtttcctttcatttcctttttttcttttcttttcttttttttttttttttgagaaaggggaatttcatcccaaataaaaggaatgaagtctggctccggaggagggtccccgacctcgctgtgggggctcctgtttctctccgccgcgctctcgctctggccgacgagtggagaaagtgagtatgtgcccgccgcccgcggccactgcgggaacttttcctccgaggggctgcgccctgtttgcgaaacccgagttgccaccgtcgcagctgtcgggcccccgggctcgggagcggcggggtggggcgcagggcggctctgccgggagggaggctgcagcggacccgggacccgggctcgttcgtctggagccccgcgggccctggctccgcgcatccccgcgcgggaagggcttttctctttctccgtcctgacagcccagccgtgtttcccggctaggcgcgaggactcggtagggaagttggtgccggggcgggctccgcggttcccgggccccgcgacccgcacctcgccccttccgtgcgcacgagcctctccgcacacagcgctgatccccctgcggcgcgcaggcagcagcgacagcaccctgggccgcaccgcgtctccgctgctggggctgaccgggcagtggggagcgggcagccgcccggcccgcggggtgcgagttgccctcgaggggggaggtgccctgcggagaggccccgaagccccaggacacgtctccaagcgcccgtcgctgcctcccgtcgcccaacgtgcttttgcccctcgggctcctcgggttcctggccttgcccgtcactttggcccgctcctcgttgggttacctgcccccggcgtcccggggctgggcggtggggtgaggggaagcgctctctgggcagccccccgggaagtgcgaggccgggagtcttcctcagcttgtctcttccggggagcgccactgggtccccagttcagagggctctgggatggtctcccagtttctcccgggccgggggatggaggggtactagggccgcatccgagtgtgcgttggtgggtgtgtggtcggagccgacgtgcattccgacacacgtgctcgcagcgcggggtgtagtcgccgcctcacggggacacctagacgcccgtccctggcgagaggtgtcgtacgctgtggtttcagcgccagggtctgcggcggcgcggggagggtgttgtgttttgcgagcgcggagccctggccttggttttgttgtggtcggcgtcgtgtcgccctctcttctgccgccccgcacttcctttgtacgtagttaataagcagtgtcgctccacattcgctgtcttttgcaatctgatagcttttgttttggtggtgtcgggtgggggttagtagggaagcgcggggatgcggggagcgagaactccccccggtgtctacggccggaggaggtgggggttttattcttctgaaaaagttgaaagtgtggcttactggtacattcaagatggtagggtaatttgaacacgattaaaagtttaaatgtcgcagaactgggactgggaacggtgagggcgtgttggtgagtaatggttgccgagggtatgcaggtggtgccgattaactttgaaaaaatcacgactgagccttcacgagtgaggcggggaaggaggaggcagcggaggttgtatggccccatcaccggggcaattcagaaaggctgtttctataaacaaatccttaaacgtctggtaagaaatgagtccgcgacggaacgagagcagatcgtggttcgcgtgtttactgccgagtgggacgcggactggggccggaccttccacagatctgggctctcctgctctttgttttctaaactttcagcggactcgattgggcgaaagccttccggctccctttactaagtcgtttaggtggtggctggggggacaaagragggtttttatctttaaaagataagtacggtttagaagacacgggagaaataatccattttgttatgttatgcagttgaactgtatagcttctctagttttgtgtttttaatgttctgaaattcaaaacagcagggatggccttcgccgacgcaggagtcgggcattttaaaataggctgtttttcttttggagcgttcttcttgaaggatattstttgtgcaagacggcgatttttgagaacacaggcaggagggagggggtgttttaatgtatgtttttactccatgataccaaagcttccccccaggatccctttacagtggttagttcctggaaacctgatgggtggtcagaaggcaccccaaatctcgattatggtttgctgaagtcttgactgactcagtacctgcccctccctccatctctgaaatgtggagaattaaaagctatgcctgtgaacgggcgttcagtttttagcsgggaaggtgctagaccacttaactctgatagaaataagctgctgagccctatcagggagggcgttctttcagctgttgtctggtggagaaataaagacagggtgttggttcagttgcaggtattttgctggcgtattgagagattagagtttcctctttgagtgtgatggcagtagaaagagtgttgtttatcttagaaaacttagtttctgaagcagaggcagtcatatggatgtgtttgttttgtatcaccataatgtgaacagagcatctaaatgaaggcggttcggaggttctgagtgatagccagataatctgagggctattttgtttttaaaaagtcagcatgcactttaaatttattgtacccatctccttaaaaggattcagtcatctttctaccccaggcatcctgttgtcacagaaatgtaggtatgtgaaatgttggtgtttaaagaagttagtgttttattaccagaaggagaacccagaaaaagaacttctgaaagaacctaaacagcaaattatagtttagatcctctggagagacatagcaagcaaatggtgttttgtggaagggtggggtttgtgtcaggatttgaaatgtaaaaggtcataatgtttgatttgtcgaaaaagattagaaaagttcaactctaagaaatatgctaaggttgaatagatgaagcttaaaaatatcacaaaaagtgaaagaagtcagtcacaaaagaccacatatcgtatgatccggtttatgtgaaatgtctagaataaacaaatccatagaggcagaaggtagatgagtggttgccaggggctgggggcggatggaatggggagtgactgctrgtgggcacagggtttctttttggggtgatgaaaattgttctaaaattagtttgtggcgatggctgcatagctctaaatatacttaaaaccattggattatrtactttaaatcggggactttaatggtatgtgaattatatctcaataaaccctttttttttttttttaaagaaatgtgatcaggttgaaaataacttgttatgctaccttaaattacgttaaaattattacatayatttgacaggctgatgtctctctctcttttcatttatgagtttttcagatccgtgagttgcagcaatacaacaaactgataattgaagcttagcaacagggattcaatcccgcagtagaaatgggcaagcaggagaaaaagaatcttggttctatgtagcttcagttagggattgaggagctggatttaaaaaacacaaatgctggtggagggcagatttttgacaatagaaacctcagctgaatctgaaatgatggtttttttcaggatagagtttaggagctgagtctgaagggctgtttgtatttccagttttattatgttttccaacaaagaaagacattgctgttttaagatgttttaaacactcattttttgatatgccacattgaccacaagtggtagtaaggactgaggatgaacagaacagttcattttaatgcagtattgttgtttcttttctttgcagttttattttatttcttacatagttccagggtctgagcaggagaaagaatctttaggatgcagtagttttaggatacactgtttcaagtatacagtgatttttataaaattaaaattccttacagaacgaaaggttttaaaatgtggcaaaggcatttttgttttgaaactgtgtgcatttatccagatttaccctggcctttcaataggaaaagacctagagaataattgttgtttacatttgcttttggtctttgtctaaggcttagtttactaataaaaatgtttcctgcccttcctattgttgcaagatcagggcagtaatgaaaatcaactgtatcattttcacttgttgccttagagtttttgccaagaggaaccctcaagggacggtggtttccttttaaatctggtttcatttgttttgtaagaatgtgctgtaagaagcaactgaatccagcctgcacttattgtgcacctactgtatgaaagctgaccttgtgctactcagtgcatgaacctgcagagtcttgcatgaaaccacctttcttgaaattcagattttttttcagactcagtatagggtgcagttttcaagtagacagtagttagcattttaaaggttcttttaaaaatatttctgtagacttaggactctagtgttgttcatcagaagcctttaccctataccttttttgcctcattggtgctttccgttatattgggatgtcactgtagactgtgacatacaggtgatgttaacccatcttgactggcggcactgtcttctttataacattggatatggcaattgtgatttacaaactgcagtgttgtagttgcctttttccaaaaattaggagtcacaggtgtgtacatgaacgttgcatagcatgttttgagttgtaagaaagatggaacttatttcagaagttttctggattacatattgcttagttagctttctagaaatcaggaagcattcataatttcagggcattttataatttgtaaataacttggtgtttttaaaagcgtgagggagtaagagtgaggagacaaatcctgaaagtttttgttttttaattgtaaagcatacaagatacatttctttataggttgtgattttccccaatttgttttcaaaactcatttaaaaatcagacctagttcatggaagaggtatttgcgcctgtgggcgaacttgatttgaactgcttttcttagccagcttaggacaggtgctgagtccaggggatgagctcttctcaattgtactaaatatataatagttgcacacatgttacggatatagtttcttgatttccagtctgagatgttctgaaggaaaattctgaacactttagagacaacaaagtgcctaatgagtgatgcactctgatccctcctggaaaatggtgtttggcatcagcttagcaagaggaggttttccagttatttgtaaagatgtgatgtggctttaagtggggatgggggagggtagcagccccagtgtttgtggacattgagacctgttgacatttgggaagcataactgagttccactatttgaaaagattaaaactttgatatatgtacacatcccctcatgcctgcacccccatccccgagggtctggaaaagaattgatttgttctgaggaaggaacatatatttggaatataaaatggttagtaaacaaaggatctttwaaacaagttagattgttatctcaagagaagcatacttcctcggcatgatgttttcttttgttaaattgctttggttttatttgactcaaagtattaacaatacctttgattttgagacttttggacttttgaagactaagtttttaaatggtcaattttactcgtttgaaagtcccagataccatttttgaagatttctctccctttttttccactgatgccggctttacttatgttttattttcaaatcttaaggaaaaactgatatttccttacttgaactgagaaatagtcgttttccctccctcttttcttccacagtaaatacatgttgagtacttactggatgcagttctttaggtttagaaattatttgatactgtaaaatgtcttaccataagtttttaaagatacccgtcaaactatagatgttactgccatgtttattaaaaaaaaaaataaaacgaaacaaactagtaagcaagcttaaaatttttctttttcctgccctggactacagatttttttttcttttttttttttgagacagggtctctggtcacctaggctggaatgcagtggtgtgatcacggcttgattctgccttgacctcccaggctccagtgatcctcccaagtaggtgggactacaggcacacaccaccatgcctggctaattttttgtatttttagtacagacgaggttttgctatgttgctcaggttggactcaagcgatccactcacctcggcctcccggagggctgggatcacaggtgcgagccaccacccccagcctacaagaatttgtaaactcatagattgctcttctgttttcactggaccacaacagaaagtagtttcttttatggtgagggatgaacacctacgattgcaatataagttgttgggccttgtgtccatggagctcacttggtggttggtggtcttgaagcattcacattctttggagtagtggggcggctggctagtcacatggggaagatgtgcacacctgtggatggggccatcacacactgcagcgatagctgggcctaccttactgctcacctggctgggcacagcggctcctgcctgtaaccccagcactttgggaggccaaggtgggcagatcacttgaggtcagaagttcaagaccagcctggccaacatggtgcaccccctttctactaaaaataccagaattaaccgggcgtggtggcccgtgcctataatcccagctacgtgagaggctgaggcaggagaattgctgaaacccaggaggcagaggttgcagtgagccaagatgatgccactgcactccagcctgggtgacagagcgagactccatcacacacacaaaatacatatataaaaataaattgctcacctggtaatagtctggaaaacattttttttttgtttttttgcatattttaaagactttagaaagtagtcttgctaatccagaaagttcttgcggggaggagtttgaaactttgttttatctcactcctcagtcttagcccccttaataccataggtctctacttcagtaagagttacataatacgaatgccgtttgttcagaattgtgtatctccatccatccgtccatcgtccaaattctgcragtttgaaatacattgttgttgctgttttgtatacttttgttcaaccattttctttttaacatggcactagctttctcaaactggctttggaattatttgtcagtttaaaaataaataccactttaaaaattactcttgacatgggagaacaaatatattttgatagttgttagagcataaatattttatagagcataacttgaaatttttcctgatacattgtgattgctttcagcttgtcctctgctgtaaaaaatatagtcgtggttagtctctgtaaagttggttattgggaatatgtgcttgattacgtaaatgagacatcaccaatttaagtcagccaaagtttagtcaatagaactttaaagaacagaagtctaatggtaattagggagagatgaatttatttrtaggagttttccccaaattcaaagcgtcttagtgacctttgataacttcctggaaaaagtaggaagcatggagagaaattccaggtaggagcccatgatccaattgactgcatcagcttacaaagtgttttctaagtcattagctattaattctgtctagattgtaaaatccctctcagttgtgtccacatttatctgtgttgtcctgtatttattctctttacctaatttccctgagtctcattttagtgggataatacacaagcttacagactcaggactttaaagagaagcacagattgccacgaaaacaaatgaacacagagaccagtagcagcagagggagatctgctgtgaggcttcccttagttctgttgtctgatttctgtggataatgagttcactgcatatgttaggtcacaacatgatatcgtgtagtcgtaggtacagaacttttgttatggtagcctttcttcgtcaggtgatacaattgggattttctttctcacatgcacctcagtaaaattttcagcaacagagattggctcaggatggaatttgttcagtttcagttctgcagcctgtccttttctggggagactcattaattgaatgttgcctttcgatctcactgagtcacttgaaatcgctcagattgacccctattccgggatccagcctggtccagtgcagacctgcattgactctgactacatgctgagttggcctctgaaccagttcctgtaccattcccttagtctgatggacttgccagctccaaatactcagaacgtgcctcttgtggtcctaggatcaagtccagggtccttagaatcaagtaatgaaacaggtccttagtaatcctgtgctgtagggatccactgttagttcctggtactccccagcatctgtgcattagcttgatggaaaggaagctgtgttatgcctgtcttcaagtttttgcttctgctgtttccatagctgagaatgtttttcctcttcactactctgctacttctccttccatcctcaatactgaatagcagaaagtgccgcttaagaacacaggaaggtcaccatagctttagtttctccttagctgccaattagttctttggtcctaaagttattaacttttctgagtcttgatagaaatgcggagacttaaaaatatttgggggagacatttctccttttctcactaaacaacagaatgaaaaccttttctaacaggtttagaaaaccaaagtcagaaaaattgtgaggaaatagaataggttttttaaattgaaataatttccaagttccaggtggatctgtaaaatagggacaagatcataactttcaaaaggcagcacgctaagtcaggtgattcctttcccccatatgccttttctgtggtttgaataggtcagagatgccatctttacatttccaagtcaaattcctcttccttcttgaaggtttttgggatttccctaacttgtatagatctactttcccattactccttttgagttcataacccacggttttgctggttgacagtgatttgtcttgttccttgcttgtaattttattaggaccatggagccaaagtggctggtttgaatctcagctcttcastagctaagctctcaggcaaataatttaatcttcttgtgcctcagtttcctcatctgtgaaattataattttaatagaatctactttaaacattcatagaaatcaaattcgtacacatgtcaagtgcctagaatagaacctggcacctggtattaagcccttggacttcaactgctactgttcttagggttgtgacatcctcgaacagagatgttctttggatagaaatataaggcttacttgatgtttgattgtccttgccatttaaatatgttatagaacctggcacataggtgctcaataaatgtataataaaactttattttgctaaggtgtttattaacaagatggcatgttgcttattaaacagttgtgattttttttttcagtaaacgatggtcatccccctgcagtttgccttccatttcagagatctgtttattacactttctcccttaatattgtcatttgtcaatttctgctcacacctgagaggtgtccagtgtgcactttgcccatctcgcctatgcataggctccatctagtggccagaagggaaattcagcatattaggtgactgaattaatagtgccccaaggaggaagatagcgatcccaacccactctctggcttgcttcctggggactgattgcaagaaaatgtggatactacagacttctgtagaaatcactgggctacagttttggattaaggttactctactgtgtcagtgcgagctgtcctgagagaattagggtcttcctaagtgatgcagacaggcgcactgcaactccatggcagagctgttaacacctagtgtgtcttttacagttagagttttaagataattttacaggactttaataaatttaaagctccaaaatatttgagattagagattaaaaaaacactactgatttcatttggaaaaatacagcaagatttaccttccattgctctatttaaacaggtagtaacactttcattctcttctctctcccctttggctattctatgtggttaagatgctcgccagccagaaatactcacagagaataagaataaatacatccagtgttgtgttaggtcccacaccgtctatatttcgctagctaattttatgtattttgtttcatgttttattgatattttcagaatctttcttgctgagattacacaaaatatatagctggttattcagttttacgtgtcaaaagccttaaacctgtttccccatgattgccttttattatttttaattcggaaatctttgtttggctgtctgagagagaacttcagcctcccttcctcccagacattttgaacagttcaggctgtactcattcgtgtctytttgtcttggcaggtggaagcccctctgcttggaatagcaaacaatactaycagcttgccctctggcaagctcctttaagagttagctgtaatttcaccctctctctggccttgattctgcatgcagaatgattgcactgacttgagctcctgtggtctcttgctatacctcctatttgggcatctcccccatattgctttcccccaccattggggaggggaatggtaccttggttatctttgaattcccaggaggtggcccagtgcctggtgcataggaggagctgaagaaacggaagacttcttaaagggatactcgccattcactttgaagcacttctttgtacaacaaatttattttcatctgatcattgcacctctgctagccaaaacattttatcacaccagttactgctgcatggaacttgaaagcaataaaattatctttaaaatcattgtttgattaggctttttgcacattgaggtgaataaaaaaaattagaactcctggaagggtaatttgtgagtctggccttgtgtcaagatcacctcatccctgtggatggagactttgttccataagttccctatagataagatgtaatgaataattcattggcaccgatttatgtctgtagtgtgcttttaaaccctcctggagctgggttcctgaggaggaagcatctgcaggctggactcggctgcctggtggtctccggagtggcctggtgcagagggccagggtggcatctcagaaagttgggtgggtagggtacttgcacacctgctgaccttgagttacagggtggacctaggtcatttcacaggcccttccagccttcagatctcaagatactaggcagagagagagatggagatttgagggagatgtggttggaacaagcagaatcaccacgtatggaagttggcttctattttttgcattgttttcttggtgaggccagtaagcttttgcctcactcctgggagggacagtagcaaggtcttacaggtctctctatcattgaagcaccctctccaaccctgccggttttggttgctggtgaaggcctttgacagtgtcctggtagggcgacggtgaggccagctcccgacctctggacagaagaaagcttacttgtctaggttggtgtcaaggggactcctgaacttaatgaacaccttagaaattatccttaaagtctcctcttccgaggagtggggtggnnnnnnnnnnnnnnnnnnnnaatgtaaacataatcatttgaagctggaatgttaatattcaagagtagcttgtaaaaaagcatcttgtgaaattctcatgtgaatgctgaaccggctggatgtgaacttagctggacagcctggcctgtctttgctctgctcttctccgtgcggtttgcatatgtgcagggcttcctttgaagccttgtcccctcaaacaattcactgtctccctctctcccacgcatggaggcatgttggaaagggagctccaggcctcagtgtctctgcctgtgattggaataacactgctctagcagggatgccaatgagaattagcaatagataatgtatccaagctgcccagcaaacctggcaaatagaaagcatccaataaatggatgcttttctctttttttctcctcctcatggtgggtggccctggtgggctctctctggggcctccagtcctccttccccacaacactggggaattgctgccagttgaatarggccctttttttttttttttttttttgagacagtcttgctctgttgcccaggctggagtgcagtggtgcaatctccgctcactgcaacctctgccttactgcaacctcttcctcccaggttcaaacaattcttgtggatcagcttcccaagaagctgggattacaggcgtgtgccaccacgcctggctaattttttttttttctagtagagacggggtttaggcatgttggtcaggctggtctcaaactcctggcctcaagcaatccaccgacctcggcctcccatagtgctgggattacagatgtgagccactgtggctggccaaggagggtctttttttgcacatctacagtgaaaggtttgaacccggacgtctgagtctcaggtcagttgttgaaaccactaagtaaccaccttgcttctctgtgcctgaagagaatgggtttttaggttaaccaggctgactggttcaaggtcatgtccctatctgtggaaggggagtgggagtggaaggtgagtggtgacagagtatggaaccctgtttctgatatctagattatttgagggcctccagtggtctctgctccatggaaagcatatgaaagaatatgattttttttttttactcgagcttgttgtctagttgggaaaactcaactactggtggagagtaacagatgctatgagtttagtgctaagttatgggatgctgaccggagagaagtatgtgggctgcaggcagtggggtcacggaactgcagaatggcttgagaagctttaaggaggatgtctgactttagtgtgccctaaatatttgactctcaagatccaaggaggcagctccccaggagaggaagggaccatgtgtggtgtgggtggcagtgtgcactgatggagtggagagggtgtcagaatccggtgtttgtgtggtgggaaggaattgactgctggctagagaatgaggagcgctgaaacctttgcaccattgcagtggacccgctgagaagggtgttctggggaggctgctctggtctctcgatggagtcaggattgggggacagatagacaccccggtgtgagccagtgatggtatagatgagggaggcagtgaggacaggctcagggagggaagtcttgtctctagacctgagaccaggaagcaggaatggactggacaggttggcccasctgagggaggtgactggtgagatgggtcctcggtgtgaggggctgggttgccagaggagctgtgggctggggtggtttgtcgagagagcagtcccagttgatggagaggcaggacccgcaaaacaggttggctgcaggactgggggcggtagcacagggcagctcccgaggagacacctggcacttttaaggcatggaatggagagagctaggggagagcacacctgcagtgaggcaattcacatagcaaagttctccggaaactgcagtgttcaacttttttaaagaatagctggatgttagaaaagtgraggaactgtcacctttattaggggcatcatggatacctggtagcatcaagggctagggttaaaacccgtggagtaatacgccctcctattgtgttcctctcctctaaaaatgaaggtgaaactgtttcaggtgagcgctgttgttgttcrtttgctggggcactgctttctgatttttagaggagtccaggctggagactgacccctgcctttttctgagttgggccggctgggcccgaggctggttctgggctgggccaggctgatgcagtggccttgggcttcccgaggctgggagagggcrgtggcccccgctaccctgaagagctggccaacgcggcagggctctttccagtccttaccatgcaagtgaagaggaacagtttgtttaaagaggggtgccagcttcacatccaggcctggactttgctactggtgcttttgaacttgtgttgatttatgtttgtaaattgactggacacattgtggttcttgatgagaagcaattgcccatccttagcccacgattagtgccactctctgggtgctgcctgttctgccactgtaactgttttcacttgacaaataacattaaaaaacacagttctgcaagagacttcctgggagggtggtatcatttggcctgtgggcttttgtaayactttcctgctattaggagagtgaattctgaattttcaatcacgttsacctgttggagcaagtagagtttcagacggtctccgcttttctcgactagaaagcaggccttctcccttttccccccagtcttgtttcmtgacaccattcccctctgagatgagggttggagaattagaagtctactgatgcattgtaccggggcacgttattgaccctctctgctctcctttcctcatctgtaaaatggaagataatgccacccatcaggccgagtgcggtggctcatgcctgtaatcccagcactttgggaggccgaggtgagcggatcacctgaaatcaggagttcgagaccagcctggctaacatggtgaaaccctgtctctactaaaaatataaaaattagccaggcacagtggcatgcacctgtaatcccagctactcaggaggctgaggcaggagaatcacttgaacctgggaggtggaggttggaggttggaggttggaggttggaggttgcagtgagccaagatcgcgccactgcactccagcctgggcgagagtgagactccatgtcaaaaaaaaaaaaaaaaagtgtcacccatcttggaggatcgttaccaatacttcatgagtgaatacatacacatttcttagaacctagggtttataaacactaggagttagctgatactattgttgctaaggatagaggaaatacgcattagaagttatttacttcctttaaaaaaaaaaataccctttgggtgtgtattgattctgatgttttgctcctagctacatttgccgtttttttttgactgcagaattaggaaccagcttcatttttttttttttttttggatggaatctcgctctgtcgtccaggctggagtgtggtggcgcaatcttggctcactgcaagctccacctcccgggttcacgccattctcctgcctcagcctccccagcagctgggactacaggcgtccgctgccacactaatttttgtatttttagtagagatggggtttcaccgtgttagccaggatggtcttgatctcctgaccttgtgatccgcccacctcggcctcccaaagtgctgggattaaaggcgtgagccaccgcgcccggcaggaacccagcttcatttcttgtaaagagagtttgacaagcgctccactggggatagcagcacagcttcctccttttctgtccctgtctccctcctgactctgcatctgcctccgtttgaagcatcctcctccagtaagtgggtcatttggattccaaggcccttttgaggccatggtgatggatcatttgcgttatcaatgtgaactgtggatgtcccttcgcccttcagtctcttccttcttcaaggagggggaggtaattgggggtcatgtggcctggggaagagcctggtcacgagcatgagggatgtgagtgggactatgtttccagccaaaatttagggcacaggatctgaaaaacacttagattaagtatctgcaacacaaattagggtattttaaattgaatgtggagaaccctgagaacctgtgccctttgtgcgtggatggctgcttgcaaggatgagcatccccagctggagcggcccatggctgccagaacaggagaaggcttcagtcaggtgggaagccagctgcagtgtgttgcctgatgcaggatggtgcgagaaggagctgctctcttgctctgctccctggatcgcacaaggtcttcctgagaccagaattcaaggttagtcctgtttaggcaacttggtagatggacttgaatggtctttgctaagcgaatattgcctatggtggtatttgcaaggaaaacaaaagtgttttgagcccagactaaccaatttaacaatgctagtaggtaaggatactactgtttgctttctgtgatgagaggtctcttaggaggaggggttaattcttttgatttaaaacttactacttgaggcaaataggcacatgaaaagatgttgaaagtcactagtcattggtgaaatgtaagtcagacccacaattggtacttcatactcattagtatggctattaccaaaaacaccagatgatagcaagcataggccaggatgtggagatgttggaacccttgtgccttactggtgagactgttaaaatggcacagccttttttttttttaacaggaagatgatatggtgcttcctcaataaattcatcatagaattgccatatgatccagcaattccactttggggtatatgcccaaaaagaagtgaaagcaggggctcgaacagatatttgtacacccatgttcatggcagcaaataattcaaaatagccaaaaagtgaaagcaactcaagggtccatccatagacgggtggataaacaaaatgtggtctatccatacaatggaatatcattgagccttaaaaaggaaggaaattctatgatgtgctacaatgtctgtgaaccttgaagacactctgcgaagtgaaagaagccagtcatgaaaggacaaacagtgcataattgttacccttacgtgagctatgtagagtagtcacattcatagagacggaaagtagaatggtgaggggcggtgaatagaggctggggggagggagcaatgaggaattggtgtttaatgggtacagagtttcagtttgggaacatgtaaaagttctagaggtggatggttacggtggttgagcaacattgtgaatcagtgtcagtgaactatacacttaacaagggttaaaatgttaaattctttgttgtgtatattttaccacaattttaaaaagcttatttctcaattgtttatgcgagtatatgtgtggaatagttggggagacaaattcaaggagaccagtccttgtccatggcggtcctaggtaccacgggatcactgcgggggaactgtgaggtcaggagaggccttgaaaaaaaacgcaggtttgagctgagtcagatggaatgggtctgttttctatatcaagagacagtattgcagataatttttttctttcaaggaaagcaagtcaggagtcaaactctcatgccacygtagtcacaaatgaaatttattgctaatcagccatgtgacgtgtaattgctttttcattttcttatttttccagaagagagatttgtttagatgtttgattccctcactgattatgattatactggaagtttttcatttgttttgacagctcaattttttttttattgtaaatggactccctcattacagaggggggagcccttgaaagaaagggattgacctctgcaggcaagaatctgagcatcctaaaagtagaaaagggctagaggcttcgccttacaggccaggaagcttggagggacgcgctgctagagaccatggcacgcatgctgtgtgtcgaaggccaggtccgcctgtctgcctctccagcagatactctctggggctatttttttctgcttggttgtcatcytttggtttaaccaggcgccagggctcaggcctggacctgctggattccaaagaagacttcgaggtggccgagcttgtctggcttccagaggagctttctctgtcccgcccgggggagtggctcaccttggtctgagaccaatgggaggaagcctgctgcgrgcaactggtctgtgcctggaagttggacttgcattttctctggacctccaaagcaaacccgaatgaccactctcatcctccccttttgcttgtttgtgtatgtgcttgttttgcctggtcgtcaggcaggaggtggtgtcagatgatgagaggtgttgctcgtccctgggttggttctcttacggggctgtatggatgtcttagctcagactgctgtgacaggttactatagactgagggctaaaaccacagacttatgtttctcacagttctggaggctggaagtctgagatcaaggtgccgaccaaatttggtttctgttaagggtccatttcttggcttgcagatgacaaatgtcatgtgtcctcacagggtggagagagcaaggggctctggtctcttcctctttatgtaagggcattgttgccattatgggggctctaccctcaggacctcatctaaacctgattacctccctaaggccccaccttcagataccactgaaggtatctgggggttggggcttcagtatatgaattggaggggacacagtcatgcagttcagaacagtggagcagtgtgccatagtgaagggatctccagaccaggattctctatggaagttcttggccaggtctgagagttggttacagatcattaaaatttacatggaatccagtacttgaaagtacatgtcttcaggatggcgctgagcacattcgcctctgtaaccaaatgcctgaaatgtgtagtgcaccttctgagcaccccagtgctttccttaaagtgaatgcagtttgagaggaactcaattattgagaaattttatatgaccccatttctctcattttaggacagataagttgcttattttaaactctgcaggagctacatagaggaagttatactccaggagagcttaaatttcactctctgaaaactctgttccatgtaagtacattcctcctctctcccctcctcagtgagcacgtacccatcagatgtgtggaattctattaaaagcagctcctcgtgaccctccagggttttgtaaagctgacaccagcatcagtgagttggaaggggctgccacagaagacagacttactgctgcagcccgcttcagagccctcagtagtactttttcctctcccagcaaatccaggaggctgggaaggtgattgttaattgtttatgagcattaactgtttaccagtcatacttactattttaaatctgaccctgccattatgttgttttgtttctgttcacagctgagctttaagctgggtagaatttcgtgatgagtcactcctatgactgtaaaatcagtatcgatcaagccttcctgttcatcctgtgagcagtttagagacagatgagacaggcttatggtttccactggctcggctccgtgcgtgtgcggattgggcttcctgagagcctggttagccccttttatctgctctctgaaacctgcgcaagggtktttagcatgcaccttgaaacctctgctgcctgaagacagtgtgcttaaatgaagggtatacaaacccatgtgaggttttctcttcccttttccatgaactccaccccaattacctgtttgaattttgcatgccagttattttcagggaactagtgacccttttcttgccaccctgggctttgaattgaaggccagtgtgccaccttttctttggctttgttagaacgttgccctcagggtcatatgtgctggctgctatgaattcttactgcttgatggacagagaaaggtgagggttagatatctggacagggcatgacagggcgggtcatcgagtaggaacattgggaccttttgcttccaggcttgagcagtgggtgagaaacactgtcttcccattagggcagtgggtgaaacactgacttccctccatcctctgggcagccttgtcaggtgggtgtggaagctgaggtgtgtctgccccaggctgtgcagtcagccccgtgttctagcttcccgtgccgaacctggccctggaggctgtctgcctggcaagggggctgcacaaagctcggaggggcatttctggtgcttggtagatggtaggcctgcccccagtgcactgataagagcatgggctgagagtgccacttggattcggctacagtgggcggcagagtgggggtgactggtgttgcttttactctagagcagaggaggcagatgaggtagatcggggccccagggatgctgagctgagctgggtagagagaatttggttttgtaggatttggagacagagacaaatttggagtgtttggatgttcggggacctgcaggaggtatgtgaggtgtgtaaaatgcagcccctgttttawaaagagcttacattgtctcttgagaagataaggtgtgcccagctgtggaatggaaccagatgcttttatgagtgaggatggagtgagcacactgggaaagagccctggaattggaggaagagatcattttgcccagagggatcttggaggtctcctggaggagggtacttagatgatcagaaggattatactagacttgatggggtggtcttggcatcagaactttaaaaatgtattttggggctggaagcaaggctggagaggaaggtttgtttaagttgtagtgggggatgaggctgggggcaaatcagggatggttttccaggtctgtaaaggctggggtaagaggaatggttggttcttaagagcaaaaaaaatcccttacatattggttctcttatttgtgctaagttaaatacatgggaggctactggtgtttatgaaataaccctgagcctttttggggaggtagtagtggatgtctgatggaagagatagaagactggtcccaggggttcttagtggcaccttcctctcaggtcatcactgtgcttttgcacattgcagttatatttgactacatttgattatggcagatttacttagaagggcactggaaaaaagcctcccaaattacaactgacacaggaaatgactttattttcttctattttttttctttgcttttctcccccaatcaacatacatttttaaacctgtcatctcacatgacctgccggtagaattgatatgtttaatttctgtagaaaataactggaaatatttcacaagctccagtagcttcctgttgtagggacccttaggactttggaatgagaagttttctattgagttgtcatatttggaaggataaaggtgccctcttttccctcgatccacatagtagactcctgtgtgcgggcatttgtttggtgtctcacgttgatgcaaatgcagccattgcagagtgagccccgctctgttactggatctccatttgctcaaaagagagcagtgtccccctccaaatctgcatgtctgaaagcattcatgcaggttcattgcatgggtctttgcattttacttagacttagcaaaaatcaggtatagtctttcctgaaaacaaaagtgaccattgtttttaatcaactgcagggtgtttggagttgtgaaatatttagggtcccgagtccattccagattcaacattgggaaagaatgagaaagctgaagcctggggcaggctctgtctgcagaaaccatgggctatcaccccctctccttagcagcattgtaaacaaacgtcatttgtaaggagcatgtcccaactgagcttgtaattataggggcaagatttgtgtggtggtaggggcatggagctggagactgggggcttccttattggttcatttatcctggcccttctcttttctctcaagtctcagctcttttaagattcagaaaataatgcaaaatgcctaagatttctgaaattcctggcttcagagacttgactacataaaagagccaggattttcaggctggccatttcaggatcagccatttcccacttcctgattcatagcttccaggatttgtaatgcctgtagacttttttctctyttgcttaaaagtggccattgaaagaaaaaataaatagcaaaatccccatcccagaagttctacttcctgttgttgtactattgagctctgaaaaacagctttgtaagtttargctcttgtttggactatttcagtggaattcttgagatctttttgtttggacaggcaagtatgaaggcgataagtcgaaagaactacagcttactcagcacagaaatgcagaggctcaaatttaagttcttccttagctttatggtgtgtatattaatataatccaagcaatagtgagttgcttagccagggtgcacagacattttccacaatgccagttgtttccctcataatgtttaatgtttatttttaaaggacatatttgggcacacgtttcatttttgcctgtaaaagaattgggaatatttatgattcttgcaacaaaggagaaggatccaaagtaaccaagaaaatgatggactggcagccttcacattttcccacaactcttttcatgaaataaaatgtagataaggctgggtgccatggctcacgcctgtaatcccagcactttgggaggccgaggcgggcggatcacctgtggtcgggagtttgagaccagcctggcgagcacggcaaaaccccgtctctacgaaaaatacaatacaaaaattagccgcgtgtggtggtgtgcgcctgtagtcccagctactcgggaggctgaggtgggagaatcacttgaacctgggaggcagaggttgcagcgagacaagatggcgccattgcactccagcctgagtgacagagcaagactccatctcaaaaaaaaaaaaaaaaaaaaagtgtaggttagcaaaagtgcctacagttcaaatgcttccatgctaaacgttgtatttcttccggtctcatttgtgatgagagtcataagattttgagaaatacaaaaacctttccagctttataggatgataatggcttggccactcaagtagttctgattgggttaactaattttggtccagtaatcatttcatttggggtgaatggatttttcccccctaaatacgggtacctggaaagttgaagcagtgaatctggtgaaacttaatcagtgatttcgtaagggttaacaaatgtttctgggtgggattcctaatgtccagcttcctctgtgtagctcagtaagtcttctttggagacactagcctgcattgtaagactgtcacatgggagcatctttttattttattttacttttttttaaaaaaatgaggtctttattatcctggctggagtgcagtggtgtgatcatggctcactgtarccttgaactcctgggctcaagtgatcctcttgcctcaacctcccaagtagttgggctgatagacatgagctactgtgccacgtagcattcttggggattattgtagggtccttttggaccacacatggttttatactctgtagctgattgatgtactggcatgtcagtgacattgtgtgtatcattacactatttggttaattgatgtactggtggaatagccatcttctggaggctcttgtttgcatacttctcttagtggcggactagcggttgtacagtaaatagatgatcattctcgctctgttttacctttcctcagctgctcttctagtaggaaaataacagccctcttagctgtagtcttctggaggctctctcaataatagaagtggaaagaaaagactcaaatccctgggcagtgactttttagttgtttcatttgcttttaaggcagaaacacctttaactcttagtagccttacagatcatttttgaaaacacctgtgcttgccttgaatggggcggtgaccactggatccccccatgctgggtacatgttttgcagtcacagacactgctggcctcacctttggtggtgaaggaatgtttccaatttctgctgatggtgtagtgctcttgggagctgggtgctctgaatgagcagatgggcatctgcttttttaagcctgctgttcattctgcaaaatagttattgtgcaaatacctgataagcaccaggtctgtgccaggcgctgtattttgtattttgcatgtctgaggccagcatctttttccctgttcctttttctcctcatccagtgaactttccactgtggttgtagtttgtctgaaaaagatttggaaaaaatgtacagccatgtttctcttgtctagagaagctgtcttaaggacttcgacaagtttcattggcagagtgaatgagtggtggcctctgaatagttgaaatgttaatgctatctataggttctagagaatctgtgtctttaaaagtcatagcgataaagtctcagctttttgagagagtgggtttcagacatactactatacaggaaatctgattgttgcattgaaacaggatttgttatcacatcacggttagacatacccaaaaggcaaaaactacagtggtcatgattgctttacataagattttggaggagaaactgttagctccatgaaagcaggaactgtgttcactcttgaatgcctgctacctgcacatggtgaatgttctataaatgtatattaaagaaatggaggtccttagagttccaagatcaccgtcaatatcatcaccctaggcttcctcgtccttccagttacttcttttccagaagagtccattgcctcctttatatgaggtctacagagcgcgttcagagggctcttatcattgattcagcaatcacgtgtacacatagcactagaatgacttcacatatttgacctgtttaaaaataacgtgcagctatgacgaacagcgaacctttgattagggacacatttgcctgccgccagacactacaagtattatgtgtattgcttttttcaaattataatagtaatagatgattatgagaagaaaattagaaaataagttttctgtctctctataaaaggaaaataaaaattatccttaatctcaaggtaaccattgttaatattttgttgtgttttcctgagattttccccctagacttatatgtgtatctatatatttaaaaaaatgaaattagtagtatactatgtacacacatattgtgaatttctgcccataacattatatctttatcacctggaatgaggtctttaatgaaattattaaaattaaaattattctataaatgctaaatttaggtattttacaatttttttttttttttttttttttttgagacaaagtcttgctctgttgcccaggctggagtggactgcagtggtgcaatctcagctcacttcaacctctgcctcccaggttaaagcaattattctgcctcagcctcccgagtatttgggactacaagtgcatgccaccatgcctggcaaatttttgtatttttagtagaaacggggtttcaccatgttggccaggctggtctcaaactcctgacctcaaatgatctgcccaccttggtctcccagagtgctgggattacaggtgtgagccactgtgcctggcccattttataattttgatcattaaaaaatgatgtgataaaattattgtgtattgttgttgatacactactctgattaattctttgggctagattcctaaaagtggaaagtaaggaataagaattgtgtaagtgtgcatgatcctagataaatattgccaaaatattttgcagaaaattcttagtttcagcttccagaagcagtgtctgtcatccatactccaccagaattgaacactaaattgagctttgcaattttagcatttaaaaagttgtatcatttaatatagaatrgcagtctcttcattatgatcttcccttgcctagtaagtttatactcaagtcaaaatcggttaatcatgcatattgattccttgtttatctttttcttttaattctttaatacttctagaatgtatttgtagttaagtgaagtaagatacctcctcctgttgacgatttagtttccccacattgtgctgttttttttcttcactggattatgtaacaatatcttttcttttttttctttctttctttttttttttttttttttgagagagtctcgctctgttgctcaggctggagtgcagaggtgtgatctctgttcaaagcagcctccccctccccagtccaagtgattctactgcctcagcctcttaagtagctgggattacaggcgtgcgccaccacgcctggctatttttttattgtatttttagtagagatggggtttccacatgttggcctggctggtgttgaactcccggcctcaggtgatccgcccacctcaccttcccaaagtgttgggattacagacgtgagccactgcgcccagcctagagactctattttattagtgttttttgtagacaaagtctcactctgttgcccaagctggagtgcagtggcgccatctcggctccctgcaacctccacctcccgggttcaagcaattctgcctcaacctctcgagtagctgggactacaggcatgtgccaccatgcccggctaatttttgtatttttagtagaaatggggtttcactatgttggccaggctggtcttgaaatcctgactttgcgatccgcctgcctcgacctcccaaagtgctaggattacaggcgtgagccaccgctcctggccgagactctattttaaagctgtcttctcccactgatttgccttttgtttgtggtaaaatcattttgtcttaaacactgtagcttcattatacatgttaacatctgctaggaagaatctccactcaggttaaaaaaaaaaaaatttgaagcaccattatttcaggtgaactttgtgtgtgtgtatgttgttttgtttttgcaattcttctccgctactcttccaaaaaagaaaacacaaatttattaggttttgattgttaataaatcagtttgggagaaaacatttccagatatttgaattactcattcaaggacatttcgtgtttctccatttactcaactattatctatctatgaagaaatcacagaaggtcatagaggttgtatacttttccttttgggttatttctggttaatgaatgctttttgttgctaatgtagaaggaatctttattccccattgtttattttatatttttaaattttttttcaattaaaaaaaatttttttttcattcctgagacagggtctcgctccgttacccaggctggagtgcagtggtgcggtcatgactcactgcagccttcagctcctaggctcaagtaatcctccacctcagcctcctgagtagctgggactactggtatgcgccaccatgcctggctaagttttttctttttcttttagaggcaggatcttgytgtgttgcccaggctggtctcaaactcatgacctcaagtgatcctcccaccttcacctcccaaagtgctggcattgcaggygtgagccaccatgcctgaccttccttgtttcttttaggtgattattggttgtgtgtgaggaaagctctggtattttctgtacttatcttgtacctacccaatttgttgattgctcttattcgttataatagtctttcagttgactcttcctaatttttttgtgccgagaatcattgatgacaaataaggataatttggtctccatttttctggtacataatacgtctttacttaccatcagttgtgtgtcacttaggaatataaatggctgaaaataactgaaagcctgcctaataagggagtaggccgacaggggctgacttttctcaagttcaggcagtctggagggaaggagtctgtggctgctgtgaggtgctcaaagagggtgtgaggactgggctcctggcttctgtttgttcatccttagcctgtggcttttgtcctcgtgaacacaagatgacctccaggaattatgtctgtttcaggcaggaagaagttgagaaggaatgaagacaaaaggcaaaaaaggcagaatgacaggtcagcaagcgctgctcagccagtaggccctgcttctccttggccagaactgagttgcatgcagctggctagaaggtgggagatgaatgtgggtatggctagtgggttgggcatgggggttgggccaaccaagcatggttggtcatagggtcttgctgcattagcctgcacatccagaattgttacatgttgattacaggcatatttgtccttttttgtctatattaatgataatgcctctgtttctcaatgtgtaaggcatcttttggtttaagaggttttcatcatgttgaagaattgcctgtcttgttttcttgggtgatttattaaggatgggtgttgaatgtcatcagatgtcattttggcattcatttggattcagaagtggttgttacacctattaattgaggtaggaatagattacctagtagtaatccctcctcaaattcccgtgttaaactatttttggttgcggtgggtggctgtttaaattcctaattaaatttggtttgctaacatattcagattttttaatctcttattttaaatgagatagctttacagttctctttagatgagttcttttccagattttgctgtcaggcctagactagttttgtaaaatgaattaatgacttttcctttttaccttctctgtaacagtttttatagtgtggcaataaactgtcctttgaaggtttggaacaactcacttgttaaatgcctggaggctgacacttaaaaaaaaaaaaaagaatagtttttgttgtgtttctttttgttgttggtgttgtttttagtcttcagtgcagtggcataatcttggcccacttcagccttgacctcccaggctcaagcagtcctcccacctcagcctccctggtagccgggaccacaggtgytttgccgccacacccggctaattttttattttttttgtagtttttgtagagatggggttttgccacgttgcgcaggctggtctagcattactgggctcaagtggtccacctgccttcgcctcccaaggtggtgggattaacaggtgtgagccaccatgcctggcgtaaaaagatggttagtttttgttttgtgacagctttaaaaaaggtcttccatgggtgttggtctgttccagggttctggttctttcctctgatgctcttttttttttttttttgaaacaggatctcgctcttgtcccagatggtgtacagtggtgtggtcatggctcactgtagccccagcccactgggctccagcaagcctcccacctcagcctctggagtagctgggacccatacctggctaatttttaaatgttttttagagacagagtctcgctatgttcccatgctggttttgaactcctgggatcaagcgaccctcctcccttggcctcccaaagtgttgggattacaggcatgagccaccatgctggccttctggttctttttaaatcaattttagtaatttagtaatttccagcaagtcaattaaaaattatagctcagttgtatgtagtattttctgtgtggtgttatgccctctgtatctgttttctcagatgttttagttgcttttctctcttaatcttgattagayctgccagagctgtgcttattttgtgtccccatccaaatccagaattaattgccgtgctccacatgttttggtcaatggtggacctcrtctgtaacagtagtcccatgagattataatggggctgaaaacagtgctgtcccctagggatatcgtgtctgttgtagtgcaaggcactgctcacgtgtttgtgttgatgctggtgtaagcccactgtgcttccagtcagatgaaagtgcagcgcatacaattgtgtgcggtacctaatacttgataataaacaaccatgttactggtgtatgtatttactatgctgtacttttaattgttagagtgtactccttatacttattaaacacaaaattaattgtaaaatagcctcaggcaggtccttcaggaggtatccagaagaaggcattgtgatcataggagctgatggctccgcctgggttactgcccctgtagacttccagtgggacaggatatggaggtggaagacagtgacatggatgatccggaccctttgtaggtctaggctaacgtgtgtgtttgtgtcttagcttttaacaaaaaagtttaaaaagttaaaaaaaaaagttaaaaatagaaaaaagcttatagaataagaatataaagaaaatatatacaagaaccaaaatttaagaaaaataaagtttgtaaaagtaaaaaaagttgtgcttaagctaagtttaatttattattgaagaaagaaatttttaaataaatttagtgaggcctaggtatacagtatttataaagtctacrgtagtgtacagtaatgtcctcagccttcacattcactcaccactcactgactcacccgagggagcaacttccagtcctgcaagctttattcgtggtggtactcccatatacgtatgtatacttttttttttttttgagacagagtctcgctctgtcgcccaggctggagtgcagtggtgcagtctcggctcactgcaacctccacctcccaagttcacgccattctcctgcctcagcctcccgagtagctgggactacaggcgcctgccaccacgcctggctaattttttgtatttttagtggagacagcgttgcaccgtgttagccaggatggtctcaatctcctgacctcgtgatccacccacctcggcctcccaaagtgctgggattacaggcgtgagccaccgcgcctggccttttgtttcgtttttaagagacagggtctagctctgtcacccaagctggagtgcagtggcgtgattatagctcattgcagccttgaactcctgggctcaactgattctgttgtgtcaccctccccaagtagctagaactacaggctcatgccaccacacttggctaatttttgttttttaattttttgtagaaatggaatctcactatgttgcctaggctggtcttgaactcttggtgtcaagcaagtgcttggcctctgaagtgctgagattataggtgtgagcctggccatatgtactttttttttttttttttatccttcttactatatttttattgtaccttttctatgtttaggtatgtttaaatacacacatacttaccatggtgttacaactgcctgcagtattcagtgcagtaaygcactacaggtttgcaggttggtagcctaggagtaataggctatactgtatagcctaggtgtgtagtaggctataccattgaggtgtaagtatactctgatcacacaatgatgaaatcacctaactgtgcatttcttagaatgcatccctgtcattaagtgatacgtaactctgcttctttaagcctctgtagcactttggttatgttaggattctgtgtctttacaagtctgctttgctgatcgattgtgacatcttgagggcggctgcactactttctgcctgcaccttgtttcgcatgtctacctggcgcatgacatacacctcgttgttcagttcttgcttctctgcttgtgtctttgcattcaccaccagctattctgatagttatcaggaggttttcattgattgcagtctcgtgcaatgggtgcaggtaatgggtagccttatggaggagaaaatgcttacctatttgggttcattccaaggagtagttcaaggataaacctctaagtttggggagtgctgtaatttgctggatatgtgagccatagaagacagcttggatggcatctgatgcttcctggctgcagggatggaggcagcagaccctcctgcctggggtggttggttgccatccctgtcgggggctcatgctccaccctcaaggctattcttgggggagttgtgacatggctttcataaaaactcagtggaattttaccctgtgtattagttagtaaaggtgagtctggttcagttggtttgagtcaaaaaatctgttaatatctctgctttagacctgcatcaggctaatacttgaatttagggtctgtccctggtgtcatctgaatttttgtttgctatgtgtgaccaaggagatggtcactcttcaggatgggtgggtggaggggagaaatgctatgatttctgttgggtcatgtgaaatcaatttggaatgtggatggggcccttacactttttcttttgagcttagtgattttctgtgtagggtggagagcgattaggaaggaattcaccacccttaggtcctcaggcatagggtcttctaggggcaggactgatgagtgaacagcagggtggatggagcagaaccgttggaaccttcagggcaggacctgccaccattatttggtcacaggaagtgttcagtggtgaacttgttggaaatgattttgagtaacttccgtctcctaaatcatattaggactctttggtctcctatggttatctgagttgttttccaggaggagctgggaaggtaccaggagaaagatgactgtccctctcatgtttgctgagggtgttcctgtaaggtgagctagtgttccttttagggcccgtggagaccgaccttcacattgaagaagcatatctgtgctccgagatgttttcatggggagaagtgtcaggtgtaattataaaaggagtctttctctttaaatactgtaggcgatttagaaatagtggaggtttaattgaagagcttgtctacgtttttacattttccttaggcacagagaaactagtatctttctctgggttgcctttttttttggagacagaatcttactctgtcatccaggctggagtgcagtggcctgatctcggctcactgcagcctctgccttccgagttccagcaattctcctgcctcagccttccaggtagctgggattacaggcacgtgccaccatgcctggctaatttttatatttttagtagagatggggtttcaccatgttggccaggctggtctggaactcctgattaggtgatccacccgcctctgcctcccaaagtgctaggattacaggcatgagccaccacacctggcctgggttgctttttaaattcatacctactgtcttatttgggtctcaaatgtgatcagtggttatacttttcttgstatgcatttaagttggagcaggctccggggcaccacttccctccctagagttgatgaacccctcatatcagtgacctccccatgtcacagtgtatctcgtgtgcactgctagatattctgatcacacagtgctgagattactggtttctctccctttctctttctgtggttatagggattctttaagggcaggcaacatgttctttgtttccataggatctgacaaagtgcatggcataggtaggtgttcatcaaaaggggtggaatagggttgatctcaagggttttaagagagatctgacgagtttgggtgtgtgacttaaaaagcagatacagcgccttttcacggatacacctccgtgattcctcaagtggtctggctgtgtttattttaggattctaaaagtaaagtgttctgttctgagtctttcacgatctgatgttctccagttctgtgaggtctcctcctttagtcccatcattggggctgtttctgctcggaaggccaggaagttgctggaagtctgctgggctttgcaaagggacttttgcttgtgtgggcattgcccagttgtgttacaacttgtttacagccgttggtttttaagggatgaggtaatcttagctcagcttagtgtaatacacaacagttttgtttattgagaaaatcattgttgaagtttttcagatgttagagatgttatgaattgcaatcaagtcggtatcctcttatataagtgcatctgacaagcccatttcacaactacatctcatcagtcacagttggatggcaaggtttattgtttaaagtttttgttttttcttttttaagttgggaaaggaagacagatggtttcagaagccaagaaagggcacaaaggcgtggatatttggaaatcgggacataattcaccattcttcttaattttttctgatctctaagacactgagacagctgttaattgaattgcttgttcacagtatttgagacgtaatgaaatgtgagtgtcctaatcacctggcgggcgtagatctttgggatcctcctggaggcttagtagggctgccctgagcagtattgtcttctccagctgggcctctgagctgtaccatgtgcccgtgctcagcctcagtccmtccctcagccagttgttaaatcactttggacgtgtgacagcctcaacatgtcacagctttaaaagttcagattttaaaaaggtaaggaaatgatctcctagtgagacaacttctgcctaaaaaataaaagcttctaagacataaattctgtgttatgaacaacttgcaattttcatagttttcagttttagctctggcagcctcwgatagatcttaaatatgtttatcacagctggaaaaatgttttattgtcatctttgtttatcataatatgccacctactctggttgtgtcttacaactgtagctctgtggggttttttttgtttgttttatgcttgctaatgggggaggtggggggtgkgggcggatgaatataaatgatacctagaaattgaaattggaaaaaaaaatgtattcagccagtactctttccaggttatagctaaacgtcagttggcaacctctatgctgtggtttattgagtaacacttaatacttarcacagccctcagtgaagatcttttatggccttttctgaatgttatacaaacataactaaagcttatccagatgaggacagggacctttctttccttcctttttaaatggagcaaaatttggccactgggttgctgtggatgagagagtagaaggagaaaggcagtcatcgggagactgtgtgctgagagagcgcatgtgggatttggcttcaggaagtctgggcttgcattctatccagcgctaatatttagtgagtgtgatttggggcaaattatttcgtctccctgagcttcagaatgtttgaaactttgtgaggagtctgaccccacactgtaggctccctccatgtatatatttcttcttccttttcctttttttttttttttttttttwaatttttgagatagtgtctcgctctgtaaccccagttggaatgcagtggcatggtcatggcttactgcagcctcaacgtcccaggctcaagggatcctcctgcctcagcctcctgagtagctggggtcacagakgtgtgccatcacgcctggctaatttttaacattttttgtagagatgggagtctcactatgttgcccaggctgcactcaaactcctggactcaagcagtcctctccctccagcctcccaaagttctgggattacaggcatgagccaccatgcccggctggaactgttggctttgaaraaraatgatgctgtgcttgcctttgcagtcctgtcaccatacttcctggaaagtgggtggacacgctggatggtagatgttgagttstttagatgcctggatgcttacatgctttgtgtgggttcttactggggctgtaacttactagaggacagactccaacttctgcttacttagtctggggaggttaataataatctagggcacccgcttcccagtgggtttccatcagtctcctccagcccactctactctctgttagccagctgggcacctcttcctctgtgtcccttcggtatcttcccagtggctctttccacgactggctcagaccatgtgtatatctgctcattgtctgtccagggtccctccaaagatgcctctgtgggctgggcccctggtggtgcttcctccagataattgttgaagatggaacaggagtgtgcaagaacaccagcgtgcttccagtattcaggtctagcggcaggtcccaggcatcagcggctcaccactccaccgcaggtagcctgattgcccagccttggagccgcagcctccttgggtggtgtggcagctgtcagtgtctgaaaccattttgaactttaaagggtggtgtcagacagcagctattgaggctacttaaaagaatttttttaaatgtacgagttcagtggcattaagtacattcatattgttgtgcaaccatcaccactgtccatctccagaacttgttcatcttcccaaactgaaactccatgtccatcaaacaactccccattgcctttttccccaagtctttggcaaccgccattccactttctgtctgtaaatttgactrtctggatacctcatgtaagtggactcgtacactatttgtccttttgtgactggcccattttatgagcataatgtcctcaaggttcattcaggctgtagcatgtgtccagaatctccttcctttttaaggcccaataatatttaataatatatgtatgtgtgataacacatttatataatgtccattaccatgtggtatatatgcttatccatttgtctgtcgatggacacttgagttgctccccygctttggctactgtgaataatatgactgtgatcatggatatgcaaatatttccttaagtctttcagttcttttgggtatatacccagaagtggaattgctggatcatatggcagttctatttttaattttttgaggaaccactgtactgttttccatgtagactgcataagaattccaatttttccacatcttgccaacgtttatttttatttatttytttaaattttttatagtagctatccattctaatggatgtgaggtggtatctcattatggttttgatgggacttttgagttttagcaaatatcaatgaagtatttaattttttttttttttcttagagacaggatctcacattgttgtccaggctagagtgcagtgatgtgagcatagttcactgcagcctcaacctcctaggctcatgtgatgctcccacctacgcttcctcaatagatgggactatgttcctgcgccatcactcctggtgaatttttaaatttttgtagagatgcggtcttggtacattttctaggctggtctggaagtcctggcctcaagcagttcttccacctgaacctcccaaagtgctgggattataggcgtgagccactgcacctggcttatttaaatttttatgggtatgaattcacttaaaagctgaaggttttgagaggagagrgagcatrtgaaaaaacctaaaggttttgggaggaggaggagaaggaagagagggagcatgtgaacaagagcaactgattacttccttgtcattcatttgcccagtgtttactaagcacctgctgtgtctcagacctgtgctggtttggcccttgtgaaggacagtaaatacagtgcagttccagctgcgcatgggatcacagtccagtaggtaaacgagtgcctaaacttaagagaaatgagtgcagttggggtcctgtggcggtgaaggggcgagtctgcacccaggcgagtgttaaaggcctggcctagagaagatgggtgttttgatggaaggagctgctgggaagcatgtgtactcggtgtcttggagtttagaaacctcagttggctccatgtctcgtccttagtaaaggaatatcgggagctgagactggatgtattgacacaggtcaaatcacagagtcttaggccatttcaaggaggttggatttttctctggaaggcacagggaggttttgaaggacttaatgcagaagaatgggcactgtcaggtttgtggtttggaaagtccgccttggtagtagggtggagggtgcattatggagggctagaccagggtccagcccccagcgagatgctgtgtggtaaccaggggagagagaggtggtggtgttagaagccacgacttggcatagaagccaaagcatccccaggttgtcattgtgtaattaatggttaagttggggcaagaaataaagctcttaaaagtgtccagctgtagagctctctgcctgtttttatcttcagatttttgtctttgccatctctggcctccagtggaaggccgaagttacttaacttccttgctggaagcagggctcctcatgattgccagcccctgtttggtagtggtcctggagtgctgtggaaatgggatacttggtgccacttaccttggggctttgctcctgaactgcagcggtgtcttgtgctctgtggtttgtagcatggaacagaggctgatgggcggggagtttgagtcccagtgattgaggccccctgcctgcctgcaccttactgaaggaaggacatggtggcttctcagtgtgctctctggtgatctgaacctagattcttgtttcacgggtagggggcagggttttggattcagccctggccagccctggcccaagttcatagtgtcagtagtatagttctcccaccacccccttctctcctgctcctgttttctcccccgccccttctctcctactctccttcctctcccactctccctcctctctctgcctttcacttccccccacactctctctcccccgctcccaactttctttctctcttcgactcaccacacaacacacacctgtgtgtgtgtgtgtgtgtgtgtgtgtgtgtgtgtgtgatggcactgttatttcatgtgtatacctttgcgtagcgttggcacatgtgggaatgctattataatgctttcgttgggggtctgtgctaaccactgctgagtgtgcttcatgttttctagacagcatgagaccagagctctccaccttgccattagctggtgggagaattttgagaaagtcacccaattgctcttaagtcctcatttttttttttaaatctgtaaaatggtatcacagatgcttatagctcaagactagttgatgagggtctgtgactcaaaaggccccatagatggggttcagagggcctttggaaatggcgtgcaagctctttgtaagtgtattttttttggagaaagggcccagctttttatcagacatcctgagagattcaggacctaaaaaataaaccttgattaatcttggaagcctctttttacgcagtacgctttgattcatcagtatatgcatgtggatgggttctcagatggcctgatgtttctcctccttcctctgtgtggtgggcgacgactttggctgcccagatgttaacatcagtaagcagaagctcagtcagtgttagcaaaattaaatcactctgcaaaaatcaatgttagtgaaattaaatcacttgatcttaaaagcagcatgaaatagcagtttttcatcttcattgtgctgttttcccactctagatatcttgcagattttttttggttgcttggttggttggtttttggcgtccttttcaaggacaagcagctttggacagttgcactacttttttttttttttttttttttttgacagagtcttgctctgtcacccaggctggggtgcagtggcgtgatctcagctcactgcaacctctgcctcccaggttcaagcagttctcctgcctcagcctcccaagtagctgggattacaggtgtctgccaccacactcggctaatttttatatttttagtagggacaaagtttcatcatgttattcaaattcctgacctcaagccatctgcctgccttggcctcccaaagtgctgggattacaggcgtgagtcactgtgctcagccagttgcactacattttttttttagatgccattgttgaggatccaggggtttgtcatagattgattaatcagaaagtattaatctaaagtattagaatatattgattgcaggcagggaccttgcatagtttaaagatgactcagaaggcacattaggttcttgccacactttgctgccatcacagatggatgtgagttgcccccttatataggtctctcgggatgccccagtggagaacagcattgatgttgaacagatcctgtccgatggagagataccagcgtttcagccagcggtgtgagtgagggcaggggccacctctgagggtgcttgctccctcacactgtcctcacgctgccctcaagctgtgggcaaaggagagggatcctgtgccatcacagccctagaagcagaattccaaaatgtgggctcctttgggtgtggtttgggggtcaaggagatagagcaagtaaggaatgaactttgagggtttatgatcattttcatgatgataatgacctaaaaacatgcttggctgggcatggtggctcatgcctataattccagcactttgggagactaagacaggaggatttcttgagtccaggagttcaagaccagcctggacaacatagggacaccccatctctacaaaaaaattaaaaaattagccaagcatggtggtgtgcacctgtagtcccagctactcaggaggctgaggcaggaggatcccttgagcctaagaggtcaaggctgcagtgagccatgtctgtgccactgtactccaacttgggtgacagagcaagactatcccaaaacaaaaacaaaaacacatgcttatggtaggcaattaaaacaggaggtaaggagtaaacatgccaggcccctcctcctctcctctgactcttccttcttcccccctgcttcccaagggtaagctttgcagatacttgctatgcaagcaaaaatgctattcttagccatcgtttaaacacagatttgcaatttgtggtttttcatttatataaattttggctctcttcctatagcagaatgatctttgtttttaaaatgattttaagtatacaattaatatgtgaatgtatgtttcttatggaaattagaacaatacacagttacagagtagaaggtgataggtgatatagctcaccctctcctcttcctgctactctccccagtctgcttcactccccggaaggaactactggcccatcagcatgtctccttccaggcattttttccatgtggttatgtccacctgcataagaaactgggggcggcagggtggggcggtgttggcgggtcaggcagaagcaagccacagagcagtaagggtactttttaaaaaaacatttaaatagatccctgttgtcctgcggcttacatgctcatgcatactcactgtttctttaaataaactttttcttttagaatagttttagatttacagaaaagttgccgcgatagtctagagagatcccatgtacctcttaacagcttcgcctctgttaacattctgtgtcaccatggtaatttgccacagctaaggaaccagcattagtccatgactgtcagtgaactaaactcaagactttttttggattttaccagttttgcccaatgttcctttcctggtctaggatcctgtgcagaatagcgcatcacagcacattacatttagctgtctccttcacctcttctggtctgtgacagggtctcagactttccttgtccttggtgactttgacagtttcgagggacactggccaggttttgtgcacactgccccttaatttggagttgtctcatggttttttttgtttttttttttttttgagacagagtctcactcgtctcccaagctggagtgcaatggtgcaacctcgactcactgcaacttctgcctcccaggttcaagcaattctcctgcttcagcctcccgagtagctgggattacaggtgcctgccaccacacccaactaatttttgtatttttagtaaagatggggtttcaccaggttgggcaggctggtctcgaactcctgacctcgggtgattgcccacctcggcctcccaaagtgctaagattacaggtgtgagccaccctgcccggcccatggttttcttatggttagtctgggaccatgggtttttgggagcaagaccacagagctgaaatgccctcccttcagtgatttgtcagcatgacctatcaccattgttgttaaccttcaccacctggatgaggcagtgtatgcgtggggacatacatctatttgccccactgacatgagggttggatctctagaagaggagtcactgttcagaggttataggcatttgtattttttggcagatgttgtccttcaaaatggctgtacacatatgctcctcccaaaagtaggagagtgcctgttgccccatgtcctcactcaagcttggtgttattagattggtaatttttttgtgtgtgaatctgttaagttaaaaatatttctttctttggccgggcacagagtggctcatgcctgtaatcccagcactttgggagtccgaggcgggcagatcacttgagctcaggagttcaagatcagcctgggcaacatggtgaaaccccatctctaccaaaaatacaaaaaaattagctgggcatggtggtgcttgcttttggtcccagctacttgggaggctgatgtgggagtatcacttgagcccaggaagttgaggctacagtgagccgagatcgtgccactgccctctagcctgggtgacagtgtgagaccctggctccaaagaaaaaaagaagattgattgagatagggtcttgctctgttcaggctggaatgcagtggtgtcatcatcatagtttactgtagccttgaactcttgggctcaagcagtcctgctcctttggcctcccaaagtgctggggttacaggcatgagccactatgctcagccaagctaaaaatatcttagtgtgcatttctctaattgtcagaagtgtatttatttaccataccctggaaaccttatgtaagatgatggtgagtttggactttccagtaacatttggaaactgtttagtaccaagctctcattaacaatataaacaaaataggggtctacccttaaggaatcaaagccattatctaaaagctctttcccgcaacaactacctgagataatgtccttggtcatatgccccagcatttaaaaatggagttagtgagagtctgttgtttaccacctgatacattggtaagagctgcttgatggtatggggacatcagtagggaggatatagacgtagccacccccgccctasatagtaggggcctcagggtggggtaagcctgggtgggggaggtatgagtggtggaacagtgggagaccctggatccttagtctccagcgtgattgcattttgccaaggctttgtcccatgtccctttgtcccgtgttccatttgcccgtggtgttgcctagagagcatggagrggctggtggagcatgctctgtggttccctaacccagggctgtgtggggagagcttgcagcacccccctgaccccatatgaacgtccttgctatttcctgctgtgccatccagcaactataggatgctgtgctgtggctgggagacctgtttggtcttggaagctgggtcctggatgagcagaatgaggcaggcatagaggtgatgttggctacgggcaggggagcrtttgctttgccttggagtagtgccatttccatgtagaggggcaagatttaccaccctgttgtggggatttgagactttgggttttgttttcctttacaccttgagctttgttctacagcaggtccctgggaagactggtccacaaagctgctgaatggggctgctgtccwkcagccctgcctcctgctgcagaatgcagaggacgctgtagacttgcttggtgggtgcctggggttttctgcctccctggtgcactgggcacagcggcttgcctgccttttgggtcgtctccacctcccagggatgtttttgttccctgatcgaatgacctcctgttttgtttgttttttgagacggagttttgctytgtcacccaggctggagtgcaatggcatgatctcggctaactgcaacctctgcctcccgggttcaagtgattcttgtgcttcagccttctgagtagctgggacttcaggtgtatgccaccatgccacgctcatttttgtatttttagtagagatggggttttaccatgttggtcaggctggtctcgaactcctggcctcaagcagtgcgcctgcctcagcctcccaaagtgctgggattacaggcgtgagccaccgtgcctggcctgacctcctgtcttctgtttttgcccactgtcaagggtagacttcttcaaggctgtacttgtgctatcctaaagaggagtaatgggagacatttctgactttgtcagcatgctgcttggcagcacctgcctcgtttctggtgaccatttggaaatgtgtcctttatctggtagcaaggagcatttacattgatccctatgcacttaattggcatacttttattcctctggattttttttttaaagcataattgttcgtgtctacatgatgtaacatgctgctgacttttaagcaaattaacagagttcgtgctgaagcgcaagggtgcagggaaacaaaatgggagggttattaaaggggtgaggcggctcctcaaagatgtcactgcaccattcattcttgtgttcctggcccatggcaggctcattaatcctccacgacaatccattagcatgcctgtcaacccttcagagaagatgagccataggaaggcttagggatccccacttgaactgctgtgtggctctatgaacatccccaccttcctggagtgaggtggttgtggccacctgactttccccattttttttttttggacctcagcctccagcgctcctgggccagactcagggtgggggggatgcaggtgccagtgactgacacttggcccctcacacttcactgcctgatttgctttaaaggcaagggttgctcatgcttgtctgagctctccatctgtttgagaattatattgttctcaactggaacttgtaaaagagaaaaaaatgtacttctcaatttccatggaagaatatagattttctggtggggtggaaactttcttagcatgaagggatctttgtgtgatctgcgcatcagcactgaataaagaatgggtgcgccgaagtcggggaggccgactttcctgtggcttgctggggaaagtttgaactgtgtgtaagcagtgcgtggaaggaaagctaagtgtggagataacgaagggaatgggatttaatagaaacagggtgtgatgagtggcagttgcctgatgaagtggaaatcttgtgttccaaatttgtgagatccatttctgtcctctaaggaaaatgttgtatgtgcaggaggagttcatgtagttgggttagattgtgttttctgtctttattttttttcctgcctctatgggttgtgaacaaaaacaagaatttgatattctgcagtatagttaactcgtgcaaacagtgtatgcttttcagtgggatataaggtctgaaataataggattttccctagtaagtcagtttcattcctttacatgtgggttatgagatacaaagtgaagctctgtaaagctttttacgagctccctgtgttgccctcctttgacgggtcaaggcattggggttgacagaggtttctactctcagaggctttaaagaggtgcccactctggtgagatggctgtcagcatgcacgatgtgtgtgagagagcacctcttcaatcatatgcacctggctgtagcatccttgtcagccttaagagatacctccaaagcggaattttctacccctagaatcatgtgaggtcatctcaatttaagccccagctctgctccctaaattacctgagtgatcccaggtaggtcatttgctcattgttaaccatcagtttccttagctgcaaaacagagcagataacaccccaaaagagttctcatagtaaatcacatcaggcttacacaatctcagaaatgtgcagctccacaggaatcttcattacctctttaggcagtccagtcgggtttcaaatgaatcctactgtctgttcttatatggaaccacagtccctcaccctgtgttgatctaagttctctgtttctctcctccagcagggtcataaagagcctgaccagtccccctccctggagacctttgtgtgctgggtttctgcagccgttctccatgagaagggacttctggtccctgctctcacttggatgttcttccactgacttatctctcttaatgtgtggaggcagaaacccagttttcagggtctctcccctggccccttactaagtctcccttaggtacagtctaagactgcctgactttttcttctttttttttttttttttggcagccacaacatcacatcgtcacatacagaaattatatccaattaaatctcctaagtctttttcacacctcctacatttgtgcatttctttttttgcacccaagtgtccaaatagcatttatttcctctctattgcaattccaatctgttgatctttttagctcttgactctgtcatccagtgtatttgccattgctcctggaaacttgtcatctttgaattagataaacattttatctgtgccatcgttcaagtaattgataaaaatgttgaaatctacagtactcagaaagagacctgtggcctcccactagagaccttccttggtctgttcattaatcagcactttgtagggtaaattgaacatttactaagctattcagatgtagttcatatttcttcaccttgtcaacaaagagatcttagcaaggcattgtagaccaagtatgtgttcctggaatatacatattaagaaaaaatccttatgccaagaaaatgggcacatccccaaaacccaggttattgtagtttacggcttctgacccagggcttcactttgtagcagtgtttttcttctgtttttgcctttggctgataccactgctagagtgcagataagagaatgttactaccagggggcttgagtgtcgggctatgattggctgtcatctggagcagagtgggactgagctgctcaggagaaaggtcttcaggtgattttttttgggaagctaagagcactggttttagacatcctctcctggctgatgatgggattggccttcatggggctgctgtctggctgggctggtgggcagaggttcctgtgggtgtggatggagaaatcctaaatgccgagggtrcctggtcttagtagaaatcgtaggatgcctcagtgaagaagtcagggatgcggattgtcctccggatgcttggatgagcgtgcagtggaaaaagtactcctttgggggaagaggtgaatctggaggtgttagagcagaagagtaaatgcagaagttgtagcagatacaaaggctttggcaagagtgggagtgatcattgaagggaaggcaggggcttgctgggacaggctggagccgtgatggaccctcatagtaaccctgctgcattttacaaaggaagaactgtgttggggtacagatgtgccaaacactcaaagttagaaaatcaacgcagtcggttgtggcttctgcccttgaaacatcagatagtgagaacctgccactgttcagtttgcagagtggttggttgcatacagtgttttagctcttgcccactcaatacagaggttgcatgcgggcgtccacctgctccgccacctctgcctgcttgtggctgtgtgcccagagcccatttccctggggagtcagtgcagcactcctgggggacccttctgtttgtgtcctgacgaatctgactgtgctggatgcagtcccacagccacacctggtatgggtggcatctttaaaggcctggcctgtgtgtgctgtatctgcagcagagctgtggccaaacctgctttccttccatctgggttccccttggttctcggtggtggacgggctgtgtggtctcccctcagctgtccacttgcacttgtgttaaaatgcggcagaactttccctctatacttaaattgtggtgaaatacrtatgacataaaacttaccatcttaacttttttttmttgagacaggatctcattctgtcacccaggctggagtgyggtggcgcgatctctgctcactgcaacctctgcctcctgggttcaggcgattctcatgcctcagccacccgagtagctggaattacacgygcccgccaccatgcctggctaacttttgtattgttagagatggggtttcgccatgttggccaggccggtcttgaattcctggcctcaagtgatccccctgcttcggcctcccgaagtgctgagattacaggcgtgagccgccgcgcctggccttccttttttttttttttttaagagatggagtcttgctctgtcgcccaggctggagtgccgtggtgcgatcttggctcactgcaacctctgcctcccaggttgaagtgattcttctgcctcagcctcccgagtacctgggattacaggcgccaggcaccatgcctggctaatttttgtatttttagtggagatggggtttcaccatgttggccaggctggtcttgaactcctgacctcgtgatccgcctgcctcggcctcccaaagtgctgggatcacaggtgtgagccaccacgcccaccggcctcccatcttaacattttaaagtgttcagtttaagtacctttacactgctgtccaatcaatctctagaacrcttttcatcttgaaaaacggaaactctgtacccattaataactcccattctctcctaccacagccacgggcagccactttctgctktctccgtgagtctgactactttgagtacctatgagcagaatccgcaggatttctccttttgtgactgccttatttcacttagcataatgtcctcaagctccatccaggttgttgcatgtgagaggatttccttcctgtgcatgaactagagtgatgcagggactgacctctggccatgtgatgggtggttggtgatggatccaagaggtagctggtctctgaatactagcccagtccttttccttgctaggaaagtccccagatcagatagaaagcctcagtatttcaagaagcttctgttttgacaccacatccatgaagaatcacactgcagggtaggggaacagatgagtgggatttctacactgttatcagctagacttagataactggctaattgaaaagagtacaggtcacttaaggaaactggagcattgtagggcaaggtaaagtgcttttgaaatgaggatgtgaactgtaactggaatgatgtaatgtgttctacaaaatgaagccagtgagaggacaggggacacagggccgacttttatttaggacatttgcctggttctgagaagaaagttgaaagtcacgagagagagggaaaggaaggcagaaggaacttggtttttgcaggtgcctgctcagcatgggccttgccccagcttggctgtacctcacagcaccatccactggctctacagtctgtccttcggaggtttagggtgctgtctcatgcacagtgggtgctaggtggtagtgaggacagggtgtgggactaggcaggtgctgcccctcggaaggcctcatggtgaggcaaagatctctggctccgagggactctatctcctggtgtcctgcttcatcgagaagccagccacccatgggaactgtggataattagaaaggcttagaggctcttctaagggtgttttttgaaatatggagacctagaatattgggctttgggatattttaagatgagaaaggcatttggagtaactgtcagagcagataaagttgtttttatgaagatccgggaaaacggttgttacaaatacagctctgcaccaattctgcgccagtctgtttggctacagatgctttcagtggaggggacactggggcttgtgttccctttagtctttgaattcccgttaaagtttccatgtcttaagtggcgtggcaggatagaaacatctcacccatcttagtaagttctttgctgtatgtagcactctggttttaacgttctgagccttcaggactgcccttgatgtgtgcatttattttgttgatatgcatgatgtgtgggtggctctgcggcagtaaaacagttcacattcaaattacactcggtttctaatttctgttctcagagtttcctctgtaatggaaatctcttacattcttatcattgccttcagttattgaatgtgttaggtggccaggattgctgtctgtgtgaaatgggaatgtatatatacaacgtaaacatgttctgattgacacgtgaagataaagggcttaacatgaattgtgtcggtttacacttacacagaaaattctactgtaataaactgaagtgtcagtagtgtttgttatcataacattgtctttttccctcttttctgatctctgatttttcaattaggaatgaggcctaaagaaacccatgctctctcttctctgagcgcaaggagggtgtgctgagaccttgaagggcacagcatgggaggatcatatactagggagagtctgtctccaccccatttttcttctgctttgctttgtttcgtagtttcttcgggcttcttgggggttttctgagagagagaatgtcaatttgagaagtaacaggtgcacaggctttacctgcaccacactgcagataaggtgggtagggagggtagtgacaggtggtgtggtgggttattcagttctttcctagggcagtgggtctcacagggtggtgcttaggccagcagcatcagcatcacctgggtgcatattagaaacaaattttggggcctcacctcttgcgttttaacagttccttcaagtggtcctgatgcatgttgaggactttgaacactcctcctacaagcaaagtgaagttgacctcccacacacttgtctcagtctgctttctagcatctgtcccattgcctttgttgttctccccgccacacgggctgcacccctgggattcccccagctgccaccaggcatcagctccagctgcctcccagggtgtgctcctgcctctgcttggagtaccctgcctcccactcttcctggcaagaccctgctcatctttcagggtcgtctctgctgagaagtcttcctgacctcctcggagatagggagttgtggggccttgtctttatgttcccagggttctgtctattgcgctattaaaactttttttttcatttaatttgccacttgctagagagatggttgttctgccttcgttgtgcaaaattcagtgatacactaatcctctcctaacctcttaaatcattttgactttcacagagtgatagtgtctagagagggtttttgttgtactaagttattggttccaaagaattcattttaagaggagtaaagaactaytatagtatgccgcttactgagacaaaaccgacttctcacataagcccaaaggttttgttatgttggattttaccattagagttaaagatgatgattggttcactaatgtgctttaccttcacagtgtgcctgtagacctgtagtaaaagaaggctaattatgtttcctgatgtcttttatttccaactataagctaagcctatctcattttttttttttttttttttttttttttgagatggagtctcgttctgtcacccaggctggagtgcagtggcgtgatctcagctcactgcaagctccgcctcccgggttcatgccattctcctgcctcagcctcccaagtagctgggactacaggtgcccgccaccacacccggctaattttgtttttgtatttttagtagagatggggtttcaccgtgttagccaggatggtcttgatcttctgacccgtgatcctaccgcctcggcctcccacagtgctggtattacaggcatgagccgccgcacccggccaacctatcccatatttttaaagaagagttgatcaagtagttacccattttaactaaatggataactataacattctttaatggaattgttgacagagggataatcagtgtttttgctaattcatgccaccctcctttgttgtatgttagtaatatttacattggggcaacaaaatagatcagtatttccattaatgtttacttaataacagctgctaaaaggtattactgtttgcagtaacacaaaagcacttacctgattcttatgccagcttctatagggtaggtagtgacagcccattttgcaggtgaggaagatggggtttagaggtgaggtgtgtctgcctgagagcaggagctggtaaatggcactctgggctcatgggagtcacgctgtttttttttttttttttttttcctaggacctcaaggttgtgtctaagacataatttacagttctcgtgtaggtcttccaaatacttagctacacagctttggggcgttttctcagccaaatacttttctttagcccttctcatattaacatttagttcttagggatttattttcaaaatatatatagcttgtatatgccattcacctaagttgttagagcagacattctgcctcttgatctttagaaaatacctaagagtattttgttaacagtactcatttcagctgaaagactttattttaaaatttaatttaattttattattgttttttgagacagaatcttgctctgtgtctcccaggctggagtgcagtggtgtgatcttgacttgttgcaacgtctgccttgtgggttcaagtgattcttgggcctcagccacccaagtagctgggattacaggcgtgcaccaccacgcctggctaatttttgtatttttagtagagatggggtttcaaactcttggcctcaagcgatctacctgccttgggctaccagagtgctgggactgcaggcatgaaccactgtgcctgacttttaaggctttctttaaaatggcatcttttggccaggtgtggtggtaatcccagcacttctggaggctgaggctggaggattgcttgagcccaggaattggagaccaacctgggcaacatagggaaaccctctctctgccaaaaaattaaaaaacaaaacaaaacctaggtgttatggtgtacccctgtggtcccagctgcttgggagctgaggtggaaggattgcttgagcccaggaggtcgaggctgcattgagccacgattgtgctgcagcactctagcctgggtgacagagtgagaccacgtctcaaaaaacaataaaaaataaataaaatgacatctttggagaagtgaattctacccaggtaccaagcccctgcctgcccctcccaactcccttccctgactcccagcacccccatctgttttggttctgctgttgccattctctggctttggggactttgctgaggccccactgtccccatcttccagctgtaccctttctctctgcttccctgcttgtcttattctttacagggctgcctgggatctcacattccaaaagtttttgggtttgtttttggatcatgccaatatcggttgctttgagaagggagaaagggtattttgcattttccttttaatcatcggtgagtagccacaaagggtgtgtctctccctcttgtgctgtgtttactgtttactccctcggtgcatgaattatttcatggcaccagtggagcatattttcttctctttcctgtttgtggcttgcgcctcctgaacgctgctatcattcatggtccagcttggttttctttttcactgtttctatcacaaaacctcctgaagaccagtggtgtcagtcataggctccaaaacagctggttcctaggccctgcctcgtgctctgtggtttgggcttgtcttttcttccagagtaagtgggtagcttcttcctactttttttctcttttcttctataaatgggaggaaaagtgtgaagtatggagactgctctttcatttgaaggaaattcacagttccagctctgtagtgtggcctctgttaactagtggtcaacactgactgtggaaggggggccagatggcaaagtgaagcagattctttcctcctgtctgcattttgattgcagtatgaagttcaacttgcttcagtctttgtcttcatgttgtttcactaggtactgaattttgtgatctgttggaaataacaagtaaatagatgcctaacgctttatacaggttgagcctgtctaatccaaaaatccaaaatccagaatgcttcaaaagtttcagcttttggagcactgacatgacaccacaagtggaaaattccacacctgacctcatgtgacgggtcacttttcgaaactcaggcacacgacacacagttaatttagtgtccccaagggaaaaaaagaccctcccggcccccttcagctgtgatgtgtcttttccacacatgcccagattccctcagacacctccacaaagggtaataaaatggttcgttgtatacaaactttgtttcatgcacaagattattaaaaatatataaaatgactttttagagaagcgagaagagaaatgagaggtaggggagggagggaggagttgggggacagttgggggaatagttgaagctaaggtgtttaggcagagctctgaggaggtgacgtttgagtggagacccagatggctagagaatggggcagcctcctgaaggagcagaagcactgtgggcggcagggtatcacagaggaggagctcggtgtgttggaggttggtgagtcccgtggagtcttgtcagatggtgttgggacagggacggaccgtgaggaggctggatcatggggaatgtgttgctttaggccaagctggagttgatagtggctcagatcagagctaaagtartggagacacacagacattgaaagaatgatgaaattcactcattctgcgtgtgtcccatgtcatgtgtccgctgcacaccaagtactgttttaggcactggtgatataattgtgaaccaactggagctgcggtgagagagaccatgaaaagaagggccagagcggtgtcctgcagagggtggtgtaccttgggagggaagtgtgtagggttgttgaggaacagygtgctgcacagggaggaaagacrtggggcagcattgtgggaagagcaaccaagattctcataggcttgggagcggaagccctgaggtctgttgctggactagatatgtgaggtktgagaggagagaagaatcaggaatgactctttgattcttaacgtgagcaactcagagaatgagagtgctgcagtttacaagcttggaaggtggattatgtggggggatgagtgagttgtttgacacctcaatggatatactcagatggatgtatacgttagagctcaaaagagtctgggccagtgacatgaatttgatcatatctagagtatgagtggcacaggaagccacttgtctggatgaggtgacagaggaaaaggttgaggatagcaaccaacatttagaggtaaggtagaaggcagagcagtgtggaatcagggaagccgagaggaggaggcaatgccaggtgactggaaggtcaagtgacacttcgacagtgtcactgagggctctgctaggagctattcggtgtcataatggggacagaagctcagtcggagtgggttaaaggtaaccaggaggtgagggtgctgagaggtgggactattgacaagccttgtgtcaagttttgctatgtaggggctgaaatctaatgtatgtgactgtgtataagtgacttgacttccccaaatctgtttcctcacctttaaaatgggtgtttgccaagtgctggtttctgctattcttttctctgtcttaggggtgtcattttctctttggtaaaacagaagaattagatgatatgaagtttcacattctaagttctcaagctttgcccactcctcagcccttgggtccctccacttcctcttctcttcgctatctctgctcagtttctgtctttgattgtaatgtaatgcccagtgggacttttcttctctccctcgtctgttcacttattccgtcctgcactgggccaccagattaatcctgcaaaaggcctcacatgggcttctctccygctcaggagccttgtgggggctttattcctctgagatgaaagttcttatccccacatgtgatcctttatgacttgggtgctatcaaattcatttcctcaactgctcccctcttcaccctgaccatcagatctgctggcacatgggcataccttgttctgcattgtctctggcctgtgggatatttaccgagctttaaatcctaggcaccctttgggagccggcctgtgtgcagagctccccttagcacggtggcacaaagcttggacaccacctcttgtctgtcctgcttaattccattcacatctagagtggactcgctgtgtgcacaccactgaccacctgcctcatgtgacagttgttcctcatgggtcttagctctttgccttcaccatgagcctcctcagagggcagggcactgcctgttggcatttctcgtggtatcatacatgttgggtgcttcccaaattaattacatcagtcagaaaacttcactctatctgagaagctttaatagtgtacttgggattattaaatcctaaaaaaggttatcacaaagagttttcttggtgtgtgtctgtgcttagaatttagaaaataagtcatccagtattgaggccattttatgaaaagcctttaaaatctgcaaatgcgttggcccagcacttccacttctagggatttatcctaagaaaatagtcttgggtatctgccaataatgttcactggagtgttgtttataatgtgcaaaacaggagctaacctaaatgtccaacaataagggattggttaaaaaaaaaaaacaaccctcatggtgtgtattaatactctggaactactgtccccttaaaatggtgatgtagaaggacatgtattgacctagtaaaatattaagtgaaggaagtgtgtttacaaatgtcatttttgtctgatttcacttaccttcatttatagagagtggataattggcatagatagtgttaacattgtttatcgtggaatgttgagatcgttgatgatttttactggtttttttttttttggttattacctctaaactctgtaggaagcatgctttcttgatcaataaaacttaaagttggagtttatgctgcttttattcataaaaaaatcacgtttttaatcttctgttaggttatcctttatgtctacattaatgcacgtgtggagagaacacagtctactcggcttatgtcaaatggtagtgggaagcatggaagcatgcgttttttagtccccactttacaagtcacagtgacggttctccagtgtagagtagattgattgccctgtgtccttcaggcagggtgcagtagtaagttattgatacttggctgctgagctgtcgttcaggccttggcaactgacgctctgcagaacggaccaggagtgtgcggtggtggagtccggctggcctgggttgcagatttaactttcgcctctgcctctgtgtgcctctgggctgtaagctttagtttgcacggttaacggggatggcctctcccatggtcggttggagtgtgttgcacagcgtctggtccagtgttggcactgtataaatgccagctaactggttagccacctaaactgtcagtctgcaacccacagctctgcagtgaacaattgaacctcatttctttaataataatacaggattcctgaaaaccaactgtattattgtttggaaaatagtttaaaaattatttcyttctaactgagacgtttaccctcttgtctcccttcagtctgcgggccaggcatcgacatccgcaacgactatcagcagctgaagcgcctggagaactgcacggtgatcgagggctacctccacatcctgctcatctccaaggccgaggactaccgcagctaccgcttccccaagctcackgtcattaccgagtacttgctgctgttccgagtggctggcctcgagagcctcggagacctcttccccaacctcacggtcatccgcggctggaaactcttctacaactacgccctggtcatcttcgagatgaccaatctcaaggatattgggctttacaacctgagraacattactcggggggccatcaggattgagaaaaatgctgacctctgttacctctccactgtggactggtccctgatcctggatgcggtgtccaataactacattgtggggaataagcccccaaaggaatgtggggacctgtgtccagggaccatggaggagaagccgatgtgtgagaagaccaccatcaacaatgagtacaactaccgctgctggaccacaaaccgctgccagaaaagtaagaatgatgctgactgytgctttctctctgcctctctctctcctctcctcctccttgacctcccttctcttctgagtgcacgagttccgctgggcagggtgcagtcgtgttgcatttaggacgtggcatgcctgctgtgcggaagtggttcccagtgggggtcttggttggctttcctttgcatctgggactcttggattgcgggactgtggcgtggctggaggccatcatggctgctgtcaagactgttcaaatcacatgttagaaataatccagcacactcctgggctagacacttgctgaccttcagctttgaattcctgatgagaaaggtgacctggtgtgcttggaagtccctgagccttggcagctgggggctgcttatgtgtcagctctttcatcctttgtgcgaagtgatattttttgttctgcaggacttccttagtttgaatggacttggaatatggttaaataaagggaaggtaaagcactaactcatatcctgtgaaagtggtccttaggtcctagtgatgatgttatgatactcaggtgtcctggttatgacagagcacctggcccaggtgggagacctctggacccatttctgcaagtcccaggttcaggctgtacttgcaggtagctgtgtagcagggtgcatttttaaacctctgggattctgttttcgttcttttatacctgtttactgaacagttgtgaaaatcttaagatttcacgagtgaaggaactttggaaagtatttactgttctgggggtcagatggtggtattttgaagcttcttgtatatttatctgcaatatgcttattttcccttgagaataactgagctcttgccttcatgtgatcagttccttaagaaccaggctgtttggtattaaaatgtgactctgagccttcaccttattgcattcagcaatagttatgtatattggctaggaagcttttcctcactggtttgaagtcagtgtgttagctataaatagctattatttaagtgttggcccagttaaagatgtaaggaacccatgttctctagttatgaagaaccaagaaaccccaaattgttagacttgcctaaaataaataaaaggcgagaccccacaggggtgaagtgtgtaaagtaaataaaggacagacctcccaggtagcccttcagttcccgttcaaccagtcctgaggcaggaaaaggatctgtgtaccctgatctgccacgcacttttctattctgcagaattggatcagtgcgtatgtgaacattgattagtgagggcaggggtcccactggctgcagccagtaccttgtagagctctgagaatgcagtcaggccactttaaggttggctggagttggagggagatcttatgctaaagtcacttgtgtggttgattaaaactgccctatcattaagttacccactggtttgagaaaacaacaaaatatattttttaaataaccttgacatttaaaaattttatctgaaaagtaaaaggtgttatcaagggaggcagcatggagtagaaaagagatgttgaatgtggtgatgagggccaggaatgaccttggatgggccagcccttctgggctgtagttgggcttttttaggatatttctagggcagtccagtacatcccttagtggtgatcatatatgggcatgaggatgttttgaaaactcataagctctttagagaagggaggtgccatatgaaacgtcattaagtggagagttgttcacgaactaggtaggtagttactttggtcttgccataggtttttggctgtttctgatgagctactgwttgaagacccctggggtaggggtgaggcctgcattctgggtccaagtctaagagtggcgactagaaatgagcaagttatttaaattgcctgggccttggtttcttcatatgtggaatggggtaaagcctgccttcctcatagggctgttggaagatgaaaaggaggaaggaaaagcaccgtgaaaatgttaacgatggttagaaggtgggctctgctggtgacagacagagccttgatatcacctgttggttggtcacctgcttccccaaggccacgccctgcagccttctccttgaccatcccagccctgctgatgttccttgtgatttcacaatggagtacttatataaaattggtaactgctttccgggaaattgacttcccttccccttgtcctgaaaactcaggcatgggcatatttcttggagattttctagttgaatcagaacttcctcttggtttgygtagattccatttagacctgcattgtccagtgtggtagccgcttattgagtaagccacgtggcttattgagtacttgaactgtggcttgtccgaattgggactgctttaggtgtaaaatatacactagatttccaagacatagtatagcaaaaactctgtacaccatttcattaataattactatgttgataacatgttgaaatataacattttggatatattagattaagtaaaatgtgttcttaaatttcacctgcctgtttcctttttattcttttttttttttttttgaggcggagtttcgctctcatcacccaggctggagtgcagcggcgcgatctcrgctcactgcaacctccgtctcctgggttcaagcgattctcttgcctcagcctcccaagtagctggaattacaagcatgtgccaccatgcccgtctaatttttgtattttaactggagacggggtttcaccaccatgttggccaggctggtctcaaactcctgacctcagatgatccgcccgcctcagcctcccaaagtgttaggattacaggtgtgagccaccatgccygactctttttaattcttaatgtggctacttgaaaatttaaaattacagatgtggcttgcattctgtgttggtaagctgctttagagcatttcttttaacaccaggagttcttcccctcatcatctttttggctgagtcgtcactgcagcgctcatagccccgcatgtacctctccagccagaacccttaggaatcatttggggagctccatgaagggcattgagtccaggcagaatggctaccttgagttcaacataagcattaagatggccattcgaaaacattaagcacagaagaatcccattcaggtaatcttctgttggctggctgtagaactacggagaacatctggagaaacacgtcaagggtgtgtgtgaaatcgttgagcctactcgattttgtcgtgctgttgcgcggttttcacttggcactgtcctttaaactccttctgtgccgtgactctgcagtgtctggcagcgtagtagactctactccctctatggacgtgatccctctgtgggttctctgcacacttctgtatttctcggttctttttggatttaggagtggattttatacatttttgagtcattcctaaagagcgattgacccttaaagaactgtgtacagtggtttcctttcagtaagaacatagttgtgtggcaccccctgacatgtggtgtggttgattcttcttccttgtcttccaacgccaccctcttatgagtctcttcctacccccacaggtgccgcttctctgtctcccttccctcagtctggcttttaacggtggtctcctgacatagtccattcaggctgctgtaacaaaatcccataccctgagtggcttacacacaacagaaatactgctcacagttctggaggctggaagtccaagttcaaggtgcttaccagattaactgtctggggagggcccacactctggttcacagaagcaccttttcactgtcttcacatgttggaaggggcgagggattttttttctggcgtcttttttataagggcactaatcccatttgtgagggctccaccctcatggcctaatcacctcccagagccatcatactggggattaggtttcaacataagaattttgaggggacataaacattcagatcatagcatggctggagttctgtcctgggctctcttttcactttccttgttctcatctcatccactggtaactgcattgcctcctgtctccacctaaacttccaagtatctccagcccagaacccttttgagtccaggacctgtcattcatatccatcccagaacccttttgaacccaggacttgtcattcatatcagaccaccacgagcatttcactacagcctctgatggtcttccctgtttcctcacttttgcctattttttttcttttctattccctcttaagtgggccacacttttgttcccctggttcttatgtcaggaatgtgggtgtcctttggacacttccttctccagttggataccaggccctttccctcccgaatggaatggaaatgctgcttcagctgtgttcctctgctcctcccccttacagcagtgacatagcctctctcctgctattgtgtcctgtggctccaccgagcactggggagcttttcagtatgcacttttttttttttggagaaagagtcttactctgtcacccaggctggagtgcagtggtgcgatcttggctcattgcaacctccgggctcccaggttcaagtgattctactgcctcagccgcctgagtagctgggattacaggcccgcaccaccacacccagctaatttttgtatttttagtagagacggggtttcaccatgttaaccaggctggtctcgaactcccgacctcaggcgatccaccggtcttggcctcccaatgtgctgggattacaggcatgagccactgcgcccggccatctagtgtgcactttggactgatgagctcccctacctgaaatcctgtagcaagtccctataggataggcatgtggtacagtgtgaagctcctgagtggtcaacagctaccccgtgacaacatgccacactccatgtgccactccctccygcctgcctgctgtgtccttggccccagtggtgctctcccgtgctgaccagccggcacggctcacctggccgaactctagccttgccttttcctctcaaggatgtaaaggctctgcagatttcgggaggcctgtctcccagcacctgatgggacactttttgccccactgtaaattctgggtgtatcctccactgtatgctgtcaccccaagggcaagcactgcatctgcttagtgaaggatttattgttcggaagatacattttccccttgagcagagagtrgcgtatcctggcagtcttcggtgagccagttgtaccaggattatgaaatgcagatgtttactgtgtcattgttgctgtcattgctactgaggagtactgaccagaatcatctgcaactcttagttggcagagaggaccactatggcgggtagctcttttctttcctgccattgtggggatgattccaggccaaagatgatggagaagtatggaaatcatctgaaaggttgaagcttggcacgtgaagccattcatgactttgtaaggcagttttgctgaaggccagttctgccctgggagggacggaggtgaatcctcctgagtacctgtggttttcttacttcctgctgaatttacctaagtgcctgttgtttgcttgctgtggaggctttctggtatttcatttcaggtgcagatgccttcactttcccacaaaaaaaaccccaacaaaacctaagaccttactgcaactaagtytccaagtactttttaacccawtgggatgaacagcctgtggtctgctcagatcaccctgagtgcgtgtgagaaggcctgggctttgccaggaaatccaggaaggcagggccgggctgtgttggaagctggcttagctggtggggcagccttatttcaattaaaagggcattgactgggagcagcagtcctggagtttgttgcatttcctattgccctcaaaatgagaaaccaggaaaatagcagattggagccttcgagaaggcagtaaatggctgtttttattgacaaaaggaaaacattttactgccatctcactgatggcatctcactgacttaaaatgaaggcaggttgtagtaaaaaaaaaaaagtctacatttttccaccgccacgttcttatatccttgtttgtcagccactgctcacaagggcagtgttgtcttgcggagtagaggcgctctccttccctcgttttcctctataggttggtgtggctgacctgctagatcaaagtggaggacctgtttaagaatgtgtaaattgaaggctgggcgcagtggctaacacctgtaatcctagcatttggggaggctgaggcaggaggatcgcttgagtccaggagctcaagactggcctgggcaacatggtgagaccttgttcatataaaaaaatttaaataattagctggttgtggaggcacgtgcctatagtcccagcactttgggaggctgagatgggaggatccgcctgagcctggggagatggaggttacagtgagccgtggttgtgccactgcacttcagcctgggcgacataatgaaatcctgtctgagaaaaaaaaaaaaagattttgtaactaagttttatggctagctttgagaaaggaaaataataataaaaaaagaatgtgtaaatcacctgctggatggggggaagaggggcacattgtctttgtagtgagacttcactcatgtgatgtgcagtatttcatcttaacattttttttttaaacttaagctacttgtgaagagctgagatgtttctgttaagcactgtgtggtctgctgctggtcttctgcaggccactgttccccagactgctaagacgatcatgacacaggcttgcattttcaggtggactcttgggaggggcttgtggaccctggaggagaaggcagccaggagaggggcatctggctttgtgttgttggtaggaacttgtctcggttgccctggaaggcctctgctctggtcagctgctcccagtgtgggggtgatctttatttagaagggggtcacatgcccccaggcctcattgctatgccttttatagtcaggcgtggagctcacattctcttctgcctgattgccgacgcttgttgccgagatggtgaagcagtttgtgtgcaggttccctgggacctggcttagcccacctcatttcttggggcgtgtgccttgtgcctcaaagactttgcttttggctaattgtcattagtgatggtgtcaccatcctgggcctccttcagaagtttttaatagggatctcgtctaagagaccaaaaagctttcagaaccactgacttgtggtgatttttgcatgccaagtatttggaaaatatctggagccccttcagctctcaccagttaaacctatttgtacawttgttctggtttcttcctgtgcttgaaaagcctctttctttgttgcgttaatacctctgtcttgctttcctcatgtgtatgccagtgtgacattctcggcagagtggggatgacgtggagcgtgtgggcccgtggttaatcttgtcctgaattgccttgctcaacttgcgtgtatagggtggttcaaaagttaagtttggctggtggtgaagttggaagcatcacttagaaacacgcctcctttgggcatatggtgtgaatcagggactctggctataaaaggtggggtctctgagcaccatcctrgttggaatgttcccctgactyggaggtagcgagagacagccaaggtgtttgttccagggaggctggtgggtgggagatgggatttttctgtctgtggcacaggcagtattaagtagagcaggctgtttaaatcacattttaagtaaaaaccaaagtgcacagatgatctgcagaacttctgggggataagaagctgctttcctcgaagaagttcayctccaaaccagcgcccatggctcagcagccagcatggcagccccaggggtacatgggacttsggcatgtgaggctggtgagggacagggacagctgggtccagcagtgcctttcctagggacggttgccacgtcacctgtctgccctgtacttccatttcctttctttgaactcggggggcttgcatcggactacctgtgccgtttcctcaaactctaaaattgagtaagttactgagggtttccgtggtctgctctgagaagatttcttgcttcctgatctgcctgtgtgttcgtgttgcttggtctctctctctgtctctctctctctcctctttgatcctagtacatacaggcaaggtatgcagcatttaaaatgttcataactcatcaaatggcacactgatcatcatgtataatttgggaatcagggtttaagaaatttagagatcatttatatggaagaaggaaccccaagtagaaacccaaaatctagaccattctgggttctaatctgtacctgccactggctaacatatggctttaagctggatgttacaatgagagctggagtttcgtctgattgcacatagccttgcttttctgtctttggaaaagtagctcactgyagagccctggtaaacgtttgaactgcattgcgggagtaggcagaagaacagaacagtccttggagcttggtaggaggtgtgagggcttatgggggacagttgtcttttcaagtcaaggaggaataagggcttctggggcsggtggaaagggtgagtcttaggcagggaagggtgaccatccaggttagatcacttcttctgcggggtcagcttggccgctgttaggttttcaggatgtcatggggctggccaggcctcacccctgatatccctgagcatctgttccttacaatattgtggagtccgtgggggcagaagctaccatcctgtgcctgccctcactctcagtgtgactggtcttcaggatgtttaggtggctccacatgcggatgtacagctttcccctgcttgttttccccatggcatattaacagcgagatctgcaagaatacatcattttgtacagaacaggatgtatttcttttaaactacgttcctgtgtggacaagtggtatcatatgcaaaggtttaaggaccgttgatgccttgagatagtgccatctgtttgcctcaggtatgtggtgctaggacaaagctgccagacctcaccttccttcagtgagacaggaataggacagtatttgaaaagcatctaacatgtttccaagcacataggtttttggtaaatggtggcagctgctgctattttttttttaaattaaactatctaagagttgcattctragaccatctaaaattctgagtcttaagctgtgttgactatatatgttcactaccataactaaatggtccttctgtattgcttttctaaattgtagaatttcaattattgtaaatagcgggccatactgtaggtgtggttcttgctaatttgattcgtactgttcaaattcttgtgtctgtccagataaactgtatctttacagaacattcagcgaggtacatatgtctatatcggggtgccagtggagtcaccctagtcatatgtaaactctatttatttggttccgaaactgaatttattttgtttgcaagtttggtatttgggagcatttaagaaatatccatagattcttgtatgatactgacattaaatcattaaataccatattttttaaatgcctctgtctgtttgcatggataacattaaagtggttagagtgggcacagttattggtaaagattacaaagatgtgcatttttatgacaactttaggtctcacataggtagccaaccatctgctccaggatgaagcatgtgcctgtttatcctcttctttggtaacgctaggtatatgtgtgcacacgtgcacgtgtgcgtgtgtgtttgtgtatgtgcgtaccactttattctcccacccagcctcttctcctgttttgtttagtttcattttcctcctctcacccccattgcaggaaacaaacactggctctctgtcctcccttaggtcttccttccgttcaaggggatcaggtgggtgggaaaatgttgtgcaggaatgccaggcctctgcccgaagccgggcttctgtttcatctcattattgaacagaagtcgctttttgtttctttgccttggtcacaaacaagcgcccagtcctctcttctttcttcctgccatttttcccagaatccatgtgggatgggaacagaggcagcgtatttagggactgtcggttgcttgatacccatggccttgtttagagaagctgcacccactgccccaacgtgtagctgcatctgatttgtttttgcaagtcctaatgaagggacctggatgaagttagtgaggttgccgttcctggggttaatgcagagtggcccatggagcttagccacccttcatgcagaaggtggggctgagggcagccagtgtgactgaggctcgctggcccaccctgagctgcttgtgcccatggggcccctggggaggagggcccagctgcagtgcgsatacatctgcccttggcagcagatctgtgaacccaggctgccattctggatttccggatagatgcaaagtgcttggacgtgttttagcagctgctgagaccaggagttgggcttagtagtaaaaagggggaacaaaataaaagaagatcaggagacaaagagcctacagtacaaaaaaggaaagacgaaggttgatattattagaartacttcctgggcagccttactgtttgaattaggatcacccccacccccacctcccagaggtattagttgtaatgcagagacaaatggaaactagtcagatccttgggtcctagaaaagaccagctttgttcctggggtggtaacctagtacaacgtttccgttcctatttcttgacctctgaatggccccttctgctttgctaagtagatgatattattaggtgcttagactattcttcagataggatgtaaggatatatttttgttctcttcctcagtgaacttgaaatgattggattattttgtaatacgtcgatactacttttagaagcttttgaataactgtgtcaaagaagctttagaagaggttttaagcaggattgcagagaatgtactgagtgtgtttttccactcacaaggaaagacagcagctgaatgcagaagtgtgtgtctggttctaactctttatcacttcagggactgtccaggcagcaccatccgttgggtctcctgcccttcctcctcccacccctgccttacccctggccattcttttgtgaccagtagtcctttatgaatggaattctgagaatgtataattttctcagaagaatgcttctttagctcaccaaatatttcttgtttgctgaggggggaaaaagatcctccttggaaaagtcactgggtgccaaaggtgggtgatgaggagagatgaacttctgggtgtgcctagcaaagctgtttctgttgataggcgattaacaaaacagccaaacttgacctaacagactgccattttgagaggaatttgttttgcaggattaattggcttcgaggtgtactggtggctgtgcagtgatgacggctgtcgtgcctcctgtgtcttctgctcattgtgatgcagggcaagtgcttaggcctcagacacaggctccctgaacttcgtgttcagtgctttagggtggggggacttgagacccttgacttgactcggtcccactggaaagcttctgttgcttatttgggtaaccccaactctatcttattgggcrgtagtgttatcctaattcttggaaatactcagtgtagaataaagagctgatgaaaatgtgtaagaagggagtaagtggtcattagagagaaatggtaattgggatgatgctctgaccccttcagcaaaaaataaaaggtgaatggtttattatgagctagttcagattctgtttttggaaatgagcttggttatacatagtgcatttgaaaagcgtgaagcatggactttcagatgccagctcctcagcctcctgtaactccagtcgcaaaatccctccagtgtatctaaataaatgcaaactcatcagtgccttaccattataaagctgggctggagaggcaggtggcctggagaatcaaatgacaagaagtatagggagcagcccagcttcatgatcgggggaatttgcatgaaaattgtgtacacttaagcaccattgtctattgcagaaagcacgatctggcctcttctactgactttccttccagctctgagattcagttttgaagacaaggttgttggggacctcggatagatctgttggccgtggctttcagtaaacactactagagactgaggacatgttctagacttggaatggtatgaagcagtcgaactttttaggatgggccctacccttagggactgcctacgaaactagatctagaagaggaggctgtggacattaggaggtggctgcaattgggaagttccagagagcttactgagggataacggatgtaggacaggaggctggcaaagcacctcagtgatagggcagaaggaaataaagtggttagggaaggagttgagagcaggaaattcaggtaggattgatgttaagtcttagatctttgaagtgactttctctggtctggcttttgctgttaccaaagtgaattattcataagtgcatatgagaaatgctgatgtaactcgattatgtggaatgaatttaaattcatttaagtcattcttttccactaaagtaagctttccctcatccagaatctgagcagcccgatagccaagcaggagtttccttgtgccatggccagtgattgatgtcttcttctatgatgctgctgaaatgctggggactctgaagcgcagctggagtgatcaaagcaaaattaaaatactttctcagtggtttgggagttgggtgcgttctgctgtattttttggttttcggcatctgggtttggtgtgcatgcatggtgagctctagctggagcagacgttacctactgaggctacgctcttcgtggtttctccttaaccatcacccacttgatcttccatgaagccccccaaatcttccttactgaggactcttgcttccaggttgcttttgtgctcatccattgctgggttatttggtcagtgatgatggtttctctgtactttttatcagtaggttcagaggaccttgtttactcctcattcatctctctccccaaacagttgagaaaccacttgtgggttaggactcatgctttgtttataatgtttgattctccaacctcacagctaatgggaagcccgtggaggagatactctgtaaaaatccatctcccatgtgggcttgaccccacttagtgtctgagtggtttggtcctcatagttctcttgggggaggaggaagggaaggaggaggaggtggcgatggcagtggcagcagtggtggcatcttggaccagagtgagaaatcttggaccagagacaaaagaggtcttctctcagggtagtgcaccatgagagggagcacctgtttacattttgtatcctggacaccaatcttgccttgctctggtgctggccctgagaggtgcaggaattttataaagagatttacaaaacatttttggatgaccaaattggtccctggttctagctggaatgaataaacaaactaaataacagtagagtgtgagagtaagtgtgtgtgctagagaatgtgtgcacatgtatggcctaggtgagttcttcactttgctgacttgtgaattatttggggtcctatggtcctccccatcattcttattcatgtcagtccaccatcattaaggaagtggaagcgaacacattgtgtacatatcactcccatagagagggagactggggaagaggtttgagttataagtcgcacctaggttaggtctggatgtgtctttgcaggtttccttgctagttccttggccagagtttccatcgtgtccctcagctgcacaattaaggtgcccccgttttgtgcaagtctcatgctaggcagtatgagatgacacaaactaggattctgttgtgagataagataaaaacacttgacatttaaaagagagagacaacttatgcggtgtgacgagacactctacgacttttgccagaagagaaatagaggcaacaagtgctaggagctcagaggagggtaagttccacatttggaactttggattaaaagaatatttgggtctggttgaaatcgaggcctttcatgagaaatgtccacacttgctcagtactgtttgccgaacactgtatacaaggccctcgactcgtgaatgagttgtaatgcaaaactttgccaggcatttggaatgtggagtatactattttgtaaagatgaggtctgaatggtggtttaggtcccaggccagtgtccctctgccccccacctccatatgtgccctcaagccggtttggcttagacattatttatctctgactactgtgtacagcttagttccatggggaggaaaaggcttgatgaaccctaccctggaaggctggtggctctgttttctgatggatgaggtaggagtggtggaaagctggtagtttctactttgtgcctgtttaaaaagccccctctgaggccttagcacttaacagatgttcaggattgggggaataaaggagctgcctttgcagaggtctgtgggcatgcagtgggtgagagagcaggcactgagtgccccgagtttcctgcctgtgtgggcaggaggattctcagtggaatcaggagcatctccgcctggtgctggaggaggtgtggagttgaaggtgggattcttcctcttgaaggacttgaatgagtttctgtgtggctgaacagaaactggttcaacacccatgtcatgatttttgtgaagcgaggacttggggtcccaagtctaggttttaggttccctgctgtaacccgtggccaccgagagagagttttatgataaaatgtcagcaaagtacctgacaacgtctcacgctagaatgagtttcgtacatgtttagttccctctctttttattccacgctcccccaccccaactttaaatcagaaacgtgagggtgctgattgaagctttttataacttttcttattgagaattgttctctggagttgtctccaagaacaaaggaattccagacgttctycttctctccttgtctcttctgtcctccagtcaaagaaaaactctgcatatgatctttggcctggagaaatattaaatctatgttaagtatgcagacatgaatgggcaaatgaaggatttgtggcaaagaagatctgccgaaacaaataagtcatgtaaatgggcagagggaaatattaaattgattgcatctttcagctcctggtacttaatgcaaagataaagtagtgggaaaaggttgtcatttgaaataatggaaagatgagggagttttgaagctagctgggatttttctgcctgttaatagagtgacttggattacagactataaagataaagagtagggccgttgcatttagtatggatcatgatgctgattgctgtctgagcaacctctgtactaagggaggagaagctaacatccccgggcctggaagatactggatactagctcattaaactcttgtgagaagccttcattagcattatgggaagacttgctgtatctatattatgaaggcatttagattttttttaaaatgcatgttcttaacattttttgtttattaagtggggcagtagattaggactgaatggatttgattctctcatcctacatagtgtgcccagaagccagaaggtttcccagaatttgtattatggcagcgagggcaaatttaattagcagataggaaaagctttggagcagtttaggccaatccatttaattgtatcagcaattaatattttgagaaaatggaaataattaaatttacatttcttctaggactttattttgttatcctttaaggttattgtaaatgaggagacttttgaactcacagactaaagcaaactacaccagataatcattaactttttctattgtgtgccacccttcccaaccagattgttccatagtatcacttatgaaccaagaacctgtgagcttgcaaaacgcatttttaaggagtctcaacttttctgatttgtgttaaagtttaggtgtgggtcccagaaatgagtttcatggaggggagagsttgtctctctgggtgggtaatacaggggccactgggggctcactgtggctttctggcacagacakttatgaagcaggggtkactaaagtgggagagagcagccagttctccagcagccccagtgagagctctcatggatctgcctattgcactggggtaggagccatcaccgtcagcttttctctggcccacagtgccattttctgattaagctgagacctctgtaatagacacgttgtcattttttcttgtgtctaaaagtttgcttgactgcagtgggtctccagctcagagcaggtctggctagagaaaacaggaggtgatgactggagcactttgcccttatggaacgtgctctgatgtagaaagcaagaggattttccttgcagtcactgaaggtaccttgtgtacacagaaagaagacagagggagccccggatgcctcggtatccctcagagccrgatccttcagacctgtgcagtacctgtggatttggttagtcgatgatgcgctgccattaaaacaaaggcatcggccctggaatagagaagttcagtgagaacctctgtactccatgggcattttctaggaaataatttcacctgccctgtgtaattctctggaagaatcacagtgagttggaaggaaacttaagacttggaaaaggattgagaggttagcccagaccayaccagggctctgaaggcccagctggggttagaacctgggacaccctccagcccactgtctcctgttccctggccatttactgccccactcccctttctactctcaggggccctggatctaatgaggggattcgtgcagtttgctgcactaatacattgcaagtggtgccaacctaaaggtattctgatggtggaatcagagcagtagcatcttattaggtcagaatctgtatctcctcttccaagatttttacatgatttagtgttttctgaattggaaaaaaacaaaaacaaaaacacacaaaaaaaccatgtctaaatcctagcatttcatcccatgttgatgaaagggcatcttttttttcccctaatctgtggttagaactctcagaaacttttagaagatccctcctatgttttggaggtttgcagatttgaaccccagttcctcccacagtgcttctccaactcctggaatgaggtaaacctccaggcagcctgttgacccaacccatgcatgccggtctttgggactcctagatgtggaccctggagtgaatagggatcaggtgggaaatgagttcctttgatsaagatccttgtaccagtgaactgaccccactccccgtctggattcctgtggtgattaccctctgtattagtctgttttcatgctgctgataaagacgtacccaagactgtgaagaaaaagaggttttaattggacttacaattccacatggctggggaggcctcagaatcatggcaggaggcaaaaggtacttcttacatggtggcagcaagagaaaatgtggaagaagcaaaagtggaaaccctgataaacccatcagatctcgtcagacttattcactatcatgagaatagcacrggaaagaccagccctcatgattcaattacctcacctgggtcyttcccataacacatgaaaattctgggagacacaattcaagttgagatttgggcggggacacagccaaatcatatcaccctcttagcaaggactgtgttcgtgatcatgactggcattcactgaacaatgactaggtgccaggcacctcgccagtattctttaatctttgcacagtctgtagggtggatatggatattactgttccattttttgtggaagaggaaatggaggcaagagacctgattataacttgtgcaaggtgccatgcagctaagcagccagcccaaatccagacctgctttcctatgattttcctgcccattactctcccatcgtagctcacctaatacttcctagtgggctgctgctgaacacacacccagggatgacttagtggcttgtcttgctctgaagaaggctaggcaccatgttggatgagttcttgaagatgtcttgctctagtcaagaaacttttaaatctttggagtttttgtccacatctgcctagttcttagtaaacatgatgtgggttctattagcatggcgccctccctcccttcctaccacctttatatgagcggagaacatctatgactcttatgagaaaggaaagatgaaaatcagagtgacatagtatagttaaattgcagatgcttaattataaaacagcttgtttctgaattttaattccttgcttttctctgactttttaaattcccctccttaggcagaattcatttttacattgatgattttttttttttttttttttttttgagatagagtcttgctcttgtcaccccggctggagtgcaatggtgtgatcttggctcactgcaacttccgcctcccgggttcaggcaattctcctgcctcagcctcctgagtagctgggattacaggcatctgtcaccatgcccggctaattttttgtatttttagtagagatggggtttcaccatgttggccaggcaggtctcgaactcctgacctcaggtgatccacccaccttggcctcccaaagtgctgggattctaggtgtgagccgccacacctggcctgatgaattattttcatgtgtggaacaaaactttgatgctgatcagtgattaggtacctttgtttggttcatttttaactaaggagatttctttctttttaaaaccattctttaatcttgtaaaaatatcatttaatgggtggatgttttagctgtgatgaatgacaggttgtcgtaaaggaagaaaggtatgtggtttccagtaaacttttaattcttttgcaaaataaaaataacagtcgtacagagagtaaaatatatgaagagtcaggaagtgatttatcaaaatcagatcttggactgctggttttaccatgaattaggctcttggaaagtgattgggccagtgtaggtttacattttttttttcttgttttatttgtcaaagcaaacttgtggttgcctgcccgtagtttaattctgcctcctttgggcaaacaaccgacttttactgggagtctttctcagggagataaaggtgcaccctgaaactctgctctctgattcctcagcaaagtcagtcctgagtatggggcttgggtgtctctgcaaggccttgcaagtgagatgggctgtcacctgagctcaggtggggctgctcctgccttggacagcctccccagcttctcctgcattatacccaggggctggagggcagagagcaggtcttcttctgctggtcggggcagtcacaggctttcctctcggcctgcttgtcctccgggtgggtccagcacccgctgggattcctgtgggcttagtcactgtgtggcggcggcagaaggactggggaaaccgccggccggccctggtgcgctgtcaccccgaaggaatgcgggccaggccggggctgctgggcctggaaagttctccagtccctgttgcggatctggcctgccgactcaaagtaaatctctcttcccctttatttcccatcaaataaaaaaggaacacgaggtagccactgtactcactgaagatgcattgttttttttttttttttttttttaagcgagcagcagcaagatttattgtgaagagtgaaagaacaaagcttccacagcatggaaagggacccaagcgggttgccctgaagatgcattttttaacttgctttttaactaagtatttttgctctgagctttcctggatctgtaaacacacccccagctattcaagatgggcttcttggtgaaaagtgatgtgtcctaggagaaatcacgcctgttgttgccgctggccatcacagatcccggtgcctgtctgtgaaaggctggccgggctgggtggggatgagaatggtcgggttgtctagactcagcctggactgtctttgactggaggggcctgagctcctcctccactgctcaagaccccggttaaggggacagcagagcagggatgagaagtggccctcttcacatcacctcccagcaagagggcctgacttagtgctcccaccattgccagccccagtttcagggtcccactcagttgtatttgaataggtctcatgacatgtgctttgcttgaagagcggctattagcagcagacgttcaagaggctgagctcaagcaggtgagcatgttctgagccattgtgaacccagtgaggtgcctatgctgatgcccagggccgcctgggcggggtcaggcccccatcgcttcttcatcctagctctgggagtgcattctgcactctcccgaggccagctggtggcctttggtgatcaccctctctgtaagtttttaagtggcttcctttcctctggtggagaagccagcacctttatcctatgacaagaaagctctttgtagtaggtggtagtagaatcagacagatctggcttaaaatcttggctgtgctacctcttggctctgcacattggtgaagagaatttaccttcctaaggcctctcagctacacgactgtggacactcagcttccttctaaggtcgttgtgagaggtaaagaaaaggggttagtccagggccagacatggcacaatgcctcaatgaaatattagctgatactatcrtaatttttaaattcccataggactcactgttaaaggattacaaggctgacacaaaaaatactgcattttgaatttgtgtctgatttatacatttccaaagagtggaattctcactacaacagctgttctttgaaaggttagatctttgttctgagataaattaagtggaaaaaggtgtagagcattatatgtactctgattcttcagggcttaatttaaaaagagcatgtwtgctggtgaatgctggttcaatcattaagaagtttttgagaaggaatcccagaaagtaataagcacttatttttcatggaaaggaaccggaagtgcttggtgacctccacaggtaatcttgtattatttttgcactgtttggarttttttaaccatgtgcttttatttcttctattcttttcaaaggtcagtaggtgttatctggacaatagggttctggtctgttttctgttttcttcattgtactgtgcattaagaaaaaccctaatgtgcttttttttttttttaagtgaacctttccacatctcattgtccttcagtgagagcaggctgtgtgtgtggtcttggtgaactgtcccgttccctggagacagtatctgggggcctccctgcccttcccagtaagagctgggccttcacaggaatagaggcctaggattcgccttcatcctcttgaagagccctaacagtaggtcctggctggggtctggcatagaatgcccttggcacgaygtgtgtgagtgtgtctttccttagtaaatggccttgaaaatgycatgtgcttctggcaggcctggataaggtttgccctgcataacccttggaaagcacagttctcacttgtaacaccctgtctgcaggtccatgatattgtaattaaaaagttatgggatcacaagggcctatttaaagggcatctggtctaaaggcacagttaaaagcagaatttgtgtcagtggctcccttaatttctcaaatatggttctgtttctaaattcatcccactggatgtctgtgttgagttttctgttgatgaaagaatgtttaaaaatgaggcagatccaaattctaatgtctgagtgtaccactgcttaattactttgggcaggtcacctcacctctcttggaaagaaaggtgatatactacatctgtgattttcaatttttttttttttaactagacccacagtaaaacatagatatacaccatgatcccaggacagaataagtatataactaaaataagtgttttgaaatcacttcttgtctgacacagcactcacgctttctattcatgtagtaccacgatactttcttctattctaatgctggtaagagatgccttaaactgattttgagaactaccaatgggtagcagctagcggcttaaaaaggatgttattaaggtccttttcaccctgattttgactctgttggctctcagctgagtgccccatacttagtgcacatagagttggcctctgaggtcagcctcctgttttcctgtgaaaatgaggatggaagagagtcacttgtttccctccttcatggctaccccctgaggactgggaagaatttaagaatttgagtatatgttcccaatagcatgatgtgtttcattgttcatctgtaagcatttttaaatattcgagatctgtatcttgggtaatttttatcaactttttatttgtaaaataatttcaagtcagttattaaagtaacaaaaataatggcaaacttgataccttcccgtatttttttttcatatttttccttgaatgcttacaaaaatattaaagaatattatcacatcattgtagtcaccgatgaattattttctggtggcttatgattagaagagcttgactcggagtggaaacagataacatttgagtgctctttctgttaattcatccttgtcaataaccccattagctaacttccagcaaggctgtgttaggaatgtggaatcaattagatgaattttgaaaataacttggtctgttctaaaaggccctatgagatycaaactgttgtggcctggtgcctggtaactttgatggccattttgaaatgttaccgtagtgataattcttctggaatctcaagtcattaaaagtgatatggctaactctgggccctgtgctataaaaatagatgtcatgggatgtgtgaatcctttcttcagtgttatagttaatagcaactgaaggaacgttttggtcaaatcccgaatacttattaggggctcactgcttggctgcatttttctcctctgcgtaaatcatctatccatgtaattattaacccctaagaatgaatagcatttttaaaagggttccattttcccctcatatgactttggttcattctcctccttgtttctgtctctcagtgaactttccaaaagatgggttatgatgaaagrtgaatcgtcgttgataactgctcttacttatctgtgtatcgaaactgcaggtagtgctcttcagctctgtggctggatttagtgcctcttctagggaggggtgggtgttggcacaaagcgtatcccatttccctgaatgtcgtgtggacacgtgagaggacagtgcaccctttgggcttggtgctgcccccttcacgctactgaaccccagggtcataattaaaagctgtgttagctcttctctggttagaggcatacaggttggaggcttgtacatagccgtgagccggttggtctaggccaggaagcaaaccattggaaaatgtggttagcagtgacagttgacagcatgtttgcctgcagtagtggtggttggtgctgcgtgttgactggagttgcttgcattgggagagcctgacttggccaagtgtgtagcttgagaccagttggattcctctcacagagacagtcttcacccccaagctctgggtgttgggcgtgcagcattcgtattcagcaaacatttgctgatttccgcctctgcaactactgagctcagctttggggatctgaagatgaatagacacagccacacttctggggaaatctccctgtggggaggctgacatggaaaccaaccaaatgggagtgtggtgcatatcttattagagctttgtgcaaagtgccacaggaagcaggagaaggggtagattggtgtggagggggcaggggaagacttgcctaggagcagggcctcgcaggatgcagaggagtttgccaagtaccagagattgtggggtaggtgaataaaggctgagtataaggataagtcaattcaggcagatgtcctctaagaatgaaggtgagaatgctggcggaaaccagttgtggccctgtctgccttccctaggagactggacctgactttacaggcagtgacggtgaagcagggcagtgccacgagcagatctgtgtttcctgaagggtctctggcagctgtctggggaaggagggaagctggcagagccgtgggtggaggcagatgccattgctatggagtgagcatggggaagggggtcggaggccttttggagatagatacagcaagacttggtgaaggatgaagttggggcaggtagaggaaaagcaatgagcttacggatgactggagactgactggagaagatgaccacccttgccattaactaggataggaaacaacaaagggtaggagtttgacaggggagaatgtttgtgctgttgagttgttgagtttaggtgcttgtggcacgagcaaggggagtgagctggtctaggaggtttttggaaacactgacctggctgcagagagggagatcctgggacacctgttttgggagttatcccagtggggaaggatcactgggaagggggccacccctttgggaggggtcagtgggacgactcccaagggaagaggttggttatagggagttaaaagaaaggagcacccctcacgcgagcccatttttcaaggatacatgtttgtcttttagattctataaggagtagctgctacacagaaagatgtctacgtgtgggtgaacacctggcgtatcccatgcagggaggcttcagcagaccttggtggcgatggaaccaccacagtgatccgaggattgggtctgaaggctcctccgagtctccaataaaaggggttgttttgaagggctcaggttcttcctgggcttttttgggacagtcttgctctgttgcccaggctggagtgcagtagaggcaatcatggcttattgcagcctcagcctcctgcctctgggctcaagtgatccttctgcctcagcctcctgcgtggttgggactataggtgcatacccccatgcctggctaatttttaatagagatggggtcttgggctcaagttatcctcccacctcagtctcccaaagcgctaggattacagacatgagccactgtacctggctgagaaggtttttttttttttcccccttccaaacccccatgtggtccagacgaggccagaggatctcaggggaattccctctccgaggagcctccactgctattgcatggcccccagcatagtcatttgagtgaagagccctccaaaatcattaagctgatttgtagaatcagtttgctgtctgactacctgatgaagatgagaagtggtagacctccccccactgtaaggtcttaacaagatctaggtggaacatgggactgtttgcaagctacttctgtttctgaaatcacatgcttgggatcccaaataatctactgaaagctgtcttcgggaggcaaagcccagggatttgttttgtttgcccctaatcatctcttccatcccctttctcaaaagtcttatatctagataatttagtacatttgatctactaacagccagggccataacaggagctgatattacataccccggaagtcctttgcaaacacactgtagtggcgattgattagtgttccgagccataggtaacattagcctgcctcgtaggaccctcagatgctgaccgtatctgctgcaattcttagatgtaaaagagcgcgcatcgtataaatcaaaactagatgattattttcatttgaaattgttgttgcactgtaatttctcagggttttgtattttccaacagtggtgtcacttaatgggaagatcgctcaggctttgtaactgggcataataccaggtattctcgtttaggcattctgctcagtagtattaacctgaagccataggacatgccaatgtttttttccgtgttttttaaaaaaattaaaatggttggctacaaatgcatccttttttacttcagagtaagtcggccttggttaagtcttaatatttctcatgcctatttttttttcttcaaatgaaaacatacggagagaaaayagcatgtttatgccttttggttgtacccagcactgcccagaatggcttacagagtttatacccatggaggtttcgtaaaggtgacattaacttcgcagtaaagtcactgaccccgaacctgtgtcacttcaggcttagccaaatgctaacagagcagctcaaagcttaagcagaggtatgtgcttgctaagtaagtgtgtgttttggactaattggtgactaccattctgaacattaactgccctttgtgttttaatgttgccaggaggccgattgtgtaacctttggaggcttccctgagtttggagaactgaattcatgtggtgacttcctatttataatgtctttgggggagctatgaaataacttttcttctaagtgtgatttttgcttttttaaaagtttttatgttgttgtcaattgggtatttcccttctatgccaagacgaattgtaggttcaggtttctatgcagcctgtatgtaaacactggccctaaagaaggactctatcactctactttcagtttcttgcattaaaacaagtatgggtagcggtatccttcttatttctgcttcctggtcctgtgtgagaccctgaaaggtcctaatggcagtgctgattagattgtggccagggttcacccacaagttccgaagctggggaaggtggaagtgctgttaactgacttgtcccatgtctggggttttgcagcctggggagaggtgaccacccctcgtttcagtccaggtagggttttatgtccctgtcaaaaatgtgttgtgtgaagtaccttgactttcatttcccagggaagaaagcccgtttcaattggctcaagcggaaaagagcactgtgggtccacttaatggaagagtctaagagtggcttcaggaagtccactgggggctccccgtgactctgcccacctgcatattgtcttcattctaaggatccakgtggtagcaaaagggttgttacaactttaaccctgcatccccaccttcaggttcagtacccaagggtgagcaatctgttccagtggcacagacctgtttcaagaggtctctagccgtgatagtgctaggccactgccctccaccagtgtgttccagagaaagatgctctgatgtgccagcccaggccatgaggttcccggcctcagtaaggaagaaggaggacaaggtggtcccttaggagaaaatgtggatattcaagaaagagggtcgcaaaatagcaaacacccactatggctgggcagtacagggttgcagaaatatattttgatgtgtgatcgcattggagctacttcaaagagcaaacacaccactttgatttatttctcttagtgatacagtatttagagagggagatactttttatcttcrtgggatacttacagtggtgctctagaagccatgtactgcttctggcttctccttcctttcctccaaggctcctcctgcctcctcccaaagctctgtgccctgaaagakccttgagccattgctcagatgtcaaaattgtattaagcagacacatcaaattaaaacttttgggatcactcaccaatatggtttcctgtacagtactgccctgaggggggattacaagtagttatgcatccatttcattgatgtatcatttttattaaaaagaaaaacaatccaaccaagagaggaagtgtagccagctgcctaaagagtggcgatgatgggagatgatattttgattacattaatccatatcctgttagttcactttgcttctgtcgctgctgctggtgaagttactaatgtgaactaattacatttgctctgaaaagccagaatttttaatgcatctcagcaagaaaggttaatattatcaatttaacagcatgaatgaaacattgtgtgtattgaacttgaactgtcctaaaagcttggataataaaaacccagtggcttcttttataactcactggataaacagttattggtgagacatggataaggctttcttctctttcagttttatggggggtggtaggcagtcagcattagatgctgtctgtttacagggtgatatcgtaacttcgtgaaattggaggccacatttaaaaaggcactccttccttttaaaagctttgcaagggggctgcatatattttcctaattagtgggaatattttcttttttctttttttttttttttttttgagacagagtttcactttattgtccaggctggagtggagtggcatgatctcggcttactgcaacctctgcctcccgggttcaagcaattctcatgcctcggcctcctgattagctgggattacaggcatctgccacctcacctggctgattttttgtattttagtagagacgacgtttcaccatgttgcccaggctggtcttgaactcttaagctcaggcaatccgcctatctcgggctcccaaagtgctaggattacaggcgtgagccaccgagcctggctggtgggagtattttcaaagagaacaacaattcaccacaccccaacatggtaacagtctttttgttttagaagcatctgtgaattgccaagactcgtagaactaagatgtattcraagtcagtcgattttctggaaacgacccagtccctgaagatagtcttttggggagttgagtgttttgagagggacaccccctctacagggacttaaaatggaatggctttttgtgtgtgcacatggtacctgcagtgatttcttgtgtttaattacttcctgcactcatctgacttacacagtggtaaacaatgaggatgggaacaggcggcagctgctctgtgccatccaccgtcttgggaaccccagcgtggcattctctctggggcagcatgttgaagtgtttggctggtgacattttggtgaccagttggctcctcattgtctttcaatgtggagattaggaaccgagcgaggatttggaacccttgcgtttgttctgccaagaacatgacttgcctctggcctgagagcagtggagtaagctgataggagctagaaatactgttttgggtaggacttacccaaaagagtgggctgagtcacagaactcccaagtttgagccctgtcaaataaattctgaattgttctcaggtatgtttctcaattggaatttttttaaaaatttaatttaaaaaagacttcgaaaagttaccttgttctcatttttcttctccctctttgccccgtccccacaatatcttagggcgaagaaaagcaggtttgagaaaagctttttttcatcatgtatttgtaatagctggagcctgctgagatgatgaggtrgagtggagggagaaagagaccttgaggaggtgtggagggggaaggggtggaaagttctgtcgtcttctgtgcctctctctctctcttgctcagggtctccagtcagccctctgggtttgtgcccttcgtgctgcactgacaggtcaaagccgactcaggcctttgatgtctgctctaggagcaaaagtgattcctggtcccgcagccgttyccactgccttgtgtatgaaggtctgctgctctgaggtggatggtggctctaggcaggctgtttccgctgggtgcggttgttgctgcaggtttttctatatagcttggtcatgctcctgtatctagattaaaatcctatgacagatgggcctgcttatatctaaacttattcagagagtcttatgataggcaacaggttaccctttaccggggtaaaacatggtttattctacagtttggtcccgttgtaaggccaggagatagagtctcactagtttgccccggctgaactcaaactgctggactcaagggatccttccgactcagcctcccaattagctgggactgttggtgtcaggcacacaccaccttgcctagcttgaagatctttcttctaaatgagcgggctttaaagtgatcagtgggacctgggcaggttggctcttgcctataatccaagtgctttgagagaccgagacaggaacatcacttgagcccaggagttcgaggctaaagtgagctgtgagcacaccagtgcaccccagcctgggcaacagagtgagactctgccccaaagcaagataaaattatcccacaggattttagtcctgacttgtgtattactatgcagttgtgtctgtstgaggctcagattcccccccatttaggatttgtgtggctaaatctcagatctcattttcaggtgaatttctctattaaggttataaaagaccaaaataactggaaattcaactctgtacttgaatacttggtaatgcccagcattctcttgactatcccatttcacagtttgccggtcatttccccagtgtactcactggattcttcccgcagccatgaaaggtaggtataattaactccagtttacattcaggacaatagaatgttcgtcaaaatgcttttgcacatgttttctcaccctgagtggctacacttgtacagtcataccctccaaactctaagatgtatactcttacataccaaaacacaaagaaacaacaggaagtaagaacaaaactcaagaggtctgagtgacatcttgccttgcttcacaacttcagagtttgcattgctttaaaaacattggttataagtgagtgtggaaacagtgtgttcactatttttatgctgtggctgtgctgtgcaggagctgggcttttcgtgcattttagacagaattgaccttggttaatgcttgacttgggaactatgcagaaacatccaggaagtggtggtggctgatcctgaccgtcctcagttttgtgaagcaacagcctctgtgcctctttctctgcatgctctgttgacggtctagtcttgagagagaacctgctgctgtcccgtctgtcrtagccttcctagcaactcttaggcctgcrtgctgtgttttcatgatctcccccaaagcggcactttgatgttttttcagagtcaaagtatcactgtggatatttatcccaaacaaaattgcaaactgatcaaatgttatgtcttttgataccaaatcaaaaacgattcttggtggctgatcaggttgtctcctaaaaatttgccttttgaacctatactgcctttatgagatgattatgaaagtagaaaatagcctgtgaaaaatggtacctttgctaaaaagaaaaaaaaattttttttgaaactaagagtctctgttgtccaggctggagtgcagtggcactatcttggctcactgcaacctctgcctcccaggttcaagtctcccgagtagctggaactgcaggtgcacgccaccacatgtggctaattttcatatttttagtagagatggggtttcaccatgttgcccaggctgttctcgaattcctgagctcaagcagtctgcccaccttggcttccgaaggggctgggattacaggcctgagccaccgcgcctggcctgctgtaagaaaatattaaacttaggatgggaaatgtgatctgaacaggattcctgtgaaggtacccagtgtaggtcttagtctcctctccagtgtacatttatggaggggcaagatttcaccattctgtgaagaactctgcgtgttgacgactgctcacgcctagggaataaatttcagagcatgcgtagatagtgccattttctacttaaaatactataatccattatttacttcggaaaataaaagcattaaggctgaaagttttgggttagtaatcttgatgttttaaaatgccttagcattccttcatttgttttgcttgccacgtggttttgctctgatttacacacctctgtgcatggctaatccactgtgccactcttggggctttattaactcttctctgccagtttttcccttagagaatatcatggccattctctaagatgataaatgggactaagagtaaatgcaggctgaaaaagcatttaacaggtcaaggatctgaagcttttaagaaggcaaaacaataaataagaaacccaaacagagtcttgaagcacacccatcgaaacccaagtttcagaatttgctgcagccttgctgccaaatcacagtaaaagctgaaaaggcttttgtggttagttacgtgtgatacaagaaatcgatgtgtctgagagaagtaggatttctctttttgagggggaaaaatacagcaaggggaaatgttttattaacaataaatatgcggcttaccatatctgtagggcacagatttggttagtagtattttgraggcaggataaaggaagatcctaaaatctctgtgctgtgtagcttccattcgagctgcacatgttaaaaacattctaggatccacacagtttaaacaaggtggctggcttaggaaatgcttctccccattccttggcatccccacaaccctattcycctactttctcttatgtatctggactggcttttaaaagatatttagtgaaatttaattttctagggaaactccactttgtcaaaagtgtagtattcctcaaggatagctttgctggtcggcaaatctcagttgagtgtatttgtggtttaaaaaaaattctttctgaatagaaatacaaagagtgataatgtttaacattttattttttaaaaagctttacgctgtgtaaattgtgggttgacttcatgtttctaaactttgtcttttagaatgactctcttgggtaaattattagcagacactctcgtgttgacatgtccattttcctttccattaagctgtctccattgcagttctgttgatatggctttatatagttttcctgagcttttttttttttttttttttttttttggtaacaagatacctatgcaagctgaaaaactcttggctttttagtttgtatcacttccagaaacttttagatgctacgtatagaagtggctttcttttagggttaggtaagatacttccttttttggaaatagttttgccatttggtctcgctgcctgatttgtgctttttcttcttcagcaggtagtaggaggctgtgtattgtattgccttttaccagacacccagaggggtcatgttggaaaatagcatcctcttagcaaaaacacaatcccttctctgagaataaattgccaagtctttccaggtcattgatggactctcaggtgctgcatttctgcacgtcggggaacaagggtgaagaacagagctagtccagcactgctccgtcctcccgcatttcttcttctgtagagtcttttgcaaactagagagtcttgcagagagttgttgggttttcccaggagatactgtatgcaaagaattgtcatgaagacataaaatcaagtcttggtgtaaaacttttaataaatttaaaggcatgtctctgtttttctcctcctcyatggggattttcatgtggttagtaataaaactgtaggcagttgtatgtctagatttctatgtaatttgtttgtgttcgtatatgcacacctgtatacatgtgcacatgtattcaagaaagacctgcagtatgcttgaaaggattgaggtgcctagtttgtggtagtagctgaacagagtgggaggtcaaagttaagtcattgtgaggcaagggaacttgacttagccctttaagaattggtctgtccctgctaagccaaggctattagtgttttcttccctagctgtgttctgaaatggttcacctgacattcagctgggttgggggagaacctctttaaacatcagatcttattccggaggagtgtatccagccttctcacagcatatcctgttaaatatctgttcaaggttagcctaggcctggagtatggacagcatgaagccagatctaaaacagatcagttcatggataaatgatgaatttaataaaatttgaaaataaaccccacataactagtgctgctattgatcattcatatagccagcaggagtggtgagaggcttggtctgcctgaggtgtggagatgcttgtggyggggggcaaggtggacgagggctggggctgctcctggagcatctttacgcgggtggaggagctctgacacagtggcagtgtttgtaacactttccaaagggattaaaataattctgtagagttaaccctaggctagtgtggcttgatctgaaacagtcccagccagaaggtaagaactcctgtgttatgttgttagcatacaatttgctgaagttcacattttaaattttatatttaaaaaccaaaaagtagtactgatcattttggactgtttcaaagtgatattgtttttacttgttacaaacattggcttgcctgcatctaattgcactcacaatgggccggatgtggtggcttacacctgtaatcctagcactttgggaggctgaggcgggtggatcacctgaggtcagaagtttgacaccaacatggtgaaaccccgtctctactaaaaatacaagaattagccaggcttggtggtgggtgcctgtaatcccagcttctcgggaggctgagacaggagaatcacttgaacctgggaggaggaggttgcagtgagccaagattgtgtcattgcactccagcgagtgcagtgtaaatcccttaaggaaacagtgtgttgtggtaatcrtgatatcatagtaaataggttttgttcgttatttttttcttttacttccttttctaccagtgactagtcctaatgtgttctaacttttgaaaataaagtacaaattagatggatttaaacatacgggaagtaagacggaaattcattacttttaaaaaacaatttgttgtggataagatttagaaatggaaacacaataaactgtgtttccatgacacaggtatactaccaagttcttacaatgtacctttgaggtaacgaattttcatgtcatttggagtagggctgggccagtgagtcactcatctccttgttcattcattacgtgaatacctagtaaatgcccactaggcaccctggagtcatttgtgtagagtggcatctctatacaactgttcgactaactgtcggagacaccctaatcaccccagccacaaacaaatagaacattgtatgtgtgctgaatcccacaaaggccagacatgatgccatgagaccaagaaggaaaagaaataatgtggaaagggtttggggtggaaaggtggggaacctggaggcgggccacatggggccccagaagccatgttgagggttttgtcttcaccaaaggatcagtgggagattagtgtagaacattaaacagaggtggggtatgtgtcatatttccattaaaaaattcatcctggccacagtgtaaagaatagattagggaggaagccaatcaggaagcaattggagtaggcaatgcaaaaggcaaagtgaacttggactagtggtggagataagttgactgcagagagagtaggaagtaaaattggccaggcctgtgttgggggtgggcttgtgagcaggatatcaaagataatgtccaggattctggcttggatgacaactatggcaatgcccattactgagctaggagatgctggaggaagatcaggtggggactgtgagcatgagtttgatttttgcagatactgggtttgagacacttctgagtcaagcaggcatttggaaatgtggactggtgccgagaaggaattcccagcagtgacttggtttaggtggtcctggaaagtagaaacacacacgagataattctggggatggagcttaaagggacgtcagcgttcaagggccaggtagaggatcatgagctgtaaagggacccaggtggytccagcacagcgaggaaagcatgcgagtgtgatggccaggcttccagggagagaggagggttttaaggagaacaacgtgctaaaagccactaagaagccaagcagagtgagaaatgaagacctccactgggtcttgcaagaggggaggcctttgaggacctcacctgagagctgatgaatgaagtgatggctggaagcagctctggagagggaggaatactgtggggaggggaggaactgaagaagtagagaagcatggctgtgcacaggggaggtgggatggcagccagggaggagcagaggtggaatgtggatcttgttttccccaacagagatagaggggggctaaaagtccatggaagggactctgctgagagggaagggtggatccatgagacagaaggggagagctccagtaaggacccagaggtctgaggacaggccaaagcacagatggagggattagctttggatggtaagaggaaggacagatggccccttaaacatgacggtaatgcaaactgctctgttttttttttttcttttggcgtttgtgatgaactttgtatatgctttccttgtttgatccttatcaaaccttatgagaagaaactaccattctcctcatttgatggatgaggaccctaagccctggagaggccaggaaacattcccagagtccctcaggaggaggactagtgctgggctcctttcctcctgttctgctgcctctgagaggagccaggattgaatcgtagccttgtcctctgacctggaggtctgggagtaactctcttatgacttttttagcctagtagaattgaacatgaacttcatgttttaagggatggttgcatttgtttgaatggtcacttctttttctatcagtattagctaatatagggagaaggaagtcatgcttctcaagtaaagcaacagtatctgtgtatccatttacttgattgagctttctactgaattacaggagttaaattatactttgttacactcttggtattacaaaatgatggccatgcctttattataaaatgacaccagttattctttcctggaggatgtgccttgtgtcactagccgcactaagcacttccccactagtggccccatgtggttgtgtgtcatcgctgactacctgttacaggtgaggaagctgggtggtgcagagacagaaagccggtggcccagtcaggagctcctaagtggcagagccctgtctcctgggttccttctcctgtctttcttgcctctcacttgaaataagagaggacatcagaactggcctgaatggggccctggtagggcaggaacaggacacctctgtggttttgttatgatgtcctgaggataaaggagtgaaaaaaaaatctttgaggaattgaagatttctttatgaaagatggctgaaactcctgacagcttttcaaattcatctttggagaaacttccgttttctctttcctgttccgaggcttaaagctgccctgaaatctacacatttatcaacagtctcttgtcaagactccagggagacaagaactcttatacattgctgttgagagtgtaaaacggtacaacctttatggaaggcaaattggcgttataaatgcgtgttacctttgacccagaaattctacttctaggaatttatcttaccaatacacctgcccacatacaaattgcagcattgtttttgatagtaatacgttagaaataacccacgtgttcttcagtgggagactggttaatacactaagatatatgcacaaaatggaatgctctgctgctgagagaaaccacaagtatgccctgcacccctgtgaatagatctccagtatattaggtggagaaggcaaggcaggcttcttttttgtaaagttaaggagggtaaataagactgcatgtttgcatctgcttgtatttgtgcagactgacactagaagggaaaccaagtaactgaaaaacacgatgattcaccggggtaggtggggaaacatctaggtcgggacaggtatgggagtgacacacctcagtgtacatctttgtatcatttttaaaagtctgtgcttgcattatgtatcaaaacttagtgctatctcctcaggtgcagggttctctggaactctgtctaggttggtctcttggatggcattcttgsagacttgccggaaaaccaaacaaaaggtgtgagtgcatgcctcctggatagatgtctttttagtgtaacttagcacaccttgtacactgtcagggcgcctctcagatgagtcatcccggcagcccctgctccatgagtgtcttccccacagtcctgagtgcttctaaaatcatctacaccagtggaggcaaaactagatattttcttagtttgcagaaaggaatatttccagacaacatgaacttgttctcctttggtctccttttccttgtcattgttcaagtcacaaggtctgctgattaaatttccccttgggtttcaaaagaacttgcttgtttggttgttgtgttttgccttttaatttgagagttgaggcccccaggtgcatgtggtaaagaattcaaagggctaaatgggtgtgtgttgttcgttatttctttgaacctcttggcacttgaatggtgtcagtaatttcactaattatggttggcaaagaaactctgacacatggctttggagctgtgttgttcttacatcatatctcttgagttgaacctatgctctcttgatggatgaactcgtaattcaccaggtgcgtggatcgctgtgattaattgtttcaagctatcagttatttaactctctagtgccaaatgttcaggagaaaatgtaagtgcagtgtaatgtaaaatcaagccggcaactccagcaatttgctcttcaaactatagctctatcagttcccattcatttatacacttacactactcaatttgtcgttgttgttgttgttgttgttgtttttgagacagagtttcactcttgtcacccaggctggagtgcaatggcatggtctcggctcactgcaacctccacctcccgggttcaagtgattctcctgcctcagcctcctgagtacctggaattacaggcacccaccgccacacccagctaattttctgtatttttagtagagacagggtttcactatgttggcctggctggtctcgaactcctgacctggtgatccgcccgcctcggcctcccaaagtgctgggattacagccactgtgccctggcactactcaatttgtaataaatcagggtaagttatttttggtgccaagtcgattaattgaatataggttattttgcatcttagattccctctgacgactaaatcttataagcagaggtatgtgagcatgagaactgtgtcgggtggtcctgaagagattagtggattagaaggagatttggagatttttaaaaaagcctctggacagtgagttaaatggtgggttgacactctgtggtcgggactttttggagagtctrtaaagttctgctgtatttctcaagagctagagagagatgatactatgaccaaatttggtttgaatgtattataatgtactgagtatcactaatttgttgggaaatgactgttaaaaatacttactgacgcttaaaaatatcacctatagcattagtataagtagccaactgatttacatatatttcatgtgtgtgttgggagaggggtgtggattcgttaggccaaagatttcggtaatatatttggaagagataaatgaagataaagagataaattaccttttgaataattccaaaactaaaaatgcttcccttaatttttatttctgattttcttatttctatcagagaaatgtttctcatgtgacaaatataatgctttcatatttacttctgcatgcacaacttttaattaagtattaattgattaattttttagagacaggatcttgctgtgtcatccactttggagtgcagtggtgtagtcatagctcactgggacctcaaacacctgggttcaagggatcctcctttttcagcctcctgagtagctggaactacaggcataagccaccttgcccagcaaatttattattattattatttttgtagagatggaggtcttgctgtgttgcccaggctggtctcaaactcctggcctcaagtgatcctccttccccagcctcccaaagtgctgggattacaggcgtgagccaccacatgcagtccgtgtacactttcacaccttttaatttctttactcattaggtgcattctttagcaattatgtgtaaagtggaaatgagcgtgcaaatcgtcattttctattgacttgcactccagaattggaaaattggaaaactgtaggaaactggaaaattagaaaactgtaggatctaaaacaaatcgcttctatgacttataatattcacttgtagaactcactggcctttgtcagctttcagagtatgtgaacactttttgccatgtaagtagttagtccattggyaatggatatatgtaagttggtatcttcactgcaaacatttagttaattgcgtttattcttgagccattcttgctctacccttaggacttgattttcagtagctacagtggttattccagaagttgttagaattaagagccaggaggaggtactatgtaagctacatttagactccactggacactcacatattgcacgtggaatatcttaaaggggttgtgtgctgtggtcagggtgggaattatctcttttctttccatgagacctccactgtgcattatttaagggcctgtcaattgcccgttattcaagttttgttgttcttggaggacactattgcctatttctttccttgtttaaaaaatttcatttaggtaggcttagcatagttgcagtagaatttaataaatccttttttttttttacagaataaatctttttattacgtaaataccctttaatttgcctatttttaaaattcttgtttctgtgcttaccttgttgttagacagccaaggggatatgctgctctttttagtgccaaggtaaaaggtaaagctgtatcttaaatatttgtatttctctttggtcttggtgacccaaagtgatttgggtcattctgacatttaatcaagtttaaacaacatggctcttagaagtatgtttaccaggtaatctgagggctggttacctggtaacgcaattgagaaatttcatcaagactaattgattaatttattaagcacttattgtccagtttgcctttaattttcatttttctaagtttccattagctatcatggcctcacttgttatttmataatgaatggttacaaattgtttgtgtgtttttgtaattagaatgtaatagcaatcgtctaccagatgagctgacattgtaatgacatgaagtcagtaacaattatgccttacaggaaaattaattctgtaatcctatcatcccatattttgcctaagagattcgatttggctgctgctaggctgcttaggcaggtgacagcatggtgggacacttctcatttttctggttagactacttaaccataacrttcatggtgccacctgaaaaaataattttatcgttttagacttttaaaatatttttaggctttttttttttttggcttaaaaaaagaatctgttctacttgggtattttgttctccttatttcttagtgaacaaagatatttgctcgacttctatcccagaaggaccatcctttcttcttccttttccttacctctaagggatatgaagctgtgagagggaattgcatatagcaataccattttgattccagtgaaagttcttacctttctcttttgtcattctcaacctcttacctgaagagtccattccctcagtatatagagcatctggaagtctaaggtgcaggcaggactgaaagagctgagaaaggcctcacatcaggtgacactggggcacctggctgtgctcccttgttggggggtcccttggcctgggcagttttgcgcttctccctgtttccctgtgccctgagactttgtgggtcacaggcaagggggctggcctccctgatcaagggcccttggcctaggagggcccctggatttatctagtccagcttctcgtcgtccaggtgcaaaactgatgctctgagatgtttagggatttgtccaagagcagagttggagccacagtccaaatcttctgagcctagtatggtattctgtcatccttggtttcattttgttctgttcataaaaattgcccaaaactgctgggcaaagtggctcatgcctgtaatcccagctcctcaggaggctgtggagggtggattgcttgaggccaggagttcaagcctagcctgggcaacattgggagaccctgtctcttaaagaaaataattgcctaaaactattcagggttaaaaatttgtctctaagcttaagaatttggaaaaactcagaaaagtagccacctataactccagcattctgagaacagttaagtgtattttcttctagttttttgtttgtttttgagacgggatcttactgtcacccaggttggagtgcaatggcgtgatcactactcactgcagcctctacctactcaggctcaggtgatcctcttcacctcagcctcccgagtagctgggactacaggtgtacaccaccatggccagctaatttttgtgttttttttgtagagacagggtttcatcatgttgcccaggctcatctcaaactcctggcctcaagtgatccacccacctcggcctcccaaagtcctgggattacaggcgtgagccatcatgcccggccttcttctagatgtttaaaacaaacacattttagtgyagttgagcctctgatcgttacatgtttatttcctagcatttaaaagcctttcagcgacatacactccttattagcttaattttttcttttaagagcygtgttcttgctctgtcacccaggctggggtgcagtggtaccatcgtaactcactgaagccttgagctcctggcttaagtgctcttcccaccttaaccttctgattaactaggattacaggtgtgcatcaccacgcccaggtaatttctaaaaaaaaaagttttttgtagaagtgatgcctcgccatgttgcccaggtgtctgtcttgaatgcctggcttcaagcgatcctctcccctcaactctcaaaaggctgtaaccctgattttaatggtagtgtaaagtgacatgggatgaaggaaccgtaacattcttaaagtttccccattgttgggcatttgcattggtcccagttttttataagtaaagaaggctgcagcaaactctgttgtactacttaatctttgtcctttatttcaaattatctccctacaatacgtcccttgaaataggatttctgtggaaaggtatcagtttaaagctcttgacccatatggccaagttgctttccaaacagcttacctgttgagactcggacctatgcttctaaagcctatgtgtgaaatgttcacattgtctttgggagaagcttcccacgaataagaaaaataagggaagaacaaataacataattgtttggatatatgctgtggtttgtgtggacgtctcccaccctttcccttccccagcccaagtcagtcttctgtataaacaacttacataatacagactcttcactgtttgtattatacatgtattttgtgagtctgtgtcagtatttgtttacacgggaattagggcatcaggctgtcttcctagggttcctctgtgcagacttgtagacagtatgggttctttgcgtgctgagttgaggtggccccaaacctttcagacagttgctcagatacctggcagttgctcatttacccttccagaccttcctgcctctatattagccaatgacaagcagatgctttccacaaaacattcgtgtgtgaactgttgacatttatgactgttttctgagcccacaccaggtcatttttctataaaatcagaactgtgagagctcagggcatgtggccatcctggataatgggtcctgctgtctggggagtcrttttcatcaaaattcacttttaaagaatagagtgtttattaacgaaaatatgtgagccttggctgggcactgtggctccygcctgtaatcccagcactttgggaggccgaggcgggtggatcacaaggccaggagatcgagaccatcctaacgcggtgaaaccccgtctctactaaaaatacaaaaaaaaagttagctgggcgtggtggcgggcacctgtaatcccagctactctggacgctgaggcaggagaatggcatgaacccgggaggcggagcttgcagtgagcggagattgtgccacttgcactccagcctgggcgacagagcgagactccgtctcaaagaaaaaaaaaaaagaaagtatgtgagccttatcccccaaatgtacctgacatgtgaataatatggctcaaactaatgatgtgtataatattaaattgactttgttattataagtgatacataattcaattttagttaaaatgcattatttcaatcaatatcaaatattgcagaaggaaaacctaaaatagtagccaaagttactcagatgagataaagaatatgtttagggctggaaaatcatactttttttttttttttttgagatggagtcttgctgtgttgcccaggctggagtgcagtgacatgatcttggctcactgcaacctccgcctccagggttcaagcgattctcctgcctcagcctcccaagtagctaggactacaggcacgtgccaccacacctaatttgtttgtgtatttagtagagacagggtttcaccatgttagccaggatggtcttgatctcctgacctcgtgatcacctgcctcggcctcccaaagtgctgggattacaggtgtgagccattacgtccagcctttttttttttttaaataaagagggtctcaggctggcgtgcagtggcacgatctcggctcactgcagccttgacctcctctgctcaagcaatcctcccgcctgagccccccaaatagctgggaccacaagtatgcaccaccatacctggcttttttttttttttttttttttttgtattttttgtagagacggggtmaytctatgttgcccaggcttgtctcgaactcctggcctcaagcgatccacctgccttggcttctcaaagtgctaggattacagatgtgagccactatgcctggccaataattatataaattttgatataaattcctgctcttcaaggagatgtgggttttttttcctcctgagagtatatttataaagttaattggattttatacaaaagaagcttttgactcatttcatttagcttttaatgttatcatctgggaggagatggtgaagaattctgttagccaaaccatggcgaattaatgtttcttacagatggttttattactttttatgatattatttggatcatgaaacaagtatcttggaaaatgtgagatacaaagatgtgagttgggaggtctctcttgtatgtgagttccttctataacagagaaaggatactttcagtttaagctgagatgctttttccttttcactcttgaaaagtctttgttgcaggaattttctgtgccctccctcctctgggacagatctgcttcttgatactgcagggctccagccttccttccagccagctcatttctcagggaagccttgttttcctttttcagaaaatttaaaygtatatttaacgcacaatttaactccctttcctgttgataatttttttcttcttcatattttgttattaataatagcttacagaatgggatcagtatcaggatcgggaggtaaccaggtctccaagttttccctttcgtttttcttttctgcttttaatgagccttaattaatccagggagctaggctgcagtatctgtggctctccctgatgttttctttctgcmtttctgtcttggaggggaacctgaggatttggaagtagagggctctactagtgcttcctttttgtccttttctcattgtccaaaagagtcttaagcgatctccaggaaatcccctgctcctgccaggaatctgcctgtgagtatttgagtgagttgctgctytttaagtaccagttgagaagctgaaggttggtgttgtggttgtgataaactcccaacatgaaaactgaggaccaccagcgttttcagctcacctttgactcacgctggcagctccaggaacactgaacaggagtccccactgaacctttgctgcgttccgaagcagcacagccatggttaggcactgccaggcagctcttggaaaccacagggagggaagttttggttccttctttctgtctttgtttttgagaggaatgagcttggaataaaagaacgctagtaatgactgatttgcaggttaggtgtaaacattaaatcctcataacaggctaatgagaggtgggagaaattatccccattttacagatgaaggaacagaggctcctagagactaaagaacttgctactcaatgaggtcaggattcacacctaggttgacctgaggatagctgctgcagtgctcacccttcctaccttcccaagaaacaatacgcagagaatttcttttctaaatattgtgtgcctagaaggtgctttgtgttatcgaaacagatatatatgtgtatatctggtctctttaaaattctctttaataaaaacaaaaagtgatgctagtgtaaaataaaagatatatatagaaaattgtgtgtcctcgttaatcttctttaggaaagatatatgcatatatgcagtatagttttgggtttttataaaaatgagatcatgctattagtatagtgaatagcctctatatagtctttcgtaacatttttactttttctcggtgtatggatatcaatttaggtcagttgctgcggagtttgaaacgagttaaaatttcagcagttcacaaaatggatgattcatagtttagtcgagccatcatctgttgatggacagtcatgtggtttcttgttttttctttctctgtgtttcactaatgaaacaggattacagtaaattgactcgtgtatgtgtatacatccatctttgctggtactatagaaaagtgtattgctggctgggcatggtggctcatgcctgtaatcccggcaatttgggaggctgaagtgggtggatcacctgaggtgaggagtttgagaccagcctgaccaacatggcaaaaccctgtctctactaaaaatacaaaaattagctgggcgtggtggcagtggaggctgaggcaggagaattgcttgaacccaggaggcggaggttgcagtgagcctacatcgtgccactgcactccagcctgaatgacagagcaaaactccattgcaaaaaaaaaaaaaaaaaaaaaaaaaaaaaaaaaaaggcattactgccttgttcctgatttaaataaaaaaatgtgttttaacaaggaatatgttaagttttggtaaatatagtttatcatatttaagttgtgtatactcattcatgttttaatttttatcggaagaggctgatgaattttatgaaatgcctttttggcatgatataattgtgagcttttgcttttatttggtggtgtaataaattacgttgattagatttcccaatattgaatcatctttgcattcctggaataagccctaatttgttatggtgtgataatctttggatatgttgctatttgatttgctaatatttttttaaaaattgtgactgtagcctacaaagccctacagataggggtctttagtttttttccttgtttgcattctatcaggtattgatattaggattatgttttttaaataatttaagaagaatttcaccctttcccagcatctagaagcatttacataatataggaaataacctgtttttttttttttttaagttagagtaaaattaactggaaaacttcataggcatcccctgtagtcccatcccagaacattttaaaacaaattttttagtttttcagaatatattatagttgttctgttcagcttttaagccttttctctggattttgatattttctacttgctgggaaagaatttatctacaatttgagtttatcgcacagttatttgtaatattgttatcatttctctggtaatcataaccctttctcattactaacacatatttttgctctttttttgcttttttcccccttaatcaagtttgttagaagtttatatattttattgtcttcaaaaaactaggtatattaattttatatttatcctgcttttaatttcatctcagtatttaatttttattcactttttccattcctttaagtttattaagttgaatgcctgtctcatttgctttttagtcttcttaaaataatggcatttaaggctatacattttctttgaaaattgcttttgttacgtatttttggttttagacagttgatctcctttttgttgttttctagatggtttgtaattaaaatatttatttgatctttgattctgacattacttagaagtatgtctgtccttgaatttttcttttgcttaccttttgatattgtttatatgatttatgaatgcagctctgaggtatctgagrggatttattaacgtttacttgcgtccaagtacatgattaagttttaattgctttgtggacattaaaaaattatgcccttggtaaaatgcaaaggttttattttctgtatttagtaaatcaaacttactgattgcattatagtcagatcttccaaattcatgtatgttttcagttgtcaaattgacagttaatgatgcaccttttataatttttttttttgagacagagtttcactctgtcgcccaggctgtgtagtgcagtggcgtgatcttggctcactgcagcctctgtctcctggattcaagtggttctcctgcctcagcctcctgagtagctgggattataggcacatgccactgcacctggctaattttcatatttttagtagagatgaggtctcactatattggccaggctggtctcaaactcctgacctcaaatgatctgcctgccttggcctcccaaagtgctgggattacaggtgtgagccaccacaccgggccccttttataatttttaaacttttcatatttccaagagaaatgcttagtgtatttatctgccgttttgcttgatgcatcaatatgtgtaatttttttatttttcagggattacatatttatcacatgtaatatccctctctgtccagtttaatgcttaatggccttgagttcttggtttgattttactattgccagctttgctttctttttacttgactttgcttggtatactcttgttcaattgtttgtttttaaatagagctggacttttaaaacccattgagacatttttgttctctaatagggacgttctgccttgtctttctttactgtgataatgcatacattttgctttattgctttcatcttattcaatggttgccatttattttactttctgttattctcaattcccatgttaattgaacaagtcctttgctaatttgaaaagtgtgttattttcaaagctaccggtgcctaacaatttgaaaatctgtatttttctcctgaaataggtaccagcattaaattactaattcttccaccagggtttgcatttccgcaatttctgccgttcccatgactttctctgtctcctggatgtgttctctgtcttttcactcatggattctagtagattcttattccttgctcttgggcgctcgcatttcttcttcttaatcctccagaatctgatactctagagcaacagatcttttctgttcaatttaaaattttaaagtgtttttttttttttaattcctgaaagtttttatactccaattgtgtctccacatatgctcttagactcctcttcccgtctagttctcctttcttggttcaattagttctgtttcagctggtgccacctgttgcagctgagcttggtcaccctccctcaggctcctgcgtcgtcctcagtgggtcatggtttttctttgcttgccgatggctgccctcagccgtcacacaagtcatgggttagtgtcactcaaggaatggcagaccagcagatggtaggtgataagccaggaaacagatactgtgccgctgagttgctctgttcccagtctcttccgacaacataaggcttgggaacagttccaccttccatggaagccccccttccctctggtttcacctgggacagcaggatgagcagggtgcagggccttcttccctgtggatggactctcagttacaatgaccatggagaactgtacccgctctctgttttggagatttgggagatcctgagggcctcagaaggccctcactctcatcccatgcactacctgtaagctcattagattactgtccttgttactttagagaggggactgtgagggaggcaggaccaagtatgtttattcaggccactgtcttccccataaagactatatttgtgtacatttttctttgctgtattgtgagaaggaggtagaaaaaagatgtgcatgtctgcatttggaaacagttctgagagtggtgctgcatcagcggggctggattgccctcaactataagaaagtgggatacttatataaaggaagcataatacagcatgtttctcttacaggaaggactgtttcttagagtcctcatcctctgtctccatcactcagtatagcaaatcatacattccatcaatgttaatgacatcaattgtatgcctgtaagtatgtacacacgcacaggggcagggggcacttcttcactccacagctggaaaacttgggacaaaatgcctagccagcttggcccaaatttgagggtattgccatctgtatctcagtgcaggtgtttctgtctgatgttcacagtctgtttatccagagtgccccagaaaggacagtagtgttaggttaaacctgtgtatgtctgttcttggttttaataacagtcctgtctttggaattatttagtgtgttctctcatttctcaggaagtcaggatgttagtgccgaagcacttctctgacttggtccgacattgaagtaccttcccctgcattacagaagaacggccccccagggggtctgtttgatgaacacatgtattattgcagtgagatactctagaaatagcttcatgtccttgcaaaattgccagcacaagtaaggacctggaaattgttgctatgcatgtatgtcagaagatttcttaaccaattctgtactgaataaaataaaatttattttcaagttttgtagggacctggggcaatatgtcagatagagttgaatattttcaaggcatttttagttcatggggcacatagttggcttaagatatctatgtgtatcaggactgaaaggtaaagtgcccgaacctgctaatgaaagaggtgtctgtgtggccatctgaggttcagccacaatgtgtcttgcagaattattttattttgctagtttttaatttctcaaacagttcagctgcctgtcccgtggtaccgtgagacttctaattcaagatgaccagtatttgcagacagagccactgcctttgctgccacattttgcttggttattgtgtgagaacaccatttttctctttttaaatgaattgtgtttctctttttaaattgagcatcygactgggcgcggtggctcacgcctgtaatcccagcactttgggaggccacggtgagtggatcacctgaggtcaggaatttgagaccatcctggccaacatggtgaaactcctgtctctacttaaaaaaaaaaaaaatgsaaaaactagctgggcatggtggtgcacatctgtaatcccagccacttgggaggctgagggcaggagaatggcttgaacctggsatgcggaggtcatagtgagccaagactgtgtcattgcactccagcctgagcaacagagagagactgcctcaaaaaaaaaaaaatccgtttacatagtgataaataaagtaattactatagtggtggcattctgcctaagtcatcttgaaaactgaatgcaaaatctttttaatagctccataatggtctcttgaagtgttacagatttttataacratagctgtaatacaagtgcctttatttactgtgagacttgaacattttgaccatttacatgggtacttgtgtgtctccagctgagctgagtgcatgtcgctgcggcattgcaggcgtgtgtgcatgttggctcttgcaacggggcgtctgccaggggttgtctcgggcaggagaaggaggccagactggcaccacttgtagtgattggaatgtgtctagtccagctcttcagttccatgtaggaggttttaggatggagattgtgttttgggaactccaagtcactgtccaatttggagagtattatgtaagaaggcttatgttttctgattacccatccttcgatacagaccaaataataccacagtgataaaaatgggaaaggagctgtcgctcagctcttcttggccgtgttgtttgcttttcgatgtctaatttatgaaagcatttcaaagtgacatatatactgaacagcttcgtcttgccaaatgtaaaataaactggagatgagtttagcacagagctttgtagattgttgtcctcttggtagagtcggggcctaaacaccacctggcctctgtgccagtggacaggtgacctgcctgtcctactgctggtctctgcagctctctgtcttgggcaaccctggctctgagttccagagtgttctccagtaggagagtctgcaggggcactgtggagcacctgggtatgtgcacatctgttgttggctggcgttgtctctgatggcttggggtgtcacagagacatgacagtactgtcactgcatacctctcaagcttttgctgagtcctacatgagttgcaggggcagagagggagggagaaaacaatgcctagccacactgagaaaggggaaagtgctacagagtcctggaaggaagcgaggatggacatggacggggaagcattcataccaggcaggaaaagtgacttcatggaccagtcacagaggacagggccagggatcaaaccttccgtaatttgcctccacagtttgtctgagactggctacctggttgagtctgccagagccctgtgtgcaggtactaccactcactgtcacctccaggcaggaaaggccatgtgaatgcatgcatctttgcaggaacttgcccctttccactgaggtttgaggcagactccaaccacatttccatccagtggcttagtggtcttacccgtgagcttgaactgttgtccctgccaggacagtctttgcctctgtaartatctccatattcctccatcctttcaggtcccattcagtccctaggtcctccatgatggaatattggttgatgcacttattccacaaacatttgttggccacctttcaagtgccagwcaacccttctaggtatggaggggtacagtgatgagcaagccactgtttctggctgcagagggctcactgtttagtgggagaaacagacaaatcatacatcttaactacactgcccttgattgctctttacctgttatatcagtcgatcttgcctgcctagcatttgttccctgtttgggggcctgtatgatgttcgtttggatacctcagggtacattttcccatctttgtgatgatgtagctcacttggtctgaatgatatgtaatcctgcacatgtagagtgaccattatatttgcataaatagcattggaggaatatataagaaatgaataaaagttgttatatcatttgatttttcttttcttttcttttcttttttttttttttttgagatggagtctggctctgctgcccaggctggagtgcactggcacgcgcatagcccatcgcagcctcaaactcctgggctcaagtgatcgcctgcctcagacttcattttgatttgtgaacctcgtgattctattacttgttccacaaaaaattttaaatgaaaaagtatttcaaaaatacatatattccggccaggcatagtagctcatgcctctaatcccatcactttgggaggccaaggcagacagatcacctgaggtcaggagtttcagaccagcctggccaacatggtgaaaccccgtctctactgaaaatacaaaagttagctgggcgtggtggcacgtgcctgtaatcccagttactcgggagactgaggcaggagaattgcttgaacccgggaggtggaggttgcagtgaaccgagattgcatcattatgctccagcctgggcagtgagtgaaactctgtctccaaacaaaacaaaactaaaacaaaaacaaaaacaaaacaggctgggcacggtggctcatgtctgtaatcccagcactttaggaggccgaggcgggccgatcacaaggtcaagagatcaagaccatcctggccaacatggtgaaaccccatctctactaaaaatacaaaaattagctgggtgtggtggcaggtgcctgtagtcccagctactcaggaggctgacgcaggagaattgcttgaacctgggaggcggaagttgcagtgagctgaggtcgcaccactgcactccagcctggcgacagagctaggttccatctcaaaaaaaaaaaaaaaaaaattcctccacaacatatattccaatgtttagtttttctgttacagagatcacatgtactctaacttgtcaactaaatttaaaaggaaaagacaactttgagagaaaattaaaaccaatgcagtgtgtgtaaatgccattttgataagctcttatttcatgttgacatattctatggtgctcgtcttacataacctagttagggaaatgttttgttccagtctggctttgtttttcttcatgtgtttaggtccttccactttccttttgttaatttttggtgttgtacttcaggaaatgaattgagggttgcaaatgacctggagggccttagtttgtttgcttgtttgattttagcaacagtcaccgtggtacacctgacgtggctgggactcctgattttttttttttttctttttgagaacaaagaatgtgtccttgtcttggcatggactgggtagccttgttcacctccccacccatctctccttattggtgaggcattgtaaaccgtgttaacaggtagcatccacagaaccctggaaaggttgtgaagtccctttggaagcctaagggttttgatctcatccaggttgtaatcttaaattctggtacaaattcccttgttacaactgggttaagtggttttaacctcttttgtgccttcattttgaatgcttagactggaaagtcgttcagagactcctgaccgaataaagcctacttccaaatgagtgggttgtccaggtgtgcttgtagatgtcacatacttctaacaaggctctgcagctgcgatgtcaccttgcccagcgtgacctcattagcatgtatgtggctttcagtggccatgtactttgcttctagagctttctttcccattctgggttcttaggagggggctgtgctttgtgtgtggccaggcagaagtccatgttttagcttttcaattctcttgaagaaaacaaatgttgttgataagaacacttgtcatggcatccgatttgttcttgtgagggctgtattagcaataaatagacatttagtttgcatatttaacacctcatcttctttcagcccacacgtcttcactacaggattagcttttcattacttagtagagcttttaattacctgaagctttcgtgtctttactgggatataacttttctccttattaaccagaaaaagtcacagaaaatcttgtaatttataatggaatggagtaatattcacaaacaggctttggcaggattttttttgttattgtgttttttgtttttgtttttttgttacactagttttatcacaagacaagaaagaggggaacttttagaaataaaaattatgtgctaaaataattaaccttcctgagtaacacacacagaatgttggtatagtgtttgcaccagaggaattacatatggaagaatgctgggatcttttaccaaataagggaaagtagagttcattacaaatagaggcttctagcacagaaaagaggacattttataagtactgtgaagcattttcagagataattaaataatagaaaatattaaaccaatttaaacaatttgtagtttttttctaataaccagtaagttcttcgtcttcgaataattcttttatactgttctatttccagctccactgagtgcccctgtgttttcagagaaaacaggagtctgttttggacttcctctttggtatatatggtgggagatttgtttaaaaaatttttttatagaggtaaaattcatatgacataaaattgtccatttaaaggtgaacaactcagtgacatctagtatattcatactgttgtgcaattgccatctctatctagttccaaaatacatttgtcatgccgcaaggaaagcctgtaccccttaagcagttaatccccattcccctttccgctcagctcctggcaaccaccagtctgcattctgtttctatggattcacctattttgcatagtgcatataaatgcagttatataatatgtgaccttttgtgtctggcttctttcacttagcataatatttttaaggttcatccatgttgtaatgtatcagtacttcatccctttttatgggtgaataatagtccattgtatccagttgtatccagaagatttgcttttcattgcctaacttcagggcttcagacacctcaatctttgttctgagatggatgtaaacttaatgtatatctctctctctcacccaatgatcatgccaacaccttttttttttttttttttttttttgagacagtctcgctgtgttgcccaggctggggtgcagtcttggttcactgcaacctctgcctcccaggttcaagtgattcttgtgcctcagcctcccaagyagctggggccacaggtgtgagccaccacacctggctaatttttttttcttttctcttttttgkttttgtagagatggagtgttgccatgttggccaggctcgtctcgaactcctggcatcaagtgatctgcccgcttcagcctcccaaagtgctgggattacagacataagccaccttgcctggccatgccaacaataattatttagaagtatgttgagaatacatcccaataatagaagtgaaagctctttaaaaagaaaaatattcaaaacttaccagctgatcttatgtttcatttagaatggctgcattctttgcagtaccctagggttgtagaaattctcccccatgattgcacaacccactccttctcagccagtgtgcacctggagtcagctgtgtttggccttaaggtgtccatggkccagcagggagagggcagatgggtcagtgttgtcctgctagtgatgagtatcccatggtgggcatgctgatgccacgcaagggagagggtgtctggttctgtgcagtggcagtggtgcaacyccttaccaaggtaccgtggggacctgggttagggcaggaggaggaaggtgttctctacagactgcagggcttggaggcagcctgtcatggggaagggygtggatgaagggtgagccgggaccccaggcaggtacggagcagttcaaggccgtcaagtgtgcttcattcttcagtcattagggtgtctctgaaaggtttttcattgaatcagaattcccctaattcacgaattctaaagcttaagtaaattcagtaataataaactgtcaattatccaagcgatgaatataaatccataaggtttttcaaatccccagaaatccctttcrtctcccacctggttttgctgagcgcctgtctcttctgtctcttttctgattcccacctttcacttttcctccatttttcgcttaatggatttatactttaaagtaggtattctgaaaattccaattttatgaatggtgtgacggtgagaactttgattcattgaaagataaaaataatcattacattttatactgcaagggtcatccttaatattcttcgtatttttaatatagctgcatgatttgagtagttgagttggggattggataatgtatttattgattgattaactctctgggggtccatacatacccctctttatatccctgtggtccctttttagtccttttgtaaaaacttgataatgttaacctctgccaaagttgatgcggtagttgtgagtggtgggacgcaagcgtgttgatttattcttggagacagcagaaacagcaccaccttcaactgttttgtcatgatcatcttgtaaccataattctgtgctaagtcagaattaatgttattttgttaattcaggttattgtgaaaatctccacaggaggttatttaagcaagtcacaaattgatgwttctgtttgtagaaaaactccagctcatccagccagccacattattccagggctgcatggtgtcagcgtagggaccaggctcggtgtagagaccaagggtgcctttccccttcctttccgcccgttaattgcctactcgcccagtggtaccttctgaacttttagaaatccagataggatttccacatggttcattagaattcatttatttttttccatctgtatttctttttgttgtactccctagatcattatttttagttactttttacatgcattggttaggtttttcatgtaatctctcagtaagcgtactgggggatgagtgacctcagtatttaaatttttcataggtgggatgaaatgtcttttctgagtgtgagtatttctgttccattcttcttttccaggcaggctctcattctgtgctgcagtttggattcagggagcactgacccttctgtcaggttgctcctgctatgaaggatggaagggcattttgatacatgaggcataactgtaattatccggtggggcttggtttgtgctgttttccacctcttcgtcatattttggaaaactgaggccaaaagcaaagttcattttcccctttaaaagcttctttaaaaaaatgatgaaagagctttatcaatgttttgaataacccagaaaatatttcttattgttgataatctgcagtttgcaagtgcagcgaatcttgtaggtagatttaccttgagttttttgaaacggtagaattaatatattaaaacatatggtttttagttaaaataggatgttaaaggaatagagcgcacgaacaaagaactttccacttgaacccatgttgtttcatctgacagtgggtatggtgtccctggcaggatagggcttccacctcctgctggtgccggtaggacagggaagaggtggggaacactgtgtctccatctcccaagcatcttacctcccaagtcagatccctggcattgtttgcatacttgcgtgtttgtgtgtggggtgatgttttcctgagaatgtggcaaaataatagaaggtcccagggttcctcagtctgcagaccatagctgagtggtgtgtgcctctagccatgaggtgaagcataggtgaaattcagatccataggaagacagacagactttgcaagttagtaagctaacttgctagaggaaacggtagactcctgtgctggctgccaactaaaaagcctttctccacagttctgttctcatgtacaccctcaggaccttggatgagcttgtgtgttcaggaaattgggcaccgagattttttttgtatctttgattttagttgatatgtagtccttccaaggaaagtattcgttggatgccctttctacactttggcattgtgcaagaggtatcaaattttaaagtaaaagtgcacaacctggccaggcgcggtggcttacgcctataatcccagtactttgggaggctgaggcgggtggatcatgctgtcaggagatcgagaccatcctggccaacgtggtgaaaccccatctttactaaaaatacaaaaactagctgggcgtggtggtgcgtgcctataatttcagctacttgggaggctgaggcaggagaatcactttaaccagagagttggaggttgcagggagccgagatcgcaccactgcactccagcctgggtgacaaagcgagactccatctcaaaaaaaaaaaaaaatrcccacaactgggcatggtggctcatgcctgtaatcccagcactttgggaggctgaggcgggcagatcacgaggtcaggagatcgagaccatcctggctaacacggtgaaaccccgtctctactaaaaatacaaaaaaaaaaaaaaaaaaaaagccgggcgcggtgccgggcgcctgtagtcccagctactcgggaggctgaggcaggagaatggcgtgagcccaggaggcggaggttgcagtgagcggagatcacaccactgcactccaacctgggtgacagagtgagattccgtctcaaaaaacaacaacaacaacaacaacaacaaaacctcacaaccctggtctcccagagcttccatattaataaatctagacaatgtgaaatgcaaatccacttaatatttgatgcaaaaaaaatttatttgacctgttattttaactctttgacataaaatctctaaatcaaaataatcagcaacagttttaagtgtataaatatgtatttctttcagtgcttgaacatttttagacaggaagattcttgatcttctttgtaagcaaatagcatcaaagagtaacatttctgtacctttgtggtatgtaccttgtggctaatttgtccatgaagggataggcattgtgttttgttgcttaagtcgcttaaggcctttaaagcatttccaaactcacctatttttgctctaaggggtataaggtgttaaaaaatgaatggaagttaactcattctcaccttgtctgctaacttccttttgttctttttctgtaagaactcataaagctgtatgcatcagctgctcccaggggccttctaaggcctcagtccaacaacagtgctacaggtgaggaaaggaaagaagrcactatgtcatcatgtcattcttttagacttggtaagaagtatattcaagcagatcagatgctctcagaatcacagcgtgttgtactgctagtaattaaaactgaagtccacrttgaataagaaataattttttattgattgctggcatttgtgagaaagggtttaattagaccaggatatggaggggacttatcgacagttccgttgtacattgttgacatggttattttctgtatctcattttgcctgggaatttgtcattctcttctattttcttatcagtagcactgcttttacacttattagccctagctgtttgtcttgcttatttaaacttgtacatggcacatgctcaaagatttttccaggcaaaatttctttaaagcaggatttgagattttccatccccttccgtctgctggattattccggtgagtgttaatctcccgcctttgtcttagcctctctgtggtcttcggttgcttccttgttctctgtagatctcctgagttggccattagctgtcaacagtcagcacttgctgcctctcaagtctcttcccctcctggctctgccctggttttgctctctgacggggatctaaattgggattctttccagtgtggaatcctgggtgtccaccatgtcactctgacttccagatgataatgagtgtgaccatgggctgaatgaatgtctctctgctgggattaaaagttagaggaaggcaaaaacagacattgcgtgttctcacgtatacgtgggagcaaaaaaagttgatctcttggaggtagagagtagagtgatggttaccagagactgggaaagggggcgatgaagaggggtagagaatgagtacaaacattcagttagatagagggaatacattctaatagggtgactatcgttaacagtaatttactgtatatttccaaatagctagaaggttagaaatgttcccaacacatagaaaggatacatgtttgaaatgatggatatcctaattattctgatcattatacattgcatacatgtttcaaaatatcatattaaccccataaatatgtacaaatatcacacatcaataaaaaataaaggggaagacataggtgtaggcatagatttttaagctgagaaccttttgacagggaagaccagggatggttttagggtgtggggaatctgtgtaagttggccgttagctgtcaacaggcaacaatcactgtctctcaggtccctcccgctcccggccgtgtcctggttctacttgccggcagggatctaagttggaattcctttccaacatggaatcctgagtgtccaccatgtcaaaattgtgtcaaaattcgtctgtatgcatttttcttggtagaagggtccccaaaagtcaccacattctcagagacttctgatccctaaaactttagatcaacagtcaataaaaaggtcccagttgtgtcttagtccccatggcagtacttttgaacatttaaaggtggagaattgctactgaggactttgttctgtggatgaaacttcgaatgaggattgttggtgagagttggattgttgttgtatgaggaagtgcaccttggaatctaatggggtcttcacggaggggragtcagttgtggcactgtttgtgtattccattcatcattcatccctccatccaagcacccacgtggagctcagaaagatgactaacacataccccctgctgctcctgtttttctaaggtgtgctgggaccatttacatttagttctttggagaacacaactacttaggatttttgttgttgttgttgttttcctgtacattgtcttcctatctcccttctggtacccattccaccctctctccccttcctcactgcygtttcataggggttctcagattcctgtgaataaagcaaaccgatgtgcagatatgtgtgcttacacatgtggacgtatttgaggaggtaagagggacctgcacaaggctttagtgagtaagcagagaagttatttatatatagtgagacccagtaaacggcgatgtcgcaggtgaggcagttgatctggtcagaatatgcctccagagacatcactggtgaggcctgcatgcatgttgaaaagagtgtatcttacatctaggcttgggtttccccctgcagctcacttatgaataacaacgtatgcaagagatttgaacattttcatgttcaaatgaaacatgaaaagggaaaaaaatttaaggttacggttaagtttggattgtttgcttattggtttggttattggcaattgctacaaagtccagggtgttctttatcagcagcatgcttatcaagttactgacgttcaagctgagtttccttccctccctccttccttcttctccactgacattttttttttttaaataggtagggaggcatttaatcttgtagcagcatgagagtagcttaaatgtccctcctctagcagtatgtttatagcagcgtaggtaaggaaagcccagcttgcacagctgagctctaaagtgcatacatcccttaagttctcatacacacactggccagtgagacccccaaactgcgaacagagaattctaattgaagtaaaagcatgaagtttttctttattgaccatgtagcaactgtggaatcatttgaaaatttctgaaaacatgaaacaggtgtttataaggagttttctgacttaacaaaattggtgaaataccaactttactaaaaactrctaattcataattttttgattaataatttctagtctggaaaagaggaattttttgaaaatcactgatatttttgatatactgttgttttcaaattgagttctcatagtgtggtcggctctgttctatggaattaatattgaacaagctgttctgaacctaagaaaggtttgtaaaaaataaacatgaaggaagacttcattcaagaggtcacttaaaaattattattattattattattattattattattattattattattattgttattttaagaattaggtctctgttggccaggctggagcacagtggcacaatcatagctcactgaagcctcgaactcctgggctcaaacagtcctcctccctcagcctctctagcagctagaactgtatatgtacaccaccacgcccagctaatttttttttttaacttttttttacttttgaagaggtgagattataggcactagccactgtgcccagccaaaaggtcactttttttttttccttgttggggaggaatcaataacaggaacaccagtcatgatttggtgttttttccagggcagacaaataaagatgatattacgatgtttgttatcacagaatatgtttgcttttgataggggttgggtgctgaagggtaagtggttagaatcattctttttctaagggtacagtcattaatactccttgattcaaatcactatttaagttataaatacatggatttattttctaacctcaaaattatagcatcttaccacatatttgcatgcctctcttgagttaactactggtgatgattcttagctcatctgtggccaagtatagataagagaattagaaagttgtttccagcgtgtgaacttttatgattttcttccttggttactgtactcagttcttttttgttttgtttctatacaagatgagtagctggtggctcagatgacccccgtgctgcatgtacagtcccatccagagagtgttgggggctgtgtaaacctcgaggctcagagtggctgccattttcctaaaagagaagtatggctgctgttggcctcaatgttcagctttacaaaaaytcccgtaattaatgaaggtcaaggcatctgcaaacattaatggggtcacaagggacaaatcagttccttgaggggaagttaaaatgctagattgcttaccgctccagacaaggcrttctcaagaagtatgtgcagtttcagcacaaggattaacacggagcattacttgagccatggggtgccttgggggacatggatcagcaaccatttccttttgctcacagcgcccagattttgttctggggaccactcttatctgcactgcatagcagccacacattttgagtgaaattaaccccaactagcattcgagcgtcctcccctcccccaaaagatggactgtaccccacactgtaatcagcagggaggcatttcctggccacagttcaggttggtcccttagaacgctgctcagaactgtggtttggtggctctgggaagcagtgctctctctgagtgtgaataaggatccacatagctccagtaggtgtctgacgacatcttgtgatccggggggaagccagcctaaggacaaagccattgtggggtgagagacaggattggcacaatcactgacaaccgcagtagtagcccagaataaactgtgcctgaaacctaccctatttttgtattttttccagttttaaggaaataaatcccctttattgtatactcagtttgaatcaattatttttatctctttgggattggtttttggttaatctcagcaattcagaaatagctgaagaactatgctgtgggtttagacatcatgcygtgacaaaaagaagaggatcttagaagcgggggacattcactgaagctttatgagcctttcctgaatcccttcaaatcagatcaagttctctctctcctgtgcttagaaatgctgcctgttaagtcacgttggctacagcacccatctcagatcccttgtgattcagttgtaaagtagattcttctggtctgaattagaggccaaaacacaagacagatcaaaaatggggaacatattgcaaatttccccacaaaagactgaaggatgtgtttaccattgattgcacagggactgcagtgtctatgcttttaggcatggaaaatgcagggtttgactatcgagtttagattttaaagttgaggattgtttctttaagaagaaatatagaatattattcagtcctaaaaaggaaggacattctgacacawgcaacagcgtgaatgaaccttgaggacattatgccaggtgaaatcagccagtcacaaaaggacaaatactctatgtgatttcatttagatgaggttccctggagtagtcgcattcagagacagaaaacagaatgatggctgcggtggtgggggggtggggggtggtttggggaagggagtggagtgatggtttcacttttgcaagatggaaaaagttctggaggtggctggcggtgatgttgtacaacagtgtgaacttacttaacattgctgcactctatacttaaaaatggttaaaacggtacattttgttatggatattttcccacaattaaatttaaaaggaagatgagtagtactcgactcattattggatattacatcagggaactggaggtagggtctcacttactagttacgtagctcaggaacctggaaccagactccttctccagctgggcagtcccaggtttgagtcctggctccactggaggttgtctgacttggakgttaataataacctgccttagtcccagagtccttagagggaaaataggttataatacctgagtccatgtgtatcaagccattgctggttccaggcccctggagcactcagaaatggatgacccccagctgggtcaggccaagtcctccctgctgtagcaagcgggaccattgcctcgttccccccacctccacatggaaggtgccttttgtgtcctgccccatctctgttttaacagtcacaagactgtaggcagatctaaacttgtttgcacattattatcacctggggagctttgacgattccaaagccaggctgccacccccacctctagaccaactgaatcaccatttccaggggtgggactgggcatccgtgttttcgaggcttctgggtgagtaccttgtgcaaacaagttcagggaccgttgccctagacactgttcttcccctcatgtctcaacctgggcctcctaccactgccaccaccacagctatgccacctgggatgtgtcccaagcccccacttgtcggggaagcagctggggaggggtctttggccacctctgcagctataaggatcagagcaacacctggcttctgtgcctgtggcccctgctggtgctgggtccctggtccgcactgaaggatccaggcagagtacagtgggtctcccaggtcagaatcccctgggttgcttgttaaagctcacagggctgggccccaccccagggtttccgattcagcaggtctcgggctggttggatgatgagaatttgcatttctgtcaagttcccatgtgatcctttttggggtctgggaccacactttgagaaccactggtctattaaacaaatctttgcaaattagggaggtgtgttgtgggaggaagagactgatagttgaaagaatatttgcctaaatacagtgcctagtatttgccaagtacgcagccttctttctggctttaatcatacagactttctcaatcacatgtaattgcacatcctttaagcagcttttgactgactttggttttctcttttgtggtgattttccttaaactcccgaagggagggtggaaggggcaagagaaatttttatttatttattttaatttaattattttttattatttatttttttattttttttttgagatggagtcttactctgtcgcccaggctggagtgcagtggtgtgatctcaggtcactgcaacctccgcctcccgggttccagcaattctcctgcctcggccttctgagtaacagggtctatgggcatgtgccaccatgccgggctaattttttgtattggtagtggagatggggttttgccatgttggccagactggtcttgaactcctgacctcagatgatccacgcgccttggcctcccaaagtgctgggattacaggtgtgagccactgcgcccagccagattttatttctttaaaaaagaaacttactagttatcaggacacttgtgttcttggtacttgattttgtcagcattatttttaagagcctcktccctccttccccctacctccctgttgagcccaggctctgaaataacataggtgcatgtgaagttcccctacctgccattaccagacattggtgctgggcggccctcacctccacctcctctcacctgaggccacagcggtgtgcaaggatgtggtctgtcttgagtgtgttttcaaagcagctgtttggtctgtgccttggatgtttttccacagataagcccaaaagagaaccacatcttaaaacgcccgtgaccttgaatggtctttccggaggggcggctggatttgtgctctcatcgtctcaggtatgtgtcaagccactgttgtttcagagctggacacaggtgcttaggaaaattcctcactgaagggttttcaggatttacaagttcttgctgtttttgtgaccttstgtggtttctggtttcacagaaggctttgtttcttggttcttgttgctgctttcagccttggcctgtaatcactgggcgccagggagggctgcggtctgtttcccggggtgtgctcagataccgtgtcagttcacatgtgttgctgcagcggcagggggccaggcaggaggggcgggtgtcctgaagcacgctcaatttgctgatcagggccttcacttggattttgcacttgccgcagtggagacattcctcgtagctactcagtgtggtttgttttaagtgggccatccgttaattcatgtgacctggaacttggttaatgtacttgccaaggttaaagttgagacgctgtttgttaaacctttcaaagagggaagaaggttgccttgaattcagttccagggtttgggagtctgagagggaggtggtgaggggcccggggaggccctgagaaacaaaatgctggttaaggacacagtctgctcaccgacctcggaagtctctagacgtctaaagaagtccaagcaaggaatgatgaccgaagaggaacctcaagggtgcaggcggctctgggatctcagcacatctcagtgatggaatgagctgccggggaatgacccctgtgggkgctgtccaaagtcagagcagacacaaacgtagctctccaggccccataccttggtgggcaagagggcagcaagtgcatcctcacagttgatggggagagcagcatttcagcctgcagaaaagagaaccacacagatgtaagatgaggtctgcactcacttgcctggtcatgcagagacggagctgggagcagctgcatgacttttcagagaagtggcacacgtttactgtaagggtcccaaatgtagaccactgcagatsgtaaggtctagatggagggaccaatagtagggaagtaggggagaagaaagtaaaaccttacagtataaagacccatagatgctcttttgtttttgatgtgtgtacgggggttagrtatttattgagcacctactgcatgacagagtgttcagcaatgacaatgcagagcttaataagaacaggttctagactaatcttttagggggtgaggatagaacagaaataggtaattatgtcctgagaacatgagagagtgttggtggacagaacggcgatgtatccccaagggcaactgaagccttcacagaagatgcaaagcctgtacgtggtcctcggagtcatgccacatggtgactggttatcttagtcgtaggaaaactgagaagctttgaggcatgttctatctgtctttgtgggcatcatcttcattatttgaacaattcagagtgcttgatgccttttgcttcgttctcacaatccttgacactaagctgtgggcttgggttatagtcactcattctgttattcatgtcattttgcctatccttccacttcacagatgagaagactgagacccagagagggtcatggttttcattagccaaatggtgcagaaacccagtggtcacagtggcyctctagctctttgtcacccacagggcccttgataagagtacggtctttctccaggggagcagggttgaggagtgggggcagccctggcctgggtggccatatcctgatttcccctcccttggcccatagctctctatcttgggtgaggtgagaaagtaaggctgctccttgactgtggtcccttttgtgtctgtcctgcactgggccaccttcccaggggccttgtgtcagcctggtagtggtgctagtggccttgaagtgagagtgggtggatcacacatggcagatctctggcagtgaccttttctgtggatttccggtgactgatgatagcctctttggaagtcagcatatgcatagctctctgtcttttgaaaacaatggaaaaacccaccaccagccccaaaaccagctgtctttcttcttatgaatagatatccatgaaaagcagaagagtagtttcttgtaagtactctgggagtgcataatacattttaaataagattaaaaattatgttttattcttactagcatcactgtcagataattgagcgtgagagcattcagtgctgtgtgcttggtacgaagtagtaacatcaattcagtgttcagtacatccactttgttccagaacaatgtattcaaggtcggtgtattttggctgtgccacakagttctggaaattcccaagagaataagttttcacctgttatataatccagcacaagtgactgtgtagcagcaacctcatgtttcatgatgactttaaaatgcaattgattctaaaatttagcttttaaaaatttcgacttcagattttctctgaaggtttaaggtaggcttctcctttattaattttttcaagaaatatttaagaacactgctctgtgctatgtaccattctaagcactttacagatactaattcatttaatcctcagcctggttaggtaagtactgctattcccaccgtacagatgaggaaacagcctcagaggagttaaaacaagttgctcaggttacaccgtcagcggtttggactacttcagtttcagataatcactgtgaaattttactgttttgagctacacgtttcaaaatcttttctgatgcggaactatcattaaatcatataatccgcttctctggagtcagaggttgacaacacattagcacttgactcgagcctctccctggaggaggacattccgtctgcggggagccgagtccgaggctggagcaactctggaaccacagccctccagtagagggcacacgagagcaggctatctgtggagatakcctgttggcacaggggtgaagatgacagaggcgaacccaagcaaagagagttaattagcagagtttgccctccaggctcggagggcaagtcagcctggggacctggagttagttcccttttcagctgtgaccattgaagacattcatcaagttctctggctccgggatgtcagctgtggtagtgacttgcatgggaggttatccgacatacctcacacactttaactccacctcttcagagtttgtggccaagaatggagccaggtggctattttttttttttaaatttatgtaataacaaacattcgcatttattgaaaacttaaagtataataaaaaaataaataaaakaaaaaaagaaaaaagaaaacttattcctgtgtcaggcacttttctaagtgctttgcagtgtattgtctcatttaatagttgtttaaattaacagagtaggccgggtgtggtggctcacatctgtaatcccagtactttgggaggctgaggcgggtggatcacctgaggttgagagttcaagaccagcctgacaaacatggagaaacctcatctctactaaaaatacaaaattagccacagtggtggcgcatgcctgtaatcccagctactcaggaggmtgaggcaggagaatcgcttgaacccgggaggtggaggttgtggagagccaagattgcatcattgcactccagcttgggcaaaaagaatgaaactctgtctcaaaaaaaaaaaaaaaaaaaaaaaagagagtaaataaaattgtaaggtgaatatgttatctacttgatggaattttttaaactaccttgaaaagttttatagtttcctatttacagatgaaattaacatactaattataaatcatgcctcactattcactttaggcagtctatctccttaaggatctccttacggtttagatagataagtgaattgcttaatgtttttggaagtaataaaactgcatttctttttaattaaacaatccagataacaagaagtaattctaataggaaacttgtaggatgtatttacagaaaatctacacaatcttactgaacaatgtagaaaagaagatttaccagcctgggcaacatggcaagctttgtctcttaaaaaacaaaacaaaacaaaatttagccgggagtcgtggcatacaattgtcatgtccacttctcaggaggctgaggtgggaggactacttgagcccaggaggtcaagactacagtgagccacatttgtgccgctgtactccagcctggatgacagagcgagaccctgtttcaaaataaagaaaaagagatttaaatgaagcgaaatgccattttctctaggtgagaaactggaatattatcaatgtcacttcttcccaaattgatttataatttaaaaacaatttyagtacttctgcagcttgtttggagcttgataaaatgattgtagagtttgtcttgaagctttaatagtgaggcaggtttaaaattgggggcaaaaaagaaatgggttttagggtgtagaagggacttgcctgatcacttttgctagaaataaatgtccctccaaattaaattactaatgtcgcacatcagatcgtatttaaatccattagaagattttactgttccattagagctacccatagctggtgaagactctgcttatagtggaacctagtttctcagttttccatttatatttatttacctgagctttttgtaaagtagtaagtacttgactgaatttctgctatttatcaaatgctttttgaatagaaataatgagttaataacatttagccttttttggtaaatagtataaacaagatagggcaaatatgtaaactacttagaactttatctaccttgcatattttgtacctcttatttgcatatgcatgtcacatgctccttatgtaccatgtgctattactgtgccggggtactggggctatattgagtctatttcctgtctttgtagacttgatggataatttggacagcattgtgatattccaggtttaagagtcttaaggttcaagactacattaaatgttaatgtagtccaacatttcttgaactctgaaatcctctgagcatcttttcatgcactggcctaaaatgttttcatagcccagcaaaaggctgattacttatttccctcctattgattttttttgagatggggtcttgctgtgttgccctgtctgcttgtgaactcctgactccggtgatcctcctgccttggtctcctgtttatgttttaaatagcatttctcaaacctatttgagcaaataactttcctgttaatatgtagtattccttgaaagaattgaatttgtgagtccctaatctagacacttttaaagaagaaacaaaactcagtaacacatttggataaaaacctgaatatgtccattttgggatgaaaggaagcagctttgtttaccatgttgaattaagtggaaaacatcttattttaatcatgattgatagaaatctaaatttgtaaattctgatttttatgttttttttacaatgaaaatacattttaaatgtcaccatccccttccccatgaagtcttcattacaactaattttgaaaatactctctcatttatttatattatatatgcatatgttctactgtataattttaaatacttaaatggggttatctttttgcattgttctgtatcttttttcagcttaataatttaccttgcttataattattgtcagtgcttgcggacctgctctttatgcatttttaaccattgcataaagctggaatgatggacatgatttctttaatcactccaaattagtcatttagttgtttccagttttttagtattacaaataactctgcaataaacrtgtcttgggtatgcattcttttagtttaaaatagtcttgttccttcagaaagttgctcaataatagacttagaaattcttttgtgctaattactgtaattgctcattttaagatctccttttattgttttcatagtatataatcctaaactgttacaactgaaatagtccttgagctaagaaagcaatgtggcttaaagataggatttctaaatagagacttaaaaattaacctttttggagctgtgacttcctgatgaagtggcagcacacaggctgaatatgttctacatctggatggcccaacatcatgatgctgtgatttgcgagaagctctctgcctgcctaggctgctggaggatggcaagttaatttatttgttgttgggagacctccccctgcccccattaaaaaaattattttgaaatacttgtagattcacatgcagtttcaagaaataataaagagtaattccatgcaccattttcctccaatagtaacattttgtgaaactagtacagtatcacagctaggatattgacgttaatatagtaaggatatatgtcatcaccacaaaggtacacctacttcccttctatctctcctctctccttcatgcctggttacaaactaacctgttctctctatataaaattttatcatttaataatgttctgtaaatagactcatagtatgtaaccttttggaactgaagtttttccatcagcataattccttatagattcattcaggttgctgtgtttatcaatagtttgtttctttttattgctgaatggtattctgtggtgtaaatgtactrcattccatgagcatggcatgtccctccatttatttagtttttctttgatttacttcattagcattttgtagtttttgtagtcctgtgtatgttttggtagagttacaccctaagtatttaatttctttgctcattgccagtatatagagatacaacttattgaactcactttttagtttatgctagtttattactaattatcaatacatgctcaagatatgtcaactccttttatttttattaggtgtcacttgctacattttgtggagaataccgatgctgttgctagaaagtgctgctgtcacaaagtgggtttatagatagtaccacgctatccttcttcctaggctagattagaagttatttatgtgctatatgcacatagagtttttgattggtctattgcaaatactatggcatctgaaattttttttttttttttttttttttttttgagatggagtctccctctgttgcccaggctagagtgcaatggcgcagtctcagctcactgcagcctctgcctcccgggttcaagcgattctcctgcctcagcctcccaagtagctgggattgcaggcacccgcaaccacacccgggtaatttttgtatttgtagtggagacagagtttcaccgtgttgaccaggctggtttcaaagtgctgggattacaggcgtgagccaccgtgcccggcccctgaatcctatttttaagtataaaaagtcttttttcagctctggattatggtgctgcaagctgatattcttctcatggcagtaaacagagaagtcctaggggtaatcttacccctctggggagtccaggatatctgagcatctcccttttctttttactgctagaaagaatttctgctagtagaatttttattttggccaactctgaccccttaggttgatgtcagaatgaggtgtaccaacctaggtggtcagagttggctcaaaatacgacattttcctgctgagcaatttagtctaggttaagtcatacttgaccatatgccctagtttagcgtccagtttgtgaacattctttacctgagttattgtaattctaatctcttatgtaaaactgcaggtagtcagccctttgtctccttcagttctacatctgcggattccttcaactacagattaagaatatttggggggaaaaacagtaaaaaaaaattacaatacaacaataaagacaacaaatttaaaaactagtataacaactttttatacagcatttgtattgggtattgtaagctagagatggctgaaagtctatgagacgatgtgcatacgttatatgcaagcgctgccattttattgcagagacttgagcatccaaggattttgtatccgtgggagtcctggaaccaatcccccttggatactgagggatgactgtatttacaacatgtctagattttcgacaacttgaattaaaccagaaagaatatgaacacacagaagttcatgtgtatatatatatgtgtatgtgtttagaagggagcaagctgttaaacatgggaaatagttgctagtagtttgtaattttatgattacaattttaaaattcaattttgcaactggaatttgacttgattggttagtgccttacagtaattaacctccaaatcatcagaatgtcatcttgttatttaggtaattgaatctacttttcttgtatacagaatgctttttggaaacaatacactgtatatctagtttgtaccaagaactaattgtacacagtcagatacttgcagttcttttggacttgagtttctttatccttctatcagatgtcacaattccctcttccctttgtagcatatgaaagtagttgtgtgtgcactgtatttgagaatgtcaagtaatagaatctctagaaaacattcatgatttcagtcccaggtaatccagagttaaaaataatgttcataaggaagggtagcaaaatttagattttaatacttataggaggtgtgttaattggccccagggccgcaggctttakcgttcagaggactttagccccaaaggttttgtggaacttttccagagtcctcaccagtacattgggaataaatggaatgcctttggaagtactttgaagattgaattcgatagtgttggtaaagcagtctagcctgctgtgattgtgctattgatgcaaatattctctagcctgtattatttttccttggagctcaggaagtgatccccacccacctcaagcagtaaaggaaagagaggcaggagggtctgaccatgtgaggtgccccaataaagcatctgtattgtaaatcaggaatgtaggtattgggtttccttaaaacaaagcacacctacgtgaccactagctggagcacaatgtgggctcggtctgctgaaagagtcagttggttgcggctgtctaatccaattatggatggtcccagcgctcagcctttcagctgctgcccctcccctgcagactctgcctctctcaccctcccttttagggcttggtctgtggctaccccagaaatcacgtgcactcctaggcttcagcgagtacagccttgttaatctcagacatggaaagcaagttgcctaggtctacagatgagtattcagtttccccaccagttgacctcagtgcaggttttgttggttccagtcatttggggtcagcacctgtttgaagccaggacacttagaacaaggtggaggaaaacctgagggtacatacagtgtggtttccttggctcatctaatgcagagtcagaatgattagccacattgcaaattgtctttactcagtggtttaattgttaaccagggagttaatttttttttttttattaaacaaagaagaaaacacctctagatttttctgggacagatggccccattgaaagaggccatgtgctgcagcgaatggccaggcctcgggtgtggcaagtgccttccagctcagtgcttgctttgtgctcctttgcctatttgaagacgtggatgaatcaaaatctataagcctatttcagtcaagtattctaaggaacctggaaacacaggggatttctctgttgcctctaatacagtgaaaaaccactgtctttttttgttgttgttgttgcattgggggaagaaagtccaggtttgcatgtacattttcactcataggatttttttttagaatagtttggggaggacattgtgctctggccaataactgggccagtgtctggtcacaagatgatcaggcaggtgcctgcatgactgtaggacagagaactgggcagctagagagcctgtgtggaacgtgaagcctttccccactttgttgccgtcctaaccttttctcaagtcatggagaattgatccttagacattccttacctctctcacccacttgaggattgctcagagcctgggtttcggattgaaatagcactatttctggttgatgacgacattctgtgagccagcaatgtagtttaaatatccacaagagcgccctggttccatcagcgccccttcgtaattggtcatgagacttggacctccttcggggctgggactcgggcaagggagttgagtagagcttctctttctgggctcctgggaaggattcatggcataaaagtgggacttcagcattctctgggcacacctgtctctgtttttgtcctctcctgaatctttctggcctgcagagcagaataaagtcactctgtgccaacctgacttttgttcatgactatattaggggcatggatagaaagtgcccccatagcactctcagataaaacaccttcaaacaaacccagaaacccatgctcacaaaaccacccaccttaaattatgaaactttcaggctgactaaatcctgaaggcgttggagcgtgagcaaagggaaaatggtgacacagagctttgcccttcctaatccaaatgaaaagctctgtaaccctccccccacctttgctatcaagaaatgttggacctttgggaagcagatgtagagtattgatccttaaaacagagacctctcaccctaggtctcttaaaacagagaccttaaaacagagtattgatccttaaaacagagacctctcaccctaggtctcttaaaacagagacctctcaccactttctaactgaagtgggttccacattggaagtactttgcagaaacttctattaccgcaattacttttgcaccaacaaatagtatcctcaactcagaaggaaagaattggaacactcagctggaggtgtctggtagggacatgtgtctgctttttgaatcagtcgtatatgtttttgttcctgtgcctggaggccctttgtggtgtgagaacattgaatttggagagggaaagggagacaaaagagaaatgggggtgatgcttaagggaaagtagggtttttagtttgttcaccacgcttgatggcagatttgcctctggatcctcaggccacgttcctatggtgggtagggatctctctctctctctctctctctgtstgtgtgtgtgtgtgtgtgtgtgtgtgtgtgtaaatagtgatttctctaagttaataaagaatgtggggtgacctcctacacatgcccgtatgctattgtgtaggaacaaatgcatggtaggaatgggtagactctaatctgaaagcatcaagttgtatgcatcttctgcaattaggaatctgctcaccagcacgagtgctgtggtttctgtagttctgggattcagaggagcattttaaagatgtaggatgttggaggaggaggtgcagggatctccccttgggtaaagagtgggagacagtctctgagtcataatctgggaccagtggaaggtcaaagggaagaactgtcctgttgtctgctaagtcacaggcttccttcctgttctctgagccctgtcacttacccaaggtgcagcaacaattagtgtctgtttacacataacagacatctctttcataaaataatttttaaggcatttgtttggtagaagcttccctgtttgggggagtcttttccctgaatgcatgtaaataacttcacagtttgcgcaagtttgcaaacggtctatactgctcagccttgattgggctacccaaggatgcgcccgccctgctgaggtctgacagctctgggaggccagtgaggcctgtcctaatccctgttctggccggtgattcagctccaggtggaggctgtgcagaaacagccccggtcatctttgtgtgaaatacatttgtcgtcttcattttcttttttcttctgctggtatcttcatggttttcagcaaaactgtgtacattacatttttttctttaccatttctccgtagttatttctagcatttttttttcagctgatgaaagcaaatgaagaatttktatgctccatagtcagtcaaacattgatttctctgacttttaacttagaaagtcattttgcagtggcttgcgtgtgtgtatttagactgtgcttctacaaaaaagcacacgtaggcttatggctcagtttacttgttccagctcactttcctgttcatttaccttcttgtaaaatggaaagacaaacataccttaaacttaactcagatcgtgattgccaactttgttctctgtgtgtaagtagttatattattcctaggttatggcatcttgatttatctttgaaagaagaaaaccctcactgagttgacagggacacattgttctaggcttctacaattgtgctgatgacgctttttcccattggaatgacagggatgataaggtcggctggctagcctttttttaaaatgtagaaaaccacaactttaatttatagcatcatcattttccttatgtatgtagtatgtttcaaaaataatccaatgtcagattcttgcttctgtgatcaaggtcttgtttttgccctttctttgctcaccacttccctgcccctgacgccgagtcctcgccttagaggaggtggtcagcttatattgcaacattgaaaatgttataccttacaaagaaggtgatatgccatttcttaattataatgatgtgcaacagtgacttctgatgtagacctttaacattgggccacgcagctttttctttggaggaggggcatttcaaattggatgatgctcttatagtttaataaagaaacaagcaaacaaaataggctatacagggcatgtgttcttaaactctgtgacagtggaggtgaacccaggcccctttcatggccttgggagggtcctcagctttgggggcgagttatctgggtggaaaagcaccatgggaggaagaagtcagagaggcgggttgctggagctcagagaataaaagcaagtctctgccctgaaaatggccctgatttgcttcagatgtactctgtctgccaacatttagtgtctgtgacttagccaaaggaaatgtacattaactgttcagtttctatgtagtttgtgctctaggattttgcctccggaggatttctgtgaaggaagctctgttcaagtggctctgttccacttgggtttggaaagaggccgggacaggtgatttcgaaggaaggatgaggacaatggaggagatgggcttggtcattgcagtgtgtgaggtggcccagcttatctggcattttggggtactatatgtgccatatgaggtgggtatgggtgtttgaagggaaagggggtggcctgggcaacttgtgtccttgcctagaaagatcatcactctttttatttaaaagaaacatgtgaaagagccatcagggatagttttgtcctccctcttcttacaagtgatcattcccttggtagggcagtgccagaccctgcttgtgagcacagaaaacgccataagctcctcatgaaagcatgtctggggaagcttatctcaaatgcagtttgcacttgcaaaggtcctgtggtatagcgggggagcaggggagatggagtctgggagcggtgaaggctgggtcactagctggctttgtagcctctgggcgtgttgtttttatcctcagaggggccactgcacctgctccatggtctcttcccacagcagacccttctgtctctgtgcctcgaggggctatgtggaaagcagagaaagactcaaccagagtcttcccttaaggaaatcggaaggaaaacaaaattaacggcattagaactgagtatgtattaaaacttctactgtcttacaaaatttagttttctttcttatttttctttccatgttgactcagtaggtaaatggactaaacacacattcatttagggcaggaagaacttcatcatttgattacctttagttcatttaccttataatgcctaaaacaaagcagaaagtgacgttggttaatcaaaaagatcactttcttttttgtgttcttttgtgctattgtgagatgcctcttctccagcaagctgtagttgttcacaaagtaaagctgttcctaagccttcattagattgaagcttgtcccagactttctttaaagaagtttgcatagcttagttcatgctcagatgattcagtgatgatgatgggttgttggttagaaattacttaaaaatgcctaatacattattgactgataaatgttaagacatattctttaagggtctaaatcctattcttgtggagctgcaaagatcttgggggtgtggttgcccttgtctgttgcatcatctttcaaatgcaacagctgtaatgatattctgtatcttgaaaaacttaaaaaagcaacaactaacttatttgtatcttttcctctaatatttagtttttacttcacttgtaacttattacatgtattaaggagtttatttttwtatgacattttactcataaaaggatgaaaccaagattggtgatctgttcacatagattaaaatcctgtttgtgaccacttaggtgtgtaatgtgtgacttgtggactgtgtcagaggaagattttccaaccaaaagtacccattggtatcacagatgaaaagtccttataccatctgaaaaaaagtagaaggtggggagaagcttgaaaacctaaggaggccattaggaaaggctgtatattttctgattccgtttaaaattttaagttggtgaaaatactatgtgatcgaaggatgaacatattttagtaaatagagttatagtgctacaatgagataaatttcacaggtaaatgtgacgtagctaatgcataatcattctttgtgttgcatggcaattctgtacaaatrgaaggtagcatgtttaacgtycctgttatttcacataaatacagactgagagtttcagtggtctggtttgaaagggaagaaatagaagaaggaaggagagaagttggcagaggagcaatctgctctaatatcctccagtacacaatctagctataggtcctcacctggcagggtttgaggatcagaatggtggctcaggtttagacaattctccctgtttgtggggcccagcagctagttaagagaaaaatcttttttccttccctattaccctataaggtccccaaattcattgtatgtagaatacttgagtcagaataactttcctaacacttaggtttcaggtttgttaggtatgcctgacagctctcttatcaactcccatttatttgctaatctaaatgaaagtttgatggtagagtattgtaaatgtagggaaggtgaagtgttcaccttcagatggtagctatttatctcagcaagaagagcagatgactaacacccaaatacataaccattattatatracttagcatttataaggcatttctatgcatcctgagagactagagcactctcaaatgaggtttcagagtaagattmatctttgcaaatgaagacaaattagcaaaatcttcctatttttaaagtgtgccttttgatttgatacctatttatttgtttggaaagaagcttttaaaatcaaaaccatgaatctgtggttatcttcaaaggataaattatgrtaggtrgttgttacccaggttaccattttaagatgattatggctggcccaaattaggggatcttttcatatatgtattatatattttaacttcagtcttttaaaaatgaatattcctaggtggcatgggagggtgggaaggtcaaaagcccaaacttctcttacttattggctgcttccttgaacttagcgtttttcttttggaaaagtgagcttttgtttttggatattttgtactgatactctgtgcctacacagattttgttttggttcaataagagttgatattttgccaggggttgcctcccatgagattccaaatacagatgtaagtttaacaggcttctgaactggatgtttctatgcgctgaaactctgtaaacgcgtgtagctttgtctaccattgtatattgctgtattgatttgttgggttgttttttttcttcctcctgaaaagctctggtctgtcctctgctgatacaaagactggtccattccccagggtcactgcaagagaacctccagggcctggccactgttagatattactaatctgtgaagttgctccaaattctcttgccccgatcataaagttccattgagttcaattttatgtgaaggttctttgtcaaaaggaataaatgtttattcaacagatccagttgttgtcagcattgacagatgtgaaaattagcaaatagcaagaagtctcccctttagaaaaggaaaacaagtacttaaaaaaaatcttgtgttgtcaataaacaagtccattttaaaagcatctttgaaggtgtgtaatgaaaatggaggccttaggttgtatcagggtttatgaggagccagcttatmtgtaatcagatgttcctgttactgttatcactgtagtatagggcttagttctgccctttaagtcacagactcaagttactcctgattttaccagcagtcagaatacatttttctttaaaaggaaaagagacgatatccyagtgcttctctatactaaaacaggaagagaagcttccttgttgaagtgacagtttagatgttgttattttgacagaaatattagtaaatatgtcacattatcccttgctaaatatttatagcatagaacgtatactctgatgcataatattttatgaaagaaatatcttttgcctcaaatccctttcactgttttgacatgaatctataatttatacccagaggtctgcaggaaaaagactttattaagacccttttatttcagccaagataaaactccatcctaagagggaacaccctggaatctttgagacccttaaaggtggggtattctgaaatacctgtgttcgttcctttgctagaatttagatagcttcacttttgcaaaaaggcacaaaatgagggcaatttttgatggaaaattttagtttttgagatgaagcagggggcacagtggcgaagcgccctatcttagcacttaggtagcagccgtaacaagtgtcctgggtattcctccctagaaaggaaatgttggtcacaaatggcagtgtcctctgcattcagttcagctatgtgactgaaagacactgttcttcagcagctgtgagtttacaagatgtcgcacattgagtatttttctctagcttatttagaaacgccagtctagacttccgcagttttggattcgtggccatagttttggcctttattagatggccctcaaaggtacttttcaggtggacattgatttcatgccagctgtcagagatgattttccctagaaatggctgggtatatggagacattctgtattagaatggaggtatacacccatctcttctgtattagagagcaggtgttgccccccgtggtgctcagattgcttagtgtgagaaggaaaagaccagtgataagaggaggaaaactgcgccttccatgtagctcagttaacagcatcatgattctccaggatggccccatttctgtttttatttacaaaatggacttgagaattaattagtaagcaaactgtctccattaggtaagtggcattctgatttgtctgtgtaaagttccatttcccaagtaatgtgttccaaagcatttttatgtacaactactggaaactgctgtacaaatgtttgctgctatttggttgtaacaaaatcagtaatgagtttcaaaatggaataatttcagagcccttcatctacagtagtttgggaaacacttgaaataccaagtgatctgaattcactacaagctctccaactggaaaatgtgcctggtgtcgtcttcaagcaagaatcccccgccccttaaccactgctgctgtggacttgagtcttcaaccttgttttgtagactttagcatttgtattgtgtcatccttgacacctccccaaccccagccttcccagctttgattgcttaccttagcaatgctctcagcttggaccagaaggcacggatgtttccctgaccttaacctcactgtgtatcagctcaaggaagaagccagatttgctgatgttgtaagcactaaattatgttcataacatttaaccctcacatccataagcaaactaagtgggaaaataaagattgactattgtagcagtcatagattgtttaggaagcagcaaaaaggcaaatttttctttaaagttcaaaatggggcgaaagagggtaggaaaggaaaagtttattaagaaaattgtatactacattaatttgactttgccgtctagacttaaattaaattcatgtatttttttggtcttaacacattgacatgtatcagtaagttaaaaacttaaaaatacacaaatgattagattagcattattatgtgtttctttcttgttttttgttttgttttgttttgttttgttttgagatggagtctcactctgttgcccaggctggagtgcagtggcatgatctcggctcactgcaagctccgcctcctgggttcatgccattctcctgcctcagcctcccgagcagctgggactgcaggcacccgcaaccacccctggctaattttttttgtatttttagtagagacagggtttcactgtgttagccaggatggtcttgatctcctgacctcgtgatccacctgtctcggcctcccaacgtgctgggattacagtcatgagccactgcgcctattatgtgtttcttatagaaaatctctctaattttttaataagcatgtttttacaaatgctgtttcctgagaactgtcgcaccacatgcgacatgccatgcatgcgactggaacatgccagatatttgtgggtggtcccttcgtgtcacctgtgccttcttaccaagtaatttgaaacacccgtgtaaactacctttggcaaataggatagctaaatcaccgctaagatttataatttactttttggatatctgaaacatcaacartayagccatccatggcgtgttcctctggagtgtggtccgtgccrtctctgcctgctccatctggctgatcccaggcaggcagctcagctctcagcagacacagatccccagcacatatgaacgtgaaagaggcttctccrtgggagcgaagtggccagcaggtgtcacaggctgtgtgggcccagcatcgtgtgggcactgctgggggaatcccatcacagcatgtgctggcgttagtagtagactgtgtgtgtctcagagggtccagaaagtaatacagtaaaggcgcctgggggtgtgtgggggtggttggttggggtttgcttgttagtttgttgtaaaagcccagcttttcattcttggaaagatttcagccaactcgagagggtkacctgccaggaatgctgcagaagcaagaactcagtgggtgagcacttccatttcttcaacaaatgcttctgagtccctgacctgtgccaggtgctcttcttgagctgagaatcctgcagggaraaaagagataaagaccccatagtcctgtggtttaccttctaatgagcatacttttgtcgatcaaacagggtgacctctctggtgtctctgcacactacctgtatggtctttscgtagctgatggggtctcctgactagtgattggtgattttaatctggattttgccacagcacttattttctaacatatgacttaatttacttaataattgtgtctattgaatgtattcttatacatacacacaggcatgcacacacggacacgaatataagctttacaaggacagaaaccttatyttttatttatttcttccttgtgtatcctgagcactgagaacagcctggcacaaagcagggctcaggaaatgtttgctgaatgcatgttcacactggatgtgttcgaaggctctcactcgcgactcctgttggcttgtggagagtgcatctagctgtaaaagccatggtgcttggatgtcttggggtgctgagcctgttcccccctcatttgggggtgtggtgctatgctggcgtttgggtccatgccccgcatttctgatggctgccccatctgcyctgtgtggggtggcagagttctgtgtacacagagttacatttcgttgttcctggcttctctatggatgacagcagcactgataaatgccacacctgctttctcagcagtcttgcggggtgatttttcctcttaaggaagtcacctgatgtccatgctgagtaggaaatgcatccaaagctttgggagctcagtgttggcccctgggctgcagcccgagccccgttttagagctgtgtctcccaggcagctgtgatgactgctcgaaagcccactcagggggaaggtaaacctgatgcccgggtgtttggacagtgagcatggcgagtggaccgttacctgtgcatagagttgttcatatgtggtgacagatgttgggctgttatttagtaacttcaaattgtttttctttgcgtcggagccatgtctaggttctgagtgcttctcccaggtcagatggagagctcttcatttggggttgggggagcggggtggtgttttcaggtgcccaaggcattccatgcacatgcacctgcagggtatgtgtcatctggggtaagacagagccctcccggttcctcttctggatgtgtgcttttagtttttaaagaatgtcagtatatacattgccatttattcaacaaatacggactgagcattctgttgtgctgacgtagctacttggggttacagagacaaagccaactccattctccaaatggaaaacaaatggaaacattctagtggtagaaacagacaacaaacaagtagacagaaaataatgtcagacagtggtaagtgctatgaaaaaaatacagactcactgattgtgatggagacttttaagttggattctcatagaaggcctttctgaagaggggacatttgccctgccactgtgaatcagccatgagaagacgtggagaggaacatgaggtggtaggccccagcgagggaaagatctccatgatggcatcgattattcgctccacaaatattattgagcacctgctgtgtgccaggcactgttcctggtgtcagggttatagaagtggacaaaatgaggcctctgcctctgtggagcttttattaaagtagggaaggggatgggagggctgggtcacatgttaggtgtggggtacagggtacgtggtgccaggcaggtatccgggtacctttttacgtagggtattcagagaaggtctctagagaggtgacatttggacgaagacctaaaggaaagggargggaaaggcgaggagcttggagagcttggtgcatcttggtgggggatggggtaaactgagtcagttatgtagggccctggaggccacggtgaggacttcggctttgactctgaaaggagatggcagagtttggagctggtgtgtacgttaacaggaccatgctggcagctgcgttaagagagactgtaagggcaaggacagaagtagagagaccagtaggagtaggctgttgccccagtgtagggcagagaagatgaaccttagaccaggatggtggagatggtcagtggagagaagtagtcagagtctggaagcaccagcaagactgtctggtgcacacaggatgcacgtgggatgtccagtgaggaggatgagatgaggttgggtggctggagcctggtgagtgacaggcagagagggctattagatcacatgggccctggagccatggtgaagaatttggattttgttctctgtgttggaaagttagcagagagcttatatggggggtgagatggcatagggacaatgttaataacagcaacgaatatttattgagcacttactgtgtaccagctgttgcaacagcctctcaagggttcgttctgctattagagccatgttataaatgaagaaactgaggcacagagaggttagctaacttgtccaagatcacacagttagggacaaacttgacagaattatgtgtgtcctggtatgtatttcagttttctttagggaaggtaccacaactttgggtaactatgcccctaccccaggatttaagatgttttgatggttgaagggcgatgtttaagagtgggaccagagaatattgaggtattaaaatctcactaaatctgtattcattatatctgtattcatggtataattcatgtgcctccccctttcgtgagcccctcaaacatgatcatggatatgttttctccacccgtaaagtacgttcatattcatagaaaacccacagagaactgcagacctgaaggtttctttgtaagagctttcattggatagctagaagggctgcagtaagtttaaaaaaaaaaaacccaaaccaccctggattccaggctgcacagcctctaggaggtgtgggtaatccctttataaagcttggcataatttctgttaagacttgcttattttgctctcagcttgctatcttgatatgtttgcctttgaggaggttagagttattgtgatttaatcacagaccatgtatttcgcaagattcatttggtatctccagcttgttttcttgtttcctcggctgtcagtccacaggcagaggtgggaggcggccggcatgggggaccgagtgtggtagaaaggagtgtttacttagcggaggggagtgctgagggctgctgttaccttcccagaatggctgatccccagcagtgatgagcaggctgggatcgtggtgttaaatttggtattttctagaaatatatagcaggctttcccctccacctgccccccttcaaggtttcgaagccttgtgttttgcaagagttgagaggggaacagttaatagcttggattatcttgtctctggagagaatttatgtatcaattcaccggaagactgctctggtattagggcaacaagaatggttttatttctcccttcctttcctgcactctgttcttatgtaattcttgtattaaaaccattcctggtaaattagaacatgctcttgtatttgggccctgctttgaagaaggctgctgagtctaaaaagtttggtagcctctcgtttctcatggtgatttctgagatttctagggacttggtgttttacagagcttgttgagttgcacaaaccagcctccttggcccttctaggtgataaaagatgctgggctgggagggcagctgtggaaaagggtgtgggcgagggagacagtgcttcatcctgcctggatgaagcatgttggttgttggtttattcataaattagaaaaatatattaagaattgaagttgttccttatctcataagatttctagcaggctgcataaagtctgtagatggtaatatccatttaaaagtggacaatgaaaaaattacctctttgggagttgtgttgctatctctaccccaatttggcaatctttaattaacttggcaacccccgttttaccaacaaagaacaacctttgattaaaaaaaaataaaatgtcagggagtgaaagatacggagtgtgactcagcagatgggaattcctttaataacacgctgggtgttagcgttagaaccgccactgaacagctctgcaggatgccctcccagccctccctccgcctatttggattagaccaggagactgcagcaaacttctcaaggggaggcgaacttggtgttggtatctgagcgattgtctgtttcaattgtttccctctgtcttggaaaacaccggcacaaaacacaaatccagtcccagttcctgcagctgctggggcgaagcaggctttttatgaatgaggcccagaagggggaggagagggcttgtgttacagcagcagttgggtaatacatttcattcacttgcagccatctagcccaggcttcattttaaaggatattgttcatttttggcaattcagattagactttttttcttccttgtgcaactgttggtaagttagaacacgaagcatgtgtgtgcattctttttgcttgcttttttgagtgtttgctcctttagttgggataaatggtaggagaggtaggaaggctttgtcatccccggggaccttgcttacttctccctcccagcaccacttaagagaagaggaggtggcctccctctccccaacctcagagccctcaaagcccttgatagtgagcctgagcacttgttaggaggtgacttctacctggggtgtgctggggtccacatgtgccagtctctctgccctgctccccgtgagcggctctttatttgtggcccttgaggccccattgttgtggccaccaaaacctgaattggaagctgtgtgacaatgctggtccccctccctgcactgcttcctgctgggggcagaacaaagagagcgggcattgtctctggcataaatgaacctctatcaaaacaaacacccagagagaggggcagcctgrttacagctgcctgtgtgagcctcgacagtgggcctcattcctcacaaagggagctttgaggcccggaagaggcctttccttgatgatcgagctgtgcacagggagcaaaccccaagccgactgcttgtctgtgccaccctcaaacaatgatttccccaaattggacagcctgggtttgtatccttgagcacrgttttgggaagagcattctgcatgaggcattgtagctatgtrtatggagtataattctgttttcaggttgctctgccacagaggttaagaactccctcttccaaggtagacattgagaacagagacgaccacactgggttttcactgcagcttttaaacaggatgactcccagcccccatccccgtggctagcagcaagcagggactctgaaacactgcaagccaatggactgagcatcttacttttgctgtccgtgttttggtgttttgtaaacccatctggtaatgaccctgatgccccatgtcccagcaagggcataggtacctgccattgtgcaccaaagtccctttcctcatggccctggctgttctcctgcatggggtcatgtgtgtcccgttaccaagttrtggccccttttcaaccttgagtgccacatctgggctgttgtaggcatgggtagtacaagctgggtttgttactctaaaaatgaaagggaggatcagttgttaataccttcctgtaggtgcgagagggaatgagttgaggattcgatcactgtttatagccagtctcggatcctgattgtgaagtcattctttctggataataactactatatccagcatcttgagagtataaaataaaggcacatgttgtacgtcatctctgagatgtagcgatggcttggactttggaggctgatgagagaaaactcatggtggtgagctggagcagggtgtggctggcggattctgaaggtgctagccctagttttacagctgaccagggaaggtcattgaaccctacagtcttggccctgagagaaccttggaggacttaaggatggagaaaggtgacaaaagagatgcaagccaacagcaattttgtggaacaaagtgtgtacaggatttgaacttaactctgcgaaagacaggggttgcttgtatgcacgaattcacatctgaagaatgcatctgattgtggctgcaatttctgtggacgtgcaaacatctacctgtgcattttatttgtctagcatcattgaaagagttttttgcttgagttgatttcccaggtaattgaagcttacttctcaaagcacaagatattttttctcatatattarcggtcttaagtgagtgagacccctaagaattcttaattcctttatcttacttttcctacaggaaacttattatgttttcctagataggaattgtgctaccaaaaatgaaaagtaaacgtaatatgtaatgttctactggtaattgtttccattttaggttgacaccgaactaatgatatttaaattgtagctgacttgaaacacagtgaaaaaatggtttcctgctgtttttttaaagctggattcagtaacatgaaggtaattaaaaatgtacagatctcagtaatagacagtcatatgttgcttaatgacagggatatgttctgagaaatgcattgttaggtaattggattttatcattatgccagcatcatacagcgtactttcacaaacttagttgatacagcctactacacacctagggtccatggtatagcctgttgctcgtaggctgcaaacccgtggagcatgttgctgttctgaacgctgtaggcaatggtaacacagtggtaagtatttctgaatctaagcatagataaggtgcagtaaaaaatatagtgtaaaagataaaaaaatggtacacctgtatagggcacttactaggagtcaggcttgcaggaccagaagttgctctgggtgagtcagtgagtcagtggtgagtaattgtgaaggcctggataaatactgtacacttaggctacacttagtgaatattacattttatttatttatttatttatttatttatttatttatttatttatgagatagggtcttgctctgtcccccaggctggagtgcagtggtgcaatcacagctcactgcagcctcgaccgccaaggctcaagcgatcctcttacctcagcctcctgagtagccgggactagacgcacacaccaccatgcctgactaatttttgtgtttgtagtagggatgaggtttcaccatgttgcccaggctgatctcaaactcctgaccttaagtgatccacccgcctcggcctcccaaagcactgggattacaggcatgagccacggcgcctggccacagttaacttttttaataagtagaaggtgtacactcttaaataactataaaaagtatagtaaatacataaaccaataacatagtcacttattatcattatcacatattatgtactgtgcactgttgtacgtgctgtacttttatacagctggcagcacgggtttgtttgcaccagcatccccacaaacatatgaggaacatgtacatcttaccacggttgcaatgtcactaggcaataggaattttctagctatattctatccttacaggaccactatcgtatatgcacttcatctttgaaacgctgttagctgcctcatgactgtatttctattcctcagtcatgggctcaccatgcagtacacatgtgtggtcactggagggaatggaagaacactgaggaaatgcatagcctgtttcatatatttattacactattatttatttagaggaatgttaagaaatcttgcttttatgtagttttagaatgccatgaaatatctagttggggcattatctgccattttgcaaggtaatcttccacttctgaataacgttacaagtaacccgcgtttggaggactgatttgggactaaggcaaggaatttaggaggcacaagtagaggggaagaaataaacacatgacttttgtttttgtttttgtttttgttttttgaaagaaggacagtggtttgcttgttgattctgctttgagaggatggggatgcactccagagaaagtgaaacggggctatgggaggaagagagcagcgcacacacagcacctgcatttgattgtgaatgcgattgtgactccttaggcaggaaggagagtgctaagaccgtcatcatggacactcagaaaatacctgctaatccgtttactggaagatacagggagctgcagataattattgttttttaagatggagtttcgctggagtgcaattgtgcaatctcggctcactgcaacctccacatccccagttcaagcaattctgcctcagcctcccgagtagctggaactgcaggcgtgcaccaccacgcctggctaattttttgaatttttagtagagacagggtttcaccatgttggccaggctggtcttgaactcctgacctcaggtgatcctcctgccttggcctcccaaagtgctgggattacaggcatgagccgccactcccggccgctgcagagaatttttaaaataaatgatagattctcacagataagaagaacaggataattatttgccaaagtttgaaactgccattatattcaaaggcattctcttttgggagtggttttatatttaaggtttgaatttagatgacctcaatcttgaggtgttatcggagcattacaggggagtcttatatacatgcaggtgcgatttaatttgaagatacttccatttaaactttatgctgccagagttggccagctaagcaaaaagaattctgataggtcttattctcctccccatcccacacgctgattttttttttctttgtgtttggccgaaacattttacatttctcatttttcacagagctactgtttctctaggattgttttccctgaagtgtgtaccctgtgtttgggcagagcagcaagaccagacttccaaatggcatgctgcgttttaatgtgctttcataattgtctgttccaaaagggtgcctgtgtgtgtatggtgtgtgtgtgtgtgtgtgattcagagcacctgagagcacactgcccgttgtcccctccagcccttctgaaatgcaggccaccctttctgtttcagttgccccttgggtggcagtctgtgataactcaaggtcaggaggaagtatttgttttggttgtcttgtttaactaattaaatctttaatcttggtccttaaaagaaactaaaataaaatcgtaaagtagttctgataagtccttgccataaattattgcttttgtaaacgcacataaaggactctgaactgttgctactcataacatttctgacgccaaatgtgtggggttttgccataccaacaaccagttctctaactctccagacaccaactgggggccttacaattcagtgcagttctgacactcaccacctggagttagcacagactccacagggatgagggttcagtcccacgagtctgcccttgctgcagatgcgagtagcaggtatggggtgcccacacttctgtctgacttgcctgaaaggttgagagtttgttgccaggccccttgctttcaggtctgataacttgctaggttattaaacctgaaacttgataacttctgtagatgttgaaattagaacggcctcactcacctgggctcacaaaattccagaaagtagttgacgtcctattactggtttaccgtgaaggctctatgtccagagtggacaggacaagtggaagagtggcacagggcgaggtgtggggggtggcgtggagctccttttcaggagtctctaagaaggtgggactccagcggcaatgccttgtccatgtgctaagccagccgagggcgcacgaagtgctgtgtggtgtccaagctgacttgggagggacmagtttggggccagccccccagcctcmcttgtcatgtcccacctctgctggcatctgtgggcttaaagtgccttcactcccatccttttcaactatttcttgattaaaaaaaaaaaacaaaaaactgttgaatagtaggagactctctctctcattggtatttgtgggaataaatattaaataaacactttctaataggtgttaccaggacgcctaaggaaattatctcacagagttttcaacactgtgaaaagagaagctgactgccagggagagatccctttttcctagtccttgtgaacatgtgctggacagccaggagtggcactgtggcaagaaacacccgttctctggcattagtaagagggatatagccaagggtatctgtataccagtgttaggcccatacatccataaaacattgatgtgagagctttagggcacagctgaccctaagcctaacgtgatcattaatgtcatgaaaattggagaattggtcaggcgcggtggctcacacctgtaatcccagcacgttgggaggccgaggtggatagatcacttgaggtcaggagttcaagaccaacctgggcaacatggtgaaaccccgtctcaaaagaaaaaaaagaaaagaaaattggagaatttataacgtctgatgtgacctgttctttaggtgttgaaattagaacggcctcactcacctgggacattcttcagctcaygccctgtacctggcttacagttgctcagtgaaatgctttcttgattgtagcatggtgggatttttataaatccaaatgacttagaggtaggtgtcacatttttagcagctaaaatcatactaatcgtaaagctcagattcctgtaagtagggcgctgagcacaggctgcatcctggatatatgaatagatgaaccagatcgtgtacatgtgggacacgttctttgtcctttgggactttcttttgcttggatgttggtagtaaccatgtaagttcgggcagctttctagaaactttccttgttgtgcaacattatgcaataaatgcactgctttgtgatatctgagacgttttggttttcttcagcttgtttgagttaaatttagactcctggcatagttttaggtttgaatgcattctctgagataggataaggaccaaaacatccactcagcagccagatgggattttatccttgtgctgccatttttgagactcatgcctctgtttcactctctgtaagatggcattaatagtgagggattgttgtgctgtgaggtttaaatgagctaatccctgtgaggagtttacagcagggcctgggccatagtgaaacactgtgtatgtggaagccacttcacttttgtcatagctttgttgtcattagtgtataccctgtctccttgccgtttatgggtccttctttcaagcagtcggattttctgtctgacatagtataagtttagaggaaacaatagcagctgtaagataatagtaattttccttctgaaatcattttggtgaatttagtcagaatatctgatccataaactctcattataaaacattgccttatgattggagttttttctgagaacagttccaatgaacatgattttttggtggtgaggtactatttctgtgcagtaatgaagttgtgaggacacacagataccacatccatgttgtttgggaattgtttgggaaaggtacgtgggatagcctggcatggggaagaatgatgttagggtattctccttgaggagctcagaataaccaaaggtaaagcatttggtggtataagatatattcatcttaaaaataagttgaaaataataagataytgggagatgttagccaccgaagtaaataactacagtgaaatagctctttattaattttgaaacctaaagttgaaagagttccgtattatttgtcagtatctttatcctcttcaaaaatgtttccagctttgggataaattgtgaataattgtttcactttgttttttaatattggctatgtagtgattttgcattgaactgtgatataagaatgatcatcagccccttgagattactgtgtgtacctgtgtcaccagtggcatataggggcttaaaagcaagcaagtttaatatatacattcattgagaacacactgtagactgttaggattttcggtgctggagccatagtgatgaatatgacaaggccctcacccttgaggtgcctatagtcgtgtggaacctaggtcctcgcagggactctagggcaggtatgttcttgaaagatttttttttttttttttctttttgaagagacagggtcttgccttattgcctacactggagtgcagtggtgcggtcatagcccactgcaagctcaaagtcctgggctcaagaaatcgtcctgtctcagcctcccgagtagctaggactacaggtgtgcaccaccatgtctggctaatttttatttgtattttatttttatagagacagagtcttactctattgcccaggctgatcttgaactcctatctcaagtgatcctcctgcctcagcctcccaaagtgctgggattacaggcatgagccactgtgccctatgtaaaagattcttatcaacagttaaaataagaagctgctcaagacatttacctatcctgaatgtttcaggccctcaaggtgccaggtagctgcaatatagttctagtgtagaaaagaaaaccctgaygaggtctatatattccaggactctgtctgaggccctttgacactccgggggcaccctgccgtgaccctgactctttcctgcatgtactgaggatggaggtagcctatgggtggcacagagatttgctgtctggctagcagtacttcagggtactgggtggcttgaggacctcctgttagaagcttggattcacttttcccaaggcaaccasgattggattctattagttctgggtcttgagagcctgcaagggcttccttctgcgaaggtgagtctgggagagacgccatggagtcagtgtgagttctgcagcctcccaagttccgctggcgtgagaggcttgcctggtgccagggctctggrcattgggaacattgcctggtctaccgggcaagaaacgtgaaccaccgcagtgaactggcagcgcgttggcatttttccctccatgtttttataaaaccgctgagtagacaccagattataaatcctgtgtaaatagtcttgaagagtttctgggttcagccccagagaagactggtttgggttttgaggaatacttcaagaaaatgtttgttggttctgttttccaacgtaaagtgctgcacaaggactgtgctgtgagatccaggagtgtcttttcagccctcagtgagtgcctgcaggggacacagctgctttggaggaatgtggttccggagggtttcccactctccatcctagttgctaaagtcacgttccacgtattgtgttctgatgatagaatgaaagcccactccccgcaccctggggtctaggtggggaaaggagaggtgtatatgggatagccacggggtttggcatgagctcagtagagacagcaaactgacccagacagactcccgctttagggaagctgggatgaactaagtgaaggtgggtcatgggagcaatgctgaaccactttggtggttacagtgaaggctgctacacacccagctttgggaggtggggcccagggtgtccagctttgtagaaaggcatggtgtgggggtggctggcggagggggtggtgggtggttttcctcttgaatctctgagaaccttgactggtgtactgctctctgctttcctaaggggtccgtagctgtgctggtggtttgcttggtatctgtattacatccactctgtgcttcagcctgtttgtccagttactgtgtctagtgaagctagcattcacatattttagattaaattccacactccacccccaaattaaaaccctgctatttaaggtaaaaataattttaaaatgttttattttggtctctttggataaattaatcttgaggaaagcaatacttactgaatgttgatgtgtgtatatgtctttctctttgtaccatacttaacaggcaagtaactctcttgtaaaatcagattctaaatgattttcttttcttttcttttttttttttttttgagacggagtctctgtagcccaggctggagtgcggtggcgcgatctctgctcactgcaggctccgcctcccggcttcacgccattcttctgcctcaacctcccaagtagctgggactacaggcgcccgccaccacgcccggcttatttttcgtatttttagtagagacggggtttcaccgtgttagccaggatggtcttgatctcctgacctcgtgatccgcccgcctcggcctcccaaagggctgggattacaggcgtgagccaccacgcccagcctctaaatgattttcttaagtgtaattcaggagttggcaaactacagcccatgctgccacatctggcctgccacacctgttgttgcacataaagtttcattgagtcacagtcatactcatttgctttcatattgtctgtagacaacctagaatgttagaaaattctttctctggctggacgcggtggctcacgcctgtaatcccagcactttgagaggctgaggcggccggatcacctgaggtcaggagttcgaaaccagcctgaccaacatggagaaaccccatctctactaaaaatacaaaaattaaccagatgtggtggcacatgcctataataccagctactcgagaggctgaggcaggagaatcacttgaacccaggagttggaggttgcggtgagccatggctcatgcatgtaatccttgcactttgggaggctgagacgggcagatcacaaggtcaggagatcgagaccatcctggctaacacggtgaaaccccgtctccactaaaaatacaaaaaaaaaaaaaaaattagccaggcgtggttgcgggcgcctgtagtcccagctgctcgggaggctgaggcaggagaatggcttgaacccaggaggcagagcttgcagtgagccgagatcacgccactgcactccagcctgggtgacagascgaaactccatctcaaaaaaaaaaaaaaagttatttctctatgtaaacaaagaaaactctccttccttataacttgtatgtgttgggtctatttgtattctgtgaaccataagaaataagtcaactatcagctgggcgtggtggctgacgcctgtaatcccagcactttgggaggccgaggcgggcggatcacgaggtcaggagatccagaccatcctggctaacacggtgaaaccccgtgtccactaaaaatacagaaaattctctgggcgtgttggcgggcgcctgtagtcccagctactccggaggctgaggcaggagaatggcatgagcccgggaggcggagcttgcagtgagagatcgcgccactgcagtccagcctgggtgacagagccagactctgtctcaaaaaaaataagtcaactatctcaaggtaattacccttttgaatacttgaggacatcttttctgtgccctctgaatatttccttccccagataaaatatttctagttcttttacytgttctttgtttcagrgttttaagtctccatttgataaagtatagtttaatagccttcgaaaccacatcgttgagatttaaaaagccctccttgagagacatgaccagtagaaatcataccaggaccgtttagcaccctaactctgggagccatggctcttgggatgcggctgaagattgtgttatcgtcctgaagctctcttggacagctgagtcaatgactggaggtaggaaagttccttgaactctttcttgtgcccttccagctgtgagctgtgtcaccattgtattatttttacattgttgttgttcttgaaaaagcttttttttttttttcaaggcagagtcttactctgtcgcccaggctagagtacaatggtgcgatctcagttcactgcaatctccgcctcctggtttcaagcatttgtcctgtctcagcctccccagtagctgggattacagacgcctgccaccatgcccggctaatttttttaatttttagtagagatggggttttgccatattggccaggctggtctcaaactgctgacctcaggtgatcctcccacctcagcctcccaaagtgctgggattacaggcgtgaaccaccgkgcccggccaaaaaagcttttgaaaacttcgtcgtataatattatggccatccttccaaacgtgacctttttatgttgtattttatctaactaatttgcccttgcccccaacttttatcttggaatttcttacgtattaatatactgtcagggtccctgcttggggcattgtccttgggcttgtcattagataactccaagttggcttgactccagaggagctgccttcacacgtgctgtgaaatgtactgttgttgaccagagaccatcgttatcattaagtccacaaacctgcttcctgtctcttaggctgttccagtcttctatcgaaaaacagtggtttaagtggcttctccgatagtgctggtgaattggaagcttctcgtcatcccccttggctggggcgaggcttacttcctggggccttggcagttttgatctaactgacttatgttacctttctgtattaatcaagcctttttattttccatacttctgatgctttgacatcttggggccttgctgaccctgaagagaccagcccccctagggttagccagttcctaggtagtgaatgagtacaatgctcatatgcaaaataaccaatccaaaggccacgcccctcactcatatgcaaaataaccaatccaaaggccaggccycttaccacctttattgggatttcatactccaggccaatattgccctaccttaatcaccctagggccagataccaggcaagagacagcccctacaccccagagcctgtcagaattactccagccagctagtcctaaacctgcttaccttgtgtgatttattccttcccaaggaaaccacaataaaggctctcctccatgttttcctaccattccctctgcctcaggaccaaccttggttcttctccgtgtggccccttggcatggtgcactacctcttcttggggactgtgagtaacagactttttcagtggcaattgtcttttaactgttggcctcaccgtacctgaatagcagtaaaccctacatcttaaaatactttgagattgtcacatacagtacccagaataggtgaggatgaaggcaatttactggatgcagagcggccccagtccattccttatgtccgaatgctaagacttgagaaaggtggagaggagcctgactatcaagagttgccttcttggatgaagtgggctgaagacacacgaaccccttccattaatacatctacatattttccaccattgtaattgtattaataattggagaaaataacaatgactgtcaacaacaatagcttaatccagtagagatgaggtccggaataggttctggcctacctcagttcatgttttttactttcaatgctgaagcacaagcaaatgcaaaagcttctcttgaatgttttgtaaattgtgggataattgaggtatgtgacatggttaataacccagtgtctgctcattgagcactgggttattaaccatacatagcaaatggagcacatcatcgtgggttgcttgcgtcactagatcctgttgcaaaaccaagattcaactttaaaatacattttaatttaagttactctttctggcatgaatgatacatcactttggagcaacacttaccaggcagtgaaagctttttttaatgccctgtgtagcactgctttcggtgcccttatatgatttggatggatggatggatggatggatatagccacagggtcttgctctgttgcccaggctggagtgcagtggcaccatcatagctcactgcaacctcaaactcctgggcttaagcgatcctcaacctcctgagtagctgggactactacaggtatgtgccactatgcccagctaatttttaaattttttgtagagatgggggtctcaccgtgttgccggggttagtctcagacttctggcctcaagtgatcctcccaccttggccttccaaagtgctgggattacacgtgtgagccactgtgcccagcctgtttatatggttttaaaaacaaaaatgtatatgctctcaagatggctttcagagagcttattagtgtcttggccatttggaattccatttcacttaaattagaagagtgaaagagaaatgaatggaagaccaaaaatggggagaagaaaytgtatctgatataagcgtggctctacctgggagaatggccattccgaattactggaaacaggaagaagacttgctatgatgcttccttatatctgtgggggaaaatcaaacttacattctgaaaggaaacttaatacttcatgtttttaaacacaaaaggatattttttcagagtagcagttataaagttgttagtttaatcttttagttcagctttttttcttaccagaaaaataattagtagtacaaaaatttatgcgtttgttttagctctattctgatactgttaagaagatacatgacataaaaacaggaatattttcagtcagtgattacaatttaaaatcatattcgaaatttaataaaaagtttaaaagaaatcaccagcataagatgttgtcatttggctcttggggcaaaccagctctcttctggtgaaagaactttctggatgaggtcgaaaggcaacagaaaacctggggaacaatggctgtctttttaatgggagttgctcctattcctggtggtaacaacctcttcctgttgctcctttccgaatggaattgcctcagtgaagttgttgaagaagtgaggagggcgaaatatgcccatccttctacagtggggagaggcctggcgcatgaaagcaggcctttgtgtatgccgggctgggcccatgcaaacagggcacaatcaggctattgtttgtttgggaaaagctatggcatcctattgcaattatttatggaagaaaatatttgatgtttttggaagaggttaggtgtggggggtgatgagggagggaggaaagagactgggcttacctcttgtcccattcactccaaatctctcagtgcgtaggatagggtccatctggtccaaaggagagttttgtgtgactctgtgtgttggagtgttttcgaaatgcagagaaattcagagcttctctagctttggctagagaaggaacaatggaagtgagtcttattctacctaagtttgatgtggggcagcctgttctgtagttgccttccaagcccttcttctttctgatgctttcttggtaccattgcccacatgctgcctccaccctggatgaggtctagacctgttacattgattctcaactaattaaaagtcaatatggtaaaatatttgcagcattccttctccttccctgtgttcatttctgaagctcaacagtcttccatactcaagctgtggggaggtccctttctcctttgacaccagccattttgtgatctgccctttcaggccaccccagccaccctactttcccagtcttgcctctgcctacttcacctcttctctcgaacctcagaagcttctggagtcttcacagtggccctaatcatgggtctcatccttgttttcctgtctctttgaggttccagcagccagctttgcctcatcaggcctttctctgaaattcccatcaataactacaagatctgcccagtaccttgtgcatatcaggtctcaggaaattgtgagtttcttgtttcattaarcatttttctttccaggaatcatcattcatcgcattgccatatgtgtccagatcccccttttcagggagccagtaattcgaaagcacttgcctgtgttgaatatggtggaaaaaacaaatgtcaaccctagccggccatcactccccatcggcccaccccattctcttgtgccagtaggacttgcctgtgttttctttgggcagttcaaagttgggctcttgagaagttgcctgtaaattcaattgaagtgaccagatctcatccttacccactctgtagctgcagataataaacactggggacttcccttgtgcctgtgttttaatgtaaccttaagacttgatgctccctggagtgtaagaatatgaatagctactcgctgtggatattgcagttaattactccttcctgtcccatgtggtccccagaggaatatgagattgccacaaacatggcagctttctttggggaggtgggagagggagatgaatcttggggcaaggcacattctcataaccatgtggctccagaaagctgcctgactcagagaatggctataaatgcccggttgtatggatctgagatcctcaaagccaggttcattcacttatttattaatttaacaaacattaggcagctgtggtgctctgtctgctccagcagtgatcaagacagaaaagatttcttcaatgctgcgtgtggtggctcacacctgtaatcccagcactttgggaggccaagacaggcggatcacctgaggtcaggagttcaagaacagcctggccaacatggtgaaaccccgtctctactaaaaatacaaaattagctgggtgtggtggcccatgcttgtaatcccagctactcgggagtctgaagcaggagaatggcttgaacccgggaggcagaggttgcagtgagtggagatcatgccactgcactccagactgggcagcagagcgagaatctgtctcaaaaataataataataataataataataataataataatagtaagaatactggggtggggatggtaggatgcacagtaaagagaataataagctagtgatgagcatctaagaagaaaacacaaaacagtactgtcatcacaatgcaggagtgctgggttgggggccaggtgtggttgaggggtgctgtattacgctgggtagtcattgaggcctctgtgaaaaggtggcatttagactaagggagattggaaggtccagccatgggaagttcaggagaaaggataagaagaaaaagctgtcacatgggcacagactgatgaccagcaaggctggaacttggaagatgagggaaactgagagtgattgtcagctcaggctgctttgacaaattactgtagcctgggtggcttaaacaatagacattgcagcattccctctccctctctgtgttcatttctgaagttgaatagtcttccatactcaagctctggggagatccctttctcctttcacaccagacatttcgtgatttgccctttctgaccaccccagccctactttcccagtcttgcctctgcctacttcacctcttctctccagcgtcatggttggagaagcatattctcatggttctggatgctgaaagtccaaggtcaggtgtcaacaaggtctggttctagtgagggctctcttcctggtttgcaaacagctaccttctcactgtatcctcatatagtggtgggagagagcaagctgtggtgtctcttcactgattaaggacattaatccaattgtatcagggtctcacccttatgacctcatttgatcttaattgtctccttaacagccctaccttcaacagagtcacatgaggggttagggttcctacatatgaattggcagggtggaggtgggaggtggccggggrtgagacacaattgatttcatagcgtcgagttataagatgggtcacagtattagatgggaccagagcagagagggtctgtaggccatggcaagagtgagaatttactcaatacacagtggaagttggggatgagtgagaagcacaagagtggcacactgatttctacaacagtcagtctagctgctgggtggagaaggggagaaggaggaatagtggaaaaagcagggagaccgcttaggaagctgctgggaccgtgcatatgagagatgttggtggcttgaaccagtgctgggtttctcagcattggcagtattgacgttttgggtgarataattagttggggagtggcagggcggggggtaggggtgcagtcctgaaccagtgccaggtttctcagcattggcactgttggcattttgggtgagawaattagttgtggggggctgtcctgtgtattgcaaaatgttcagcagcttcactagtctctacctgctagatgccagaagcccacccaccccgccccctagtcatgacaatcaaaaatgtatctagacattgacagatgttaacctgggattagggggtggggagaccaaaattgtaccctgttgagaaccactggaccagagtcatagcaatttgyagtggatagatttaggaatatttgaagacttgtaaaatatagcctgaagggaatggagactgggagagtgaaagatacctctgagacattttggcttggacagaacagggggtggaggcttccattcctgagctgcaaaggagtggggagggaggagcagtgtagtttgggaagtgtgtggtggagaaggcagatggggcaggagctctgtcttgcatctctcaggtcagaaatgcctcagacatccagggggggcaagctaagatggagttgaacacagcagtgtagggctcaggggacaggccaggaatggagagaaacatttggcactcatctacttgtagcttccctgtcgagaaaaatgaaatcatccaggggttttcaaattcagtggtctctggaccccttcacactgttaaaaatggaaaaccctgccactgtctacatgtttatgttgccccagtaatctatgcattgaaacctaatcaccatgtgatgatattaggagctggggcctttaggaagggattaaatcgtgagggtgggggacctttatgaatgagattgtgcctttataaaagagagctgctttgcctcttctgctagaaggtgccctccgtgaaccagaaagtggagccctcacaagacactgaatctgccagtgccttgatcttggacttcccagactctagaactgtaaggaataagtttctgttgtttaaaagctacctagtttaaggtgttttgttataggtgcccagacaggctaggacaaacgccaataagctttcgtttatgtgggttgtatccattgatacttgctgtatgaagaattaaaattaataactttaaaaagatttattgattcagaaacagtaacaaaacttaatatgcgttaacgtacttttatgttggataaaaactatatcccaccccagtatatgaatagagtggcattgttttatgtgtttaatctctggcttaacagaaggcaattggatgatcatacctgcttctatgtttattctgctgccaatatcacacagcttctggaaacttccacggcacacattcatgagacaataagagttaaaaaggtaaacagtgtcttagtagtgtatgaaaatagtttaatctcatagaccccctgaaaaagctgcagaatccttacgcgttcacaaaccacactttgagaactaaagatcaaggagtacagttttctcatttttatgctgttcagagtgtggttgaagttcagccatcactagtccttcacggatagttcataccccaagttgatggccttgtggaattgctgaygctattttcatatatatatatatataattctagcctttttctctggtcttataagagtcacatacgtaggtaatttcatatcctacaaatatgttctaaacagcagaatattccaggaaaccttaagtgataactgagttgaaagagtcatattttttaagcaatacaatttaaataatttttaaaggaaacatttmtaaaggacgttttacattgcttgcattaaaaagaatataatgaacataatccaactttttstcaatactcagggtcatcactgtgaaagtaacttcattctatgataagataatgatgctcccaggtgggcaaggcagtttttcatctaaggtaattgagacaccttttaaaagcaaaagataaattcacagaccctcagtgtcattataaattacttggtataaagatacttaaatacctacagccttataaggcctaggtgtcaattttttacgcttgcagatcttttacaactgtaagttaaatgattttacacattaagtgcatataaaacaaaaagattcaaacccaaatattaatttaatgacatgggtaatattttgctaaaagtaaaccactgctcagaatgtgaataaactgacctcgaaggcctgagtacgtttgaattacggaacacctctctttgacatcacaattgaattttttctttaagtatcgcaaggccccagttcacggaagtaccacaacataaattggtcttcacttggtatgtgaacacatatttatatgttaaatgtgtcttttctttttggtgtacaacagctagagtaatgcagtttgcttgcaatgtgttttttatgtaaatgctgatgccgaatccacttggcagcactgagttacaagaaggttaagtagatgaactagaagatggataaacgaagatagataaaatgaagaaaaacaaaartcaaggagaactcaggcgtccaagagtgtgtaaacaacttctggtgtgagacgcgctacattgcgctaaatggcctgtgcgcttctggtttttcccttcctctgttgattttttatagttgtcttttattttaaacacgcctcccccccccctttttaaactgattttaccatcactctctctagccctgcctccctagaattagctgcttcttacctcccttggatctggaacttaaatattaacgtgtatataagttaatagtaagtagaccgtgaatttagaagagtaaaacagaatcatgagtacgtagtcactgtggccccttttytgctggatttcaagttcgtaagcatttttggaagagagtcgaaggggaaggggtggcttgccagtcagttgagtgatgcgtgagggaggcgttaaatgtgcatgatgcactaaaatgcatgtttcgagatccagtatgactgctcttccatagatgatgaaaccaaggcagagaaataagatgtaactctcttaccttgattagtgatgagaatgggacagctttattyatgaaacccggaaaccactagcccattcttgggatgattgatatctgcaaggatcttcaggaatagagtacctggggctcaggagccaagactagaagtgttgaaaggtgagcaggaattagctgctggcctcagacgtggagagacacacgggtgtatgtgtgcacacacacacacaggcacatgtatattcatgatggcttcttaattcccactccaggccaactcatttccctttcccttccacaggtacttataccataaaaggtatatgaagtgctaaaatacttgtaggtatgttgtcaatatgagctactctgtaaatgataaataataattgactggtgagtctaggcaaggcaagtcaatgagattacaagaaaagagatgttaggccttcagaaagatggaaatttctctttgtccctgcagggactgttgcagagcattagagccaccctcaaacagttacccagtgagtctcctcaaagcaagtggcactgagatacarccttcctacaggttttcaagtcatctcgtgtggtgcacagtcctsgccctacctcgaaggcccgggcraagttttcctgagtgtgtatactcatctctttgtgttrtctctggcagggagcaagtgagtacaggattggagtaataggcatttttaggcttgagatggctttgtgtgtttggttaatgtcactacatttcctaggggataataaaagtctagcatgataaaagatctcgtcttacaaggtcccgatgtaaagtttggagcctaacttagaatttaaaataaaatacattttgacccattgtattgagagctggtataatttaatatagtgagcccctcggcttctggttggttgggttataaagcytsttattcattcgctcatccattmatgcatttctcctatgaggaagctttttcctttgagctgaacacacaaaattaatcgtgctcgaactctccaaattttgtgagttccctggtaactgactgtatggaagacagaaataaaaatcagaataaacttttattttctgaatcagaaagcagttgctccagcttytggtggtcacattgctaagatgtaaaaaacagaagttaggtgaaataaattaagaataattattttggagaaagagagggtagtgtttgactaaattagaaacattctctgagtcttagaagcgtgaatgatttaaatgaggttccagcatagtattgcatgtggtttctattttagagttttcccacttgaaaacaaactttgaggatttttattgaagtccatcagttttaacttactcaaagcttagcagccaccttttgcttttcttcccgttccccccacctcatgctgtgaagaaagtcatacaccattgtggtgttgattgaaacctttatttctccaggtctcctctcataaactgggctaagaaacacaaaggacatttgacacttcatgactacataagatgtgctgttcctctctctttctgtttgaaagtgacttggcagggtgaagttgagaaccccttggaaaggaggaagccgaaatgcaaacamagttgaatcatgargtgatgtcactctgaaccaattggagcagtggtgtcatgtgcctggcagctacttcaaatgcccacaaaacaggagtamtggtttaagctgtttccctcttcccctcccaccaccaatcagcagcagactgctagaggacagatgcaaaacagttattagaccaggcttagttagacatggaggatgcatcttaacaagttagtacctttttgcaaagcatgaagactaattcaaagtctattttctggttttgctctaccagtayggccaaaaccatttctttttaagtgagaagtggggatatggtcaggtttgattccagttgaagttgtgagctgcacagggctggtctgagcccagtggcatctttccaggtgtcagagccatgattttaagctcctgttaaattcacagtgcttagtaaccataacttcttggtttcatgatcataggggtttttgcatagctgccacccccattttctgtttgtgatccagtagttaaaactcccagaaaatatttctcaccctggtttaaataaacaaaacagccaccacaaaaacaaacaaaaacttggctaaccactattttcaggcatattctgagagagaaagagggggaaaaaaagactagacatcctaaaattaagcaacattatttttggaattgtgttgtttcttatactcagtcatttgtgaatgatgtggttcaaacaaaactgaaacaaaaatagtttttctcattaaaaatatgtttgtcgcatagccagcactcrgaactagggagggtaacatggaagtattgtcattctcggggctgactggttgacagcagcctatacaggagtggagaatattgacagggctgcccgttctccccaggtcgaagagagcaaatgcacatccctgtgtgcacggccacctggttcctctcctcacttgctggtgagtattgaacggctcacataattaggcagaactcaggaactttcctccctatctctttcactcttctgaaatgccctttatgttttcctctgctctttcagtcccagtgccttttctctggtgcagcctcatggttcggtctcaccttcagcttttccttccctccaatacatcctgtaaattattgtcagacttcttcttatctaaataactcgtttaggtaaggtactcatatgttcaaaataccatggtggctccctgttctctgtgatgtgaagtcctaaccattagactcagctttcccccaggacaccttggcttatcttcttgctgctttccagaggcatgggccattaggctggttttctgaaggttctgccaaaaggctgggcccttgtctcccaccccactgctgttactcatgtgttctcccacttgctcggcattctttcccatgctttttccttgatcatcactyactagctaacatctattttttcctaaacactctgttgcagttgtagtctgcagtcactctcctaagacttgatcatctattacgctgtttcgttctttattttttaacttttcttcttcttttttttttttgaaacggattctcgctctgtcacccatgctggagtgtactggcacaatctcggctcactgcaacctctgccttccgggttcaagcgattctcctgcctcagcctccctagtagctgggattacaggcacgcgccatcacacctggctaatttttgtatttttagtagaatcggagtttcaccatgttggccaggaggtcaggtcgaactcctgacctcaagtgatccacctgccttgacctcccaaagtgctgggattacaggcatgagccaccatgcccggttgttttgttctttaattttacaaacttggcatagcttagaagaccatatacagtggcaccatatacagtggcaccatattagtggcaccatatacagttttccctgagaaaactggtacctcccaacagataccaaaatctgggaccaccccaacagataccaaaatccacagatgctcaagtcccttttataaaatggtgtgatatttgtgtatagcccatgctcatctttccgtatactttaaaccagggatccccaacccctgggccacagaccagtcccggtccatggcctgttaggaaccaggctgcacagcaggaggtgagtggcaggccaactagcattaactgcatgagctccgcctcctgtcagatcagcagaggtcctagattctcataggagtgagaaccctattgtgaactgaacatgcagggaatctcagtaatgcctgatgatctgaggtggaacagtttcatcccaaaaccatccctctcccccacccatctgtggaaaaattgtcttctacggaaccgatccctggtgccaaaaaggttggggaccactacgttagaccatctgtagattacttataacacctaatacaatgtaaatagttgttatcatgtattattagggaataatgacaaggagaaaagtccatacatgtttaatacacaagcatcctattttttttcctgaatatttttgatctgcagttggttgaatccatgggtgtggagccctcagatatggagggcatgctatactgatcacccctatgggtgtgaatgttgggcagatcctccagtgtcaccagccatgtggccttggtgacctttccatacttttcaatcagaatgatgatctccacctctcaggaaagttgtggggatgaaatggtatagtctgtgtgtgtagagttgttaggctggggcctgccatgttaaatgcccatgaagcaggtaattatggtagtagtggttgatatcttgaaatcagggggattcccaaatttctaccccaaatctggatgactgcatattgcgggagttcagtaaatatttgttgcactaatacttatgtgcatacgctgaaataatctaaatatttaaaaaccaaactaacggtaggactttcctcagggatttaacgtttgctgtagaagactgaatgatagaatatataagctgtatttttcttgtgattctacacattgyccatgttgcaacttaaatatttttggaatgcaatgtaaaagtgatttactgtcctataattgttttcctgaaagcaaaatgatatttaagtgaactgcaatgaaaaatgcaacgactgtaatttatcrttgaagggcattttcaaagtgtatagaatgactaaagcttaagtgtattaaatattctagaggaagacatatttaggctataaatctagacttcctttggaatttgtttcctttttctcagccaggtgtatgaagattttaagttcttaggcctcagtgggaagaagatttaaggttcyaagagtacatttgtatctcttttaaattttctattgtttatcagtgacatatgtaaatgttttagggagctgtttactgtaacattacctactttagctctgtgcagttgtctggcaaccaatgtgataaagacagaggraagtgctgtattttgttgctgacaagtatatcttaaaagtgcaggtgcacctgaataggcartaaagtattaagagctgctcctggagcagtttgctctctgtgacgtgtgaaaagtctacggggtttataattggtctggccatacggctgcctaggattagactcttttcatatccyactaaacactctccttagaagcaagcacaaggagatagtttattttaaaatgtaattgctatgttactaagatttgaatttgagtaccgagaataaaccatatttctgtttagaggctggttggcttaaaattgtgtctaatccttcccctgccccccaactccgaatcagagaatgaataacaaataaacatgacaatgaagtctcatgctgttgttttcatatttgtatttaggagtttcagagcaaatgacttggaaaacaggcaaatccactgacataggcatttttagccaccttggaatccgaggagggattctgcactatgccctgtaacctcgttcacatgccgtttgaatgtataccatgaagaccccttagctcagggagctttgctctatttaagtaatgtttatattcttaatgaaccaaagaggaagtggtyatgggaaaagagccaggactagatttcattctaatgcttataaggagagttctaggaaaccctcagacttggtaaaccaaggcatttggagatactatgaattggtttaaaaggccatttaccacttcttttgtaattggccttttaaaccaactctcacttagctgattaaatgtggtcatttaaactgctagttaacaatcggaagtgcagtggcgcaatctcagctcactgcaacctctgccttccgggttcaagcgattctcctgcctcagcctcctgagtagctgggattacatgcgcacrccaccacacccggctaatttttgtatttttagtagagatggggtttcaccatgttggttaggctggtctcaaactcctgacgtcatgatccacctgcctcggcctcccaaagtgctgggattacaggcatgagccaccgcgcccggcctaagatttcttattgtggtattctgcagtggagaatgggagttggaaagaaatgttttctcccacacctgtcccgctcctgtctactgaaagctgattaatcagtcagatagtgagttcctattggtagtamgcctccaaaatttggaagaggggaggtggcgtgatgtgaaaaagcaaggctttagggagagattcccgctgggggcattcaccctctggtccagcgtgcctgttacagtgatcactccatagtggttttgcatgaacaagactgcccagtttgcttaggaagaaaacaaaggacataagktagttctcatgtcttcccagcaccctaaatactcgggctaaacttccacagtcagaccgtcagcttcaggaagggctgctgttgggaactttttttttagtttgcagttagttcagctccagccaaaaacctacaaaaagccactgcaagccctctgcctgctcgtataagacaccttggttgggcccctgtgactgtccatccataggatggttggccattgactgcacagagaggtagggcaagataaaacgactcatttgtggatctgactccttgtacttctgtttggattcaaacagaggaagatagagtagtggccttgggaaaccgtggagagagaaaaggcatagtcagaatgttttcagaggagcgcagacttttcaaaacccctctcatcacgttcccactgaccttcagttccagtgctgtggccacagggtgtctgcaccccaacttctttgccaagaaattaatgatctgtgaagacacacagacatgaggcggacttactatttaaaggaatcctgaaacgaatatttttctgatacatatttatcctaatatatttgctgagcatggtttttttttttttttttttcctattttggagtttttgggttttttaagcctagggaatgcctaatatgtactgtggagtgcatttgttcatttatatcccagtgcattgtaaaatcgagcaattcagtgccttagaatcctttctgtgaacttgatgctacgtgaactacttgagaacaactactttcaagccctccgaagcactcagttacaactgtcggtctaattgcacattattctaattcattaaaaaagtccccaagggcttcttaggatactgctctatgttattagaagtccttccaaatagaaaaactttattaatttaaaaataaccgccaattcagacttcgattcaaacaaggcattttaccaagtccggctgaaagagcttcttaccacatctggcatgtagaatggcagaagactatttttgctagattccttgttgctgcagccrtttctgatgtccttttccccttcacacctttcgtgttacacatgtctgagatgacatgatgctaagtaaccaaagtactgctgcgatggaattgctctgatgtttttttccagagtgaaagctgctattactttaaaaaaaaaaaaacttgaggtttggtttctttccccctctatccgggtgttatacaaatatgtaattaagatgtttgggggttcagatgacaaacaaggagtctacttctaagaatgcatttgcaagccaaaagagtggtgaaccacttcagagtgcgggtctgtgggggatgatgtctgctttgcttcgttttktggaataatttttaacatttctatttagcattcatgatactctaaatagaagcaggagaacactgtggctctcggatccaggagaggcaggccacgagggctcctgctgtttggggacagtctgtaactctaaatctttttatatgcagcaattatgaccttaaaaatgggtgactctaatactggcattcattgcctaaaaataattttaatgtgcaaatgccagagaccaggtcatctcagaaatggactagaattgaccactgctatgttttggtgaaacctgataaccttgcttttctccgtgtaccttgtttttcattgtaaaactatttaattatgaaaatgagagtgtgaaaggcaaagtatrattgaatttagggggcagttccatatagttgtaacaaactgattatcaaatgtccaccattagtatgttaaaatacggttttctaatactgagacaacagggatggagcagcctatccactgaagtcttgttgtttgtccctgctgtgtcccaacctggaatctctttcttcttccttcagcagacccttcgagatcagcttaagcttcactgccttagagaaactttcctgtctacctggactgtcttctagatttctagagcagtgttcctgcccttttcctttctaaatggggtgggagttctcagagaactcatctcctttatggctttatccatcacagccacacagataggttctgtctggaccatccttttccctgagctttcttctcctttgccatgtgttttcatttctgccagacactggcactggggaagcctcccatcgtctcagactcagggtgtgtgaaaaacaaacctgctttctggactctacagtttgtgcactagcctaagccgaaaatcttgaaatctgtcatcagtgactattgtagtccataggaatacccaagactgggtaatttataaagaaaagagggttagcttttttttttccggctcatggttcttcaggctgttcaagcatggttccaacatctgatcatcatctttttttttttttttttagayggagtctcattctgtcacccaggctggagtacagtggcgccatcttggctcactgcaacctcccacttctgggttcaagcaattctcctgcgtcagcctcccaagtagctaggattacaggtgtgcgccaccacacccagctaatttttgtatttttagtaaagatggggttttgccatgttggccaggctgatcttgaactcctgacctcaggtgatccccccaccctggcttcccaaagtgctgggattacaggtgtgaaccaccacgcccggccaggatctgatcattttctaggaggcctcagggagcttttattcatggcagaaggtgaagggggagcagttgtatcatggcaagaagagaaagagagacgccagatctcctggtagataactaacagagtgagaactcactctttactgtggggagggcaccaagcccttcataagggatccaccccatgacccaaacacctcccaccaggccccacctccaacaatgggaatcacatttcaacatgagatttggagggaacaaacattcaaactatatctacgaccaaattttcctaattcctttctacttaaatgctttcttttccatttatttcacccacatctgaccctaggatttcaacgtgttctaaaatgaatttcttgcacccattttcactttctctccaccagaatccatctcaccacccacctgccagtggcatactccttgcatagaccctgctctagcatgaatatagcccactgttatctgttgtagaacctcacgcccagcttcccaccctgtgtgacatcttcaccctcttgccctggcttgtgccatccacattccgatcttgatgactctggttctcttctctttgacggtggagggttgatcccttccttccccatgatcataaaaggtcatgccaacactcctaaaacaaaagatagattaataagagaaaaacctaacaaatttattatatgtgtgcatgggagtcatacaaaatatgaaaactcaagaaaatggccagatggttgatccttaaatgctttatttattggtgagaaggtattgggggtgtaggagtaaatgattttcagggaaaatgaatatttccctgagacagcaatttacttgtaaatgatgctctttagaatttgaacacgctccagaggcagaaattgtcttgtgaaaaagtctgtctgggtatggttgcattcctcagtcttgagctggtggatggcagggtgcaattgcaggccgtagtgttcctctttggggatctggtttctaggtgggtaagggaacttcagagaacagccttgtcctgtgctttgcgagagacaaaggatgaggaaggggggtcagggaccttgaggctgcttcagcatgtcaagagtgccatgtttgggacgcctcaacactggaaatagccttcattcctctgcttcttgggtctggatccttttctttagactccaagaaattcttccttttgccccaaactcacattgtttttgtcttctgtccctctacttctatgtaattctattattatgcacagattctgtgtgcccaaggagactgtaaactccaggagggcaggaattatgtcttaaaacactagcggttaaacagttaagaggtgtcttaaaacattcctgtagccccagctacactcttgggtgcaggaatcacaagtgccttattccccacagggtccccagcatattccaggagctcattatgtttttaaatgaatgacctactgaaggcaagagaccaggaaggaaagtttgtaaaagtttacattattagattacccctgagatgtgtaaccttctcacgagttagatttcttgaaccactgcccgggtattgtattcctactctaggagcttgaaggattaatgataatccttttacagatatattcacaagtttctgtgaatgtgaattaagtatgtagatcttgattgcctttcttgagtgcatggtttttttctagaaaaacaaatttaagttaggtgggacacctaataaagctctaggctcctttcttttcctcttttaagacacagttaattaccttatgctaagttggaatataggaattatcttccaaaactgtgtttgcttgctgtgtctacataaaaattgatacaaggtatgccatggtttatacaatttctggcacatttacctggtctctgttacaggtttgtgaaaccaatttttttattgtaaatagtacgttaccagcttaattgctttagaacctagacagtctatgtctgtgatagtaattacattctttcatgactttgtttggtaacctgaatgttgaactagctctacagatttaggtcatgtctgatgctagccattcctaggaaaaagtggtgaggactacattatgggcctttccccctagacttaaaactgtgaagaagtcattttgggttgaggtatcccctggtaccctctcctgaacttcaatagaataacatgatgtggtgaatgaaccatattagaaaaaccagccaatcagccragattcttgtattgactcttctgatctccctctacctctcctttccccatctgccaaacaaagggtttggaacagttaaattctaaagtggtgtcattgatggctctcagtattctgtggactttcctggttgattcagtacttgtgattgacctggaccccctggtttggtccagccttagagcgggtttgcaggtagacaccttcctaatgtttgttccacgtaagcccccggagcacagtatttccatcagctattttgtrgaagtgagcgattctcttttggttgtaaaccttcactatttcatgtgggtgacttgacaatggctccatttttgaatggcccattgatagttgtagtctaaaaatttccagagattacacaagggtttatttaaagggaatgggaatagggagaaggtataacctttccaaaacaatctttaaggcaattataagctgttaggaaatgtcatgtaataataacacagatacccaagcttatatcacataaatcattcattttgcatgtttttgacagggagatttattttccaggttaaaaacaaaaaagaaaaatcttaaaagcttaagcttttattgtttgctttttttattaaaaagtaatttggagccagtaacttaacctgtttttcataaacatgctatctagaggcagccaaaaaaatattcatgcttgcatagtcagggtcctcaaatgaacttatgtgttggatcatgataactctggtaattactcgaattacccttgttgagtaatagtatggaccctgaatacaagggtttgatttatgtggccagctctgtgctgctgggtttatgaggacttgccagatgtcatctcctaattaaaatccttctttacccttaatatcctctcctctgtccccaagaaattaatccattctattgctggagcatgtaacagctgatgttgaagttacaagtttacagcttgaactttgcctagactgtaccttttttgggaaagagtttgcaaagcttttaagcctgactcttgtctttagatcaccagcatcaccatggtgcctggcatcagtggagcctcagcaagtgtttatggtggaaacctcagaagctgtcactttctctggctgtaacagttgtcatctttgtttacagggaaaatgctcttgagaaaatggaggtcattaaacactccagcttcagcaatatcatcagagctttccgtcacgtgagttatctcacmaaagggtcagattctggtaaaaactcttgccttcacacttacttctgttttattttgccttatttgacatttcaccagaattgatccataggttcaataaggctccattctgttgggacaaatcaagctagaaagacactgaactctgggggttaccagaaatatctgaaagcaaagcagtgactgtgaggtgggaatctctctgagaatcctttgcagaaccatgtaacagctctgcatcactagacgagccaagcgaagtggtcctggatggttcagtaggctcaagcattgagggtccagagcatcctttgcccctggacatggaagggttttcattgggagatggcatttagggcatccttataaacgagcaggagtaaacctagcaataaaaaccaaacctctgccttcagaggtatatgctattacttctgcttaaaccgttgtcagagctaacagttttggttagggatttttgtgggtccagggcacgcccagacacccagatgcttctctatgtttgtaagatggcgagtgttgagatgtcttataggcttatattgagtgaaaaggaataggatcctttgtcagtagtaacttaggctttttaggtggccagggcaagagaacaccccccctacacacacacacacacacacacacacacacccctacacccacacacacccacccctacacccacacacacccacccctacacccacacaccttcccacacaaacctacacccacacaccttcccacacagacctacacccacacaccaggatttgaaggctctgctaagaggctacaacaactgtagcatacaactagcacacttgttgctattatgtgtaggggactagatggaaagagtgcagataggactacctaccattcacccctaccagcgaagtggaagcactcatcttctttcccttcttaccctttcaaagcaagttgttgagggatgaagaggagagtgactttaatcgtggctttaagtagagattttctttaggagtaattgtttctctcgacagagtggataggcttccatagttgtcttaataccttttgtccaccccaaggattgacccaggcaaggaggatgaaccctcctcaatttgggaaagttaaattttaggcacagcaggtcaaagagtagggaagagctgcagttgttggaaccaagtgacattgatttagtctggaaaggagtcacagaggaatcaaaagccagaccctcctggcagctttagatgtggttggggtctgggaataatgctggtcccaaaatcacctctggaactaactcctgtaaaatgaagcctctgcatccttcagtaacttacttaaaattttgttagggctgcattttcttcaaagccaagttctgaataagaagtatttgttttggrctctagccagattactgaagtattgttgagggagatttgctgtggaaggkgttgggggtacagggattgtgaagataatgtaaaatatttaacattttaaaaattttcagtaagttctctttccccaatgtcagcatgacttcttcattcatgttcttccatcactctccattcagttagaatctcaattgtgtaatatcagtggtagcgacaattatgaaattcgtccagtgaggaaaatccgcagagctagagcccaaaccagcaactttgtagtgaggatgaccccactggccggggagaaactgaactgatttttttttttctctctctctcagctttttattttgaaataattttagacttacaaaaaagttgaaaaagcatccaggcatggtggcttatacctataatcccagtgctctgggaaaccaagacaaatctcttaaagccaggagtttgagaccaagctgtgagactatctctacaaaaaaaaagaaattaagtagccagcagtggtggcacgtggctgtagtctcagctacttgggaggctgaggtgggaggatcgcatgagccaggagttccaggctgcagtgaactatgatcatgccactgcacaacagtcttggagacagattaagaccctgtctctttaaaaaaaaaaaaaaaaaaagtttgtaaaatatcacccagttttccctaacgttagcattttacataatctatacaccaattctcacagccaagaaattaacaatgacacaatactgttaaccatggactatttgaatttcaccagttttcccactaatatcctttttcagtcccaacatccttcattgtgtttacttactatatctagtcttctccagtctgtaaaaatgtgtctatctttgcttgtttttcatgaccttgatatttttgaakagtatggacaggttgttgcatagaatgctccaaattggttctaatgtttctcatcattaaactcatttttatacattttggggaagactactacaagattgacattgcatctcagtgcgtcacatctgtgtgatgtcagcatcttaccactgatgatctcttagccttgaacacttgattgaggtggtgcctgccaggtttctccagtgtaaattttctgcttttcgcattgttactgatatcttagggctgatactcacagtatgyagatgtctcgtttctcttttttcatatttcttttcttttttctttttttgagacagtcttgctctgttgcccaggcaggggagtgcagcctcagacttctgggtttgagcaatcctcccatctcagtttcccaagtagctagtgtgcaccatcactaattagtgccccaccagttttgtttgtttgtttttttgtttgggcagaatctcgctcagtcgccagactggagtgcagtggcgcaatctcggctcactgcaacctccaactccctggttcaagcagttctcctgcctcagcctcctcccaagtagctgggattacaggcaggcaccaccacacccagctaatttttgtatttttagtagagacggggtttcacatgttggccaggttggtcttgatctcctgaccgcccacctcggcctcccagagtgctgggattacaggcatgagctaccatgcctggccttcaccaatttttaaattttttgtagaaactcactatgttgcccagtctggtctcgaactcctggcctcccacctcagcctcccaaccacaactggccraggtcctgtttctcatcacattgtcactcactgatcttgtcatgctttggtggagcttatctacaataattattactgccatgctttaatggcaattttctatcttattgtcatttattcattggaatttttacataggaaagacctgctccttctcaaactctaaacagtttcattcaccatacttttctccaggtaactttctgggtggctgaaagtgactttcaaagaatggagatatcttttcaatgttgagagagtggcagtctgctggttcccaagatgccttcttcacctagcattgagactctgcagaatgccttgaccacagttgtgatttggatctgttggcttgcaaagcccatttgagaatttacaaaatcattttcacggcctgagagtcttttaggtactgatttttttcatcccttctttactaacagactttatttagtagagtattattggacaggtttggggttcacctttatgagaaaaaacttagattttctaatttcagcttttttattttcttccatcagtgggacaaagttgacatcattgcctaaaagtaatttctgtgattatctgtgtatttcagttaaccatgttctttggactcactgtggtcttcagcagggatggtggccaaactatgtttagaaagataaaaattaaaatgacatctgcatccttcatgtaaacccataaaaaatagcacgtgaccctgaagatcctctgcctctcattccaggcattacaattgaaaatgctatctgggatgttaaaaactaaaactattctaggacttagtggaatattgatagttagggaatgctgtttgctttcttgaattttgaacctgttattgagaaggtagatgcgcctgtttaccccaggaaggctcctctttgaagacagtgcccctggagcacatgaccttttcatgcccttgcctgtcaagacttttccagtactctaaggtcaaagggcgttgggccaggctgatctaatcagggtattaaccttgccccactcatcttgatttattcctagatcccagttcccagagcatccctttagagcctcagaaatggaacamaagacagctgaaataagcccgtggccaaaaggcactctgagcatgagggaagtaagcaggcttccctgtcactgctgaggctctgtcatccagccccagctgtcctcttgtgatcactcagcagacccgggaaaaattcaagaatttgttttttagtgtcagtgggagacgtggggatcctgcttttgctgggagagcttcagttgtctgagtccccactcaaccccaggctcctgccaaggccaccaagggcaggagcactggaaggctgactatggagtgaagaggccactgggtttcacaaacagcactgtcagccaaagctgtagcttgttagccatccaaaagaatcttgcacctgctgccagtgagcttacacctagatgacagctggagctgacactcattcagcccttactctatgccaggtactattctaaacacttgccatatactcagttgtcccacagatacaactatttatccccactttagagacaaaaaattgaggcacagaaaggttaagtaatttggccaaggaagtgcagctagtaaatggcagacctggggtttgaaccgaaatcagtgtgactctagagtacctactcttagaccctactctctactgcctctcattagaagtctcccccacctccctaccaccaccatcaccacccaccctcccagccacatatatgctcacactgggtggttcagatggctagaagtggcagctcaaccttgtgtgcctcggacacgaaaatattaggttcagacaccactcagacttcacattttcattagttttgggtagaggaatgagaataaatattcagcgagacagccttttctaactgcaagattgcattcctcttctttctagatgcagtggcaagaacagtaccctggatggtggagctggtagtggtagatgagatagagcagtcccttgattctgctttgtccccattaatgacagatctgagggcatccagaaggaatctccacaagcccagcctccacagtggctgcttccyctacatggtagagtggtgctcacctccactcctccatagatgccaagtcatctgtggtatagatgtggatgtctttgttcaaatggtccttgagtctttgctcagatgatccttggttcttcatttcacctgggaaagaaaataatttgcctgttgtcattttatccataatattaagaaaacttaatggcacaatctaagctttttaccatgttatttatcatgggattacttttttcaggtgtcttctgaacacgcagttgtcccaccaaactttgacactgcccttgtgattaatttttgcctacattaatcactctcccttgttttaattgcacattacattcttttctgtccttcccggacatctttgctagcacagtgagtgcagggaggactgtcacggactctctcccctcttgaatgggggcattccagcagagtgtgttacatgagctcagagcacatgatgtgagagcctcgtgatgaaagatactgcaaaaacagtgcgcactgttatcaaacctgactgccttcacatcttgctttctgtggtgcaaaataaggtttttatagtgtcctgtttcttctgttatcatctaaaccaatggggaacggtgagtaagtagtaatcttcagaaaagaagaaaagacagggaggagaaagtgtactggaggcctgctttaccattaagttgttaagatggagtctcactctgtcaccccggctggagcgcagtagtgcagtcgtggctcactgcaacctccaactcctgggttcatgcagtcctcctgcctcagcctcccaagtggctggggactacaggtgtatgccaccacaactggctaattatttatagagatggggtctcattttgttgtccaggcggggtttttgttttttgttttgttttttttttttttttgaggtggagtcttgctctgtcaccgaggttggagtgcagtggtgcaatctcagctcactgcagcctctccctcccaggttccagcaattctcctgcctcaacctcccgagtagactagctgggattacagctgcgtgccaccacgcctggctaacttttgtatttttagtagagacggggtttcaccatgttggccaggctggtctcaaactcctgacctcaggtgatccgcccgcctcggcctcccaaagtgctgggattacaggcgtgagacactgcgcctggccgtccaggctggtcttgacttcctttcgcttgtagcctcccgaagtgctggaattacaggcgtgagccaccgcatctggtctctaagttttttttgaaagtgtgtgtgtatgtgttgaaaaacaatcttactgccatcatattgaagttacctagtgcatttcttcttcagggtacgaagaaaaaagaaaagtatgtcctgtggttgatagaaatcagtaaaatggagccctgtacgaggaagtgctgatgagactccaactaactccatggagatgagctacaaaaaaaaatactgattgggttcaaatccttggcctgccatttactggctgtgcttccttggtcaaattacttaacctctctatgcctcaatgttctcatctctaaagtatggaaaataattgcatctgtgtgaaaactgagttactatacgtaaagtttttagratagtacctgacatacagtaagtgytgaataagtatcagctagagagagagagagttagtttccagcagcctgtttctgtttggggtcacatgtggtctctgtccacctggctttttaggcctctcttacctgttccctgtttatccttgcctgccccagggaggagtttgagttggtacatcctgactgggtactctgcctgtggttagcaaatactctgcatgttgagtgctttcaaaatacagaaacaarcaacttgtggaggcattggaaaagtgtgtttgagaaacaagcagcctcaccatgartgggagtttgtttccctttctcgtctttctggtcatctgctgcacgggcaggaggagctgtgggttgcttttcttccttggaacatggagcaccactctcccctgtgctgatacacttacaaagaagttcacctactccttggaaagttctggaaaaggggcttctacactgttggcctctcgaggagaacggtttttgtttctgtcttcctggaaaagaggtgactgctggcatcatctttctagataaactscttgctatgatgccattagaagcagtgttcttttgtgttttgcttttgtttttccctgtagacaggaataacattttgactagaaacttccctgatgtaataacgaagatggcctccttagaaagttccagaacagaccccttcacctctgtccccagaagcagaagtaggtgatgcactttcttggcaagccacataactaccatttctctacaatcgaagctcaaaaatctgtgcttgtatacgttcattttttgtttttacttctttacttcctttgataagacagaaacttctgtattaaaactgatttaactctgaggggctaagtgaacaacaatctgttgtcctatagaggtcaaggcagtgctcacaacaggatcattgtgctgctgtagttcagtttaggggacggggaatgtttataaaaacaaagttttgaaatgaggacagggaaaggctttgtttacctggggctctagacttaaggtactcattttgcctgcagaataatgaaatgcagagttgtaattagaaaaggttgatgtaattgatgtgttaacaatttttgaggtttttctctttccactttaggacagtcatgcaattatttttctgaaccaaaatcagaaccatcagtcgaaggctaaaacaggcctggggaaacactgtcttttggcaaagaaagacaaagatccttgttctctaggccagtgtgcatatgtgtgtaatgctttaaagaacaattttgacaagaactcttaggatgcaacttgtagagtgatttttaaggagatgcagtaggatttgtgcaagtattctgctatgagcctaagattttcaacatggaaatctagccatgcagtgactcgttcactttggcagtgtctatcttagtctgggggtgagcgtttgtagaaaatatttagagactcaagtacactcatttgaatttttgctgttagcaaataaatggcaatatgtgtaacgtggtgaatgggatgtaaagctgtctttatattaccacggttagaatttaattttgaaagttgcaagtcaaactgcttcctcttgcgtcattaagttgtgcctcttgtttgctcaccggcatgtgtgtccttgtgtcattttggttgctgtgaaattgctcttaccattctttcatccttcaacctgctgtgctacaatcctaacatgctgtttttgttgaaaatgcattcactctttttggcatcttttttccccagaaagttagaatattgggaattcattggtattagtgaaattcccacctaatgcagcagtttttttctcttacctgcataatagacgcagaacaaattaactctaaacggattagagctgtcaactgacagatactgtgcgagatactgaggaagcctcagagatgataccaataaacaggacagggccttctggtcgtgtttctacttctcttattggtttgtcttagcaattttgaattgcactgaaaacgaaatttcataggtacacgatacagtagttagttttaaaagtttttaaaatattaaaaaattgaaagtatttaaaatattttwaaaatattttaaaatctgctgtgtgagatagataggagacctagcttttcttccttcttaccttgatccatagagaaagcaaccctgaaagaagaaaaactcacccatttgagctttcttttgtttccactgagcaatacggaagaaattcaccrctggttataggtcttcagtgctttcttcagagtgggattgttttttgtttcaccataagtagtagtctattaaattaacagttgctagagaagaagctgcatctatatatgcagttctcttcttgtcaagcagtatattttcacgatagcaatgaaaaaattccatcctcaccagccgctgaaacatagtaatactgcagaaattcctgtgaactatgcgtttgctgcttccttttgtttgtttgttttcagagcagatgggcttgtttgctttttgcttaaacattaatcaaaaatcaatttatggctatgtaagtggcattagataattctcattctgactacagtaaataatatctatttgttcatgttagataagtctgggcggcagtggaatgtaaaatagaattacatgagatatgacatatggctatgtgttttataaattaatgcttttatgcatgtgggaggagaagtaatttagcttactgacaaaaagaaaagcaaaggaaattccagagaaagaacaggataccaagtctaaataaatttggaagacaaagagaatatcatartttagttcaatcttttaaacaaattgtcacaatttatacgttgggataagagaaccatgagaaaaggtatattctaagtcctgaacatctttctataccctgaagatgtttttatagctcttctgctgactccctgccaaaaaaactatttacggtttggggtagggggcgtgtcatgccatacagctaaatacacttttttcctaatctaggaggcatgtctacttacaaataaattgcttaaactagttaggcttgtgtaaatgtaactgacatttccttgagatcagaaaaagttttgctgattaactatatttgtgtgtgtgtgtgtgtgtgtgtatttagagagaaggagggattttataattattacaatttgatttgaaatgtctagagaaagtgagagattatggaaattaccataaatgctccctttttcatagatttagatctgttaattgcaagmaatctttttttaagtgaatcaatgggaactttttatttcttccctaagattcatttagccttgaaaaggccaaaagttgaatgaagcttctaaatgccaatctttccctccttctgttaaagagtatgcttcaactataattacatttgcattgtttaaaatattagtaattctacagccagacctctgagatagctgagaaaccaaaaagtgaagttcaaagacatcatcaggcaccctctccacacacaacataccaggcccaccaaggagtttacatgagtgtttttgccttgttagccgtggaacgacctgggcagtacccaaaacttagcaaactcttcttgtaccttgtattcagtagacggtcagtagcaccgagagtagggagaagagtaaatatgtttctaatactttattcaatgtatgttgttaacagtgtagacactctgactttccttgtgaattgcgcctcagtatttagttttcatttaccctggatcagatagggcatgataacctttgaggggctttgtgcatatgtaatttggaatctgagtcagtcgggctgtgtctctcccaacttcccttctcatattcttctctctcctcctcctcccctccctcctcctcgcctccctcctcctccccctccctcttcctcccctccctcctcctcctcccctccttccttctcctgccccctcctcctccctcctcctccttccttctcctcctccctcctcctccttcctcctccccctccttcctcctcctccccctcctctctcctcttctctcgtttctcttctctctcttctttctctcttctctctctaccattgctgtcagttgagatgggcctgtgcggcactttgtttgcagttgattggcaatcttctgttctactactgcatctgaatcatcacttgcttccaccagttctctgaatgtcttacctagtgatcctggtggggaaattacagtgattagtgttccaattcttgtttgcccataagtgtttcaaagtagtatttttaaaaactcttctaagacattctctcttctcatagtagatgcagtgaatcttaaaggtgccctaactaaaatttttgtgctataaaattggcagctttacaaaataaaaggttcgagatatgagcctgatcaaggctctgcatttgcaacaatatccttggtttgcctggccctgttatattttgctgttgtgatatgactcctgccagtgctatttccatttaacctttgtttttctaaaagacagtaataatttttcatttctagggagtctctgacatcagctaaaggaaagacacttttctttgactgtatatacatttctccccatttcattaatatcaaagttgctctttcaaatggcttataaaattttaaaattacaccagttgcataagcctgcataaaaagcagactcctacataagctgacaatgcatttgtaccgtggtgttgagcagttttaacatcctccgtgcctctgtgcttctgctagctactgctctgataaagttatcaaggtatcattggatgcattgaccaggatgaagacacaacagtatggccttattaaatttggaaataatgaacagacgagtagagaatttaggagcaatataggcaagcttaataggtctttactttggggcctgtaactccaactacatatggaagaatttaagtacaggaaaagttaagctcttttcccagtagttctgctgacaagttgggtgacttcgggatggttacctcttcatgataccacacggtgatggtaacagaggcactgtccagtctctggttcatgcacactggtcttctcaggggtccctgtataggtgacacagtggagaacagggcagtactgccagactcagggacccagttcatcgagaggggcagtgtttctcttatgctgccttaaaggcattggatgccttttggaaagccagtggacarctcctgcatccacccaagattaatgttaacagcttaaagaatcattgcaatcaagggaaattttgcaacactttgttgggatatttttaaataaatgtgtgaacaccttgttttaggcttgctgaaaatgacccaggaattccttgacccgggaatatagtgtatggctgccaattattatattccttcatcagacaaaggcggaacagttcactctttttcttttttttggacacaaattctcactccctcacccaggtcagagtgcagtagcatgatctcggctcactgcaacctctacctcctgggttcaagtgattctcatccctcagtttcccaagtagctgggatttcaggcrcgtaccaccatgcctggctattatttgcatttttagtaaagacagggttttaccatgttggctaggctggtctcgaactcctgacctcaagtgatccttctgccttggactcccaaagtgctgggattaaggtatgagccaccttgcccggctaccggacagtccactctttacaggggggcgtcttggtataagtatggaaagctccgtagatgccrtgtcagtccataccctcaccaccttcttgaccctgtgccgataaactaagagatgtgggcagtgtaccatctggaaaggaaaaggctttggagccaggtagtcctgcctgcatttgaatctgctttctaccacttacttacatcaggttttccttgtctataaaatggaagtccttgtacccaccacctagaatggaagtgaggattaatccagaccaacgatgaagagtccagcatgcaggaaatgctcgtttataaccatggaagtttcgaggacttttgaaattcgatgacattaacctttgaggtgcattttagttggcttgtgtgatgaggcctttctacttctagttccagaatcgtctggatctacattatgtgggaatgtttattcccccctttactttcccaaaatttgctaaacattttcattgctatttgagttttttaggagacatactgagatgaagttagggatgtgaaaggtttactgaggataacaccaatgaaaggaagagaggaggaagatgatgggtgtggggagcggtttgaccaggactctgataggacagacactctgccagccctccgggagctcatttgcagagccccctgttagatggatataaccgggccctgggaccattgctgggctcagttactggccaggagctgcctaggaagagtgtgacctaggccaaaagttgaagtggaccctagaagagctagcagctggagggcatctgctagtgacactctggagctggacagcaagtcctttctgaaagaggatctgagctgagtatccctgtggtccagtatttcaagttggaacctctaggtttgaaaaatacatgttttgggtgagagtttgattattcttaaagggacatatctttcaaacatatggctgtggaagaggaaacttgtttttgacttgtaaaataccagcagagccttgcagtgatcacaacttatgtgaaatacagaccatcacccacagtttacgtgttcacactaaagtgccagtctctctatgggttttagagctgatttagatacatgcattgctaatacagtcagcccagccaagatagtgccatcctccgcaagcatccamtaaggcatggagtcagcttccgtcattgttagatcagtacttgtttctttsccttgcttatttttcctaacctctctgaacctgctgtgttggaagcttaaggaacatcatcctctgttgggcagaattcttccatggccaccccagcattatgccccacaccatttgacttactcatttgtgaatgccaactcaraatgtattgctttgattcttgattaggatctcaacctctatttattgttaagactatcaccctttgattcccccccatcccattgtgtccttctaaaggcacagaatagaacatcttctgccagaaataacatacaaatttatcatcatacaactgtacaatatgcaaataacttgctagatgatattactgaagattctacatccaattaaaataaaragagaaaacaccttaagataaccatactattaaaagatacagaagacaactggaataaatggaaagacataccacatttattagacaggaataatcatcattagcaagatggcaagatgtcagttctccgtaagtttttcaatttaatataaatccaaatacaacagatttttttcttttagttagattctgaggttatcattaaaacaaaaacaaacaaacaaaaaactgaacaagagcaaggagtccttaccaggtattaaaaacttccatagtgcctaaataattaaaatagtgagataccaatagatgaagagacagaccaatggaacagaatagaaagtccaaatgtagatgcaagtacctgtggaaatttagttattcgataaaggtagcttcacaaatcattgggactaagataaactcttgatttactggattggggcatgtaaattatggcccaatcatgccatgtttcttttctctggaaaagaaagtaaattaggttcatacattataccatgtaccaggctagactccaagtgaatccaaggtaaaagtgtaaacaaaactatgaaagtcctggaagaacacatagcgagttcctttttataaccttggagcagagaaagcctttctagtttcaactcaaaatccagaagccagaaaagaaaacattcataaaaattgaatttaaattacaaaaaaactttctgcatggccaaaaaccataagcaaagacagatgccaaactgagaaaaatatctgaaacttctatcacaaagagctaatctcccttgtttaaaaaaacaaagtaaaacagagctcctagaaattgttaaggaagaggctaacagttcaataggatttgggatgaagtattgaacagatagctcacagaagaagaaacacaaatagctaagcatagaaaaaaagtttgatttcactcatacgagaaatgcaaattaaaactacaccaagataccattttttcacttctcatattggaaaaaatccaaaatatttgataacacactctttggaaaacaaccccacatggctgggaggacggcagaatagcacatctatagaggagaatttggcaatatctctcaggttataaacacgtattctttgacccaccaatcttagagggggcatttaccccatagacttgcacacatgtgaaatgacagttgtgcagttgttcattgtagtgtttcaaatggcaaaagatgaaaatgtcccccaaattccatcactgagggaataagtaagttagggtgatagctcccaagcttattttctcttcagaatcacctcatgaagaaaatgaaggtctgtgtgatagtagctggcaggtgggcatggtggtgagggtggtgtttgagcggagacctgaatgaaggttgagaaggagccagccactcacagacacagaggaggccttcaggctgagagagcagagaaggaccctgtggcagagacaagctggaaacagcactgcttccatggtctggagactggaatatgtgggttctgcagacacctggggggggcaccacctggtaaatctgcctttcagctcttggttcttccagcaaaccatgccagctgtggctctgtagccatgtcctcggaagatggcagaggttgcaacgaggcctctctgaggtgctctgggagcacagaggagtcaggtggaacttgtggcatgttgccaagggaagaagtgatttttagacagaataggaatttgccaagaagagaagtcagaaaagcataactggcagaggaagcagcatacgttacaagtaactgcatgtgtacagggaatcactgagtgatggacaagggcttggcacttggtgggggggggtaccatgttaacatgttagcaagaaactaggtaggggtacttgacttgggggcagcagaagcaggtgtgagtgttggacaagacgagaactgagtgctgcaaatgtttggcaagacttgattgagtgcatattgtggacctgtgtctccactggagacacaaattagaatataacaccttgccctggtatgctcagggtctactgaggtggagaaacctgcaagtagagtcggagtacagtgttgaaaacaccatctgcaaccttaacacagtgctaccaaaaccgatttcggagcactcctgcaggaagtgggctggccagggcaagggaagccgtggagaacagtggcctctcccgggcaggcagggtaaggcctagaaagaataagctgagtgaaggtttgtgtgtggcccatccagggacctgcgacaggaacacagcggctgaggaacggatgcttggagaggagggggtgctttacatgccaggcgggcagggccggggtggggccagatgctggaggagagggctggccaaggggtggcagagaggccccccaggtggcaagtttgcaccctgttgcttcctgcaaggagcttttgtttacgttttcagcttggacagtctggctgtctggccaagagtgacaacgtgacttaccatcagagcgaagcaccaaagagcacataaatgaagtggagatccctcctgtgtccagcctccccctccccgtggccttctcctaccttcccagtcctccatcagtaccccggggccttgccagaatctcagaaagaatctctggactctggctcaggacctctgaggtgattatgcatctagaggcatccccaggtgctgcccaatttggggaagcrgcacttcccgctggaagctgggaagtttcccctggctgggggtcctgtgaggatggagaggccagaatgaggaatgggttgtgagtcaagaccaaccagaaggggacttagcaatgtcagatgatagcctgggtgaactacatcctgtgtggaaaaggcaaggtgtaactgcttatttcttgtcaagtgagcctaatatcatcatgtttctttttatgcctgctcccaaactcagcccctcccagtgagatcacagctccaggaacttgcaaggaaagggactaacggggcatctgattcacccgtgtgcccttaatggcgtattgtgtgaataaagcaacaatttttagyacagggatttaaaacaacttctgcaaagacagaactaaaaattaatcttaaaaggtggagggttggggtggagggcaggaaagaggaggaactaaattgccattctctttggagactttctaaaacctaagacgaagaagaggagccgaattatggaaacaaaacctttgcggttttccacagaacaaaaatgatgtgaagctgcaagtcagcagttctggcgcaggggctccgggggacgcccgctccgccggctgtggtgtgcgcccttcctgctctcccctccgaggggctgaggctccttttgtctggcgcgcgcgccccaccccgccccgggygagggaagagggagcgggcaccccgcgcccgcgccgccgccgtggaccaaggttgtttactactttccactccgaataacacgccaatcaccagggcccaccctccccgccggccaatcgctgcgttgggaaattccacctttccgcggggcccgggcagcgactggctggagtgtctgtcagtcaagtgggcatcccgcaaggatgcagcaggagtattagggaggcgatcaccagagcagaggaggagtaaccttccccataaacaagatgtgttccccccactaagaaagcgggtggagggtggaggagccaaaacacatcccagccccggggccccaccggagcgaagcgggccgagcgcagagtgcagagtcggggaatccctccctccgcctcccgccgtcgctgcagttgtaaacacgtttccctccatgtctgttttcccttctctctcaccgtggccattacgggctgctgtttacaaaaatcctgcaggcctttgacaccccgtcctcccttcccccggcatccctgcccttattctggctttyttctcttccatctcctggtgagcacagcatactgttctcaggcttgttttccttttattgctctccatgtgggacaggtcatgctttatcaacatgtaccattttctacaaatgccgcccttcctctttaaattgcttggatgggcagatcgattttgattagcaacactgcagcagaaacaagktgcatctctggaaggactgggtggttttctcgttattgttgctggtttgggtcacatcggatgctattttaaattctgtgttttattccacgatgggtcttgaatcctttccctattcctaggtttgaaatatgtttcctccctttaaaaaaaagaaggggggcagtattgtgttgaaccaaatgtttttctaccttctcctgtgatctgaatcaggtttcccatttccagcagtacaatgtggttgtattcagtgtgataggggcgtagtggacatgaattatttgcgacagggctgcctggaagatgcggagcggagtttgcgtggcccggagcagctccagtgtctgaggcttctctgtgtcacaggctccaagcaggaagcgcaggcaaaatrgcaaaayacagcatgtggcattcagttcaaaaatgcccttttttagaagtcggtattctaaatgacatccagtcttgcttagttttttaagagaaaggaaaaataatctatgaagatggtttggaatattttgtgaaaagccttttcagcataaaaaagatgatcttgagggtctggtttgcggagtggaggataagcctccctcctgcgattctgaattgctttttggtttgtaggaatttcaggaacatgttgcaaagccgtggccgcttgaaagggtcggtgccctgcgccccgtctcagcccctgcggcccctgaactttttcagtgatggggcacttggggagaagtgcggggagtggaggaggaggggaaggtgcattgcaaatagaaatgtaaggcgtggcctgggtggccaggatgtgccagagcagcctccagacctacttaaatcccaggaaaagtcctgcctcaagttaggcacaacatctgacttggatttctctctgtttttttctcttccagttgtctgtctgtgcgccctctcccacaaggaatagttttccacactgatggaattaatgcatatcgtggtattattggtggaatatgtttaacctttgtttcgtgatttgagaggaatggttcttgtgtatcgtgtggtgacagcaggttaaggagagtgtcagagctggtgcagagttttgccccggggccatgaggttctgggcatcatgactctcttatgaagttacaaaackgggcaagtgattgaaggcagaaagacactgtaataaagtgtgctccagtgatgtgtgctccggcttctctcccttactcatctgggccaggtgctttcgccacagtgagcctgggtgtcccctgcctgagatgagcacagtgatgtctatgcgaggttgtaggactcagtgaagtgccttagggattttgcctggcactctcctgggctcatgaggtgcctagggctgagacttccccttctctgtctggtaaatcatctctcccattctttcttctgcggcccttcatatgagctttgtaatttactcagggtggcagggtgaattcatcttttgctgggtttctgcatcacctgctcctttctggccaggtcagcctgttcattttttccatgccaacagcctctaagtgccagtaagtcacgtctgaacaaccaaagcatgtttccctgcgggagaatgccagggcaggcgggtctgggagccaagaggatttctcctgttcagataagtcgggggaatagaagagccctgtgacttgagacaagctttgagtgacacccagtgaatctcccatcactactttaatccctgccccagtgttctggttccccctttcctgcatgaggcagtacgagtaccctggcctggctttgggttctacacggtctgactttagcctgccttggtctttgttcccctctcactccctccacccctgccccccccaacacatgtggagtaccttaccctgccttcctagttctggaatggctgcccctgtgccaggccaccccattttctagaaccaccttcatacagcccctgcgcatcccactgtactatttccttgtttgtttttcctgtcaatcttgccttccgcgctaatgggacactgatgctgtatggtgatgtgttctcccacagtcatcttytcctcctgtggttggggtggggagctttctctgtgtccccccatgagagtgaggacagtctcatttaatggcaccatggtctgtggagccaggcaggcctgtgtgtctgactccacttcagcgctctcagccagcgtgggcacctcggacccagacagacgccccgagcctgtctttctggagaaggaagtagtaataccttttccttgagggagttatgaggattaactgtgcctggccctgaattcgtgccttgcaggtacttaggaagtgagttattacaagcagtgctttttatcatccatagatggagatgttatctaygctataggactgcagaaagaattacagagaattatgtagaatcactagggacttgattaatatttgtttacctttcccccacatggattgatgtcctttattatacttttgtacccccgcttggcaagcccttgacaaatattgatccaacaaaaaattagctctttaatgtatacgtttagaacctgttgctttgtcagtagtggtttttatgaaaatgaatgcttataggtcagacttctggaaaccctaatctgagggaattgggccaaataggaaagtgagccccttaaaggcagttgtctgaccagtacttggagcacaacaggttcttgctaaagcactgtgtttttaaaacagtggagttattaggttgaaattctgaatagcaagaaaaagaataatggaagtgctgccagccccgtgatgctggtgcagctggtcagtttgcagaaggaggccagttactagagcagagtggccgtagaggctgcaacacggtggccaaagcatgaagctgctgtatagtggcaaggtcacagtgatttccccrcagcctcggtttagagggagacggggtgtgctgagctgtgcctgcttctgtagaaggggccttctccaagtctgagtagccttaagccattaggactgctgagtctttctccacaaaaatatgtgggaggcctgcagggcaggtgctcaactaagctctggggctgcaaagatccagagccatgcccctccttggaggcaggtccttgyagacgaggacaatcgtagccttcctgattaaagcaggaattgtccaatcaggctatatgacgggcatcgtccatagtcttcaccaggggagcttttctgactatacatctctagccctgtggcttgagccagtcacttaatttcccctgagctttggtttcctcctcctggtagcagagagactatcagagtgaggggcagatgcaatagcatatgtaaaacacttagcgttgggcctggtgtttaactgcaataaatgttagctcatattttactgtgacatagatgctgtatgccttttgctgagtattaaagatactgagctgtagcatgcatacttgcatgaatcagtctgctaagttattttaagtttgcatttgaaaataaagggtggattgctatccaaatataaagaattggaaccaggctctaaaaggatgtttgctgttctttagcaaaataccattcttcttaagtttcattcaatcattccacaaaaatttaagcatctgttttgtcccaggcaggcactgtgcttgtaatggatgtgcaatagcaaacagaacacttgctttcagctcacacagagctgactcctgggcagagaatttcgacagtaaagaaatacaagtgtgatgaaggagaaaccctttggtactacctgctacatgttttaatatttaaatgttgacttagggaggtctttccatctaaaaataatgatttgccctttctcctgtaaatgacccctttctcttaagttttgggtgagagattttttttttttaaggaagaaagatattctacaatcgaatgtacaactgagataatgcttaggagagaatgtatactgggtttgtgccttggaagttgcttaggggaaacagttgtgtgcagttggaaagctgatgctttaaagaagcttctataaagtgaccccacaattaaactgttttgtgtacatctttatttatttatttatttattttttaattgagacagagtctcaccctttcgcccaagctggagtgcagtggtgcgatctcggctcattgcaacctccacctcccaggttcgagcaattcttctgcctcagcttcctgagtatctgagattacaggcatgtgccaccacacccggctaatttttgtattttcagtagagacggggttttgccatgttggccgggctggtcttgaactcctgacctcaagtgatccacccacctcggctttccaaagtgctgggattacaggcgtgagccaccacgcccagcctacgtctttaaaaataaatgtaaatacccaaggctcacagttccgttcttccatctagtctagcaccgtccagtggaagtttccaccatgatggactgttctgtggatgccctgtccagtacaggagccgctagccacatgtggctatggagcacttgaaatgtggctagtgctacggaggaactggattttggatttttttaaagttttaatttaaatttgaatagctacatgtggctaatggctactggacatcacagatctaacacaggattaactgacaaaattctttcctcttaaaaatatgtgtttattttgataaggataactgagacctgtacattccatttttcctgtcatatttagggctcataaagggggtggtatgcacgttttaaaaaatgcaacacaaccagttaaaccagctgtctaattgtacacatttcctggagctgttggtgttgattattagcaaatactaagtacttgtaatgacctaagaactataagacaagcaagtcgtcttctgtaactgagtatcagcggattcaagcgttaaggaaaatgattaagagaaaacaaccaaaaaagtcttaatggttctgtcaatcaagtggctatcaattcatggctattcaaaagcttttgtggctatgaaaataaactagattgaaaaaattctaaaacaaaattgaaacactcatttgagtttaaaattttagttgagttgatttttatttcttgttttggttcatttgtagtttccccccgcttcgttgtttcctcagatatggagaataaagcctggctggtcagtttcagtttttatttaaattcattttrtcttcattccttttaatctagcacagtcctgtgatgtattgggatcacagtgctctggggaaacattgaaatataaaaacattttcctgaaaacatttccagttatatttaattttcctccttgaatagaaaaatatttccaacttaatcctccctctcccctcttgaaatgaattgcatgctttggaaataacatcaatccacccaagtacacaaggacaatctcagccatttaatcgagatataaaggcttagagaactctgggcttcggaggcacagactccacctttcaggatgctaataaacgtggacgaggtctcgcctgggcttcctcctccattgttcagcgcagcaaaccagcacagcactccgtggccagggtttgcggggagaaatctctcactctgttttagtagcatcatcatccttatcagcaccctgcttttatttttgaacagccaaacttcctctttccaaacttcgtgtgacatctgggaccagctatgtttgaaggagtctgaacatgccacatagtggctcacgcttttaagggaggaaggccagtaagcctcctcaatggcagaattctactttcagtctaccctttggttctgttgtggttgttccttagaactttattctgctcattaggaagcccagcctccggggagggtttagcttctcatctaagcaagaagtaaaatgtcataatggaggaaaaaaaaaaaaaagtccaaactttttttggacttttagaaacacatccagtttgagctccactgagctatcattgcagttacaaagcccatgtatattgagatcggtgtaaaaattcagcatgtccacctgcataattatgaccagtgtattgaaagcacatttcatttagttttgcaacagccgatgaggtagattctaccaacattgttttacggaagaacaaatggaagcctggaaaaataaattgtctacctcacacacttcgcaggtggtaaacacaggatttgaactaagacatacttgattttaaagtgtttgcttttcctttgcactactgcatctgcgatgtttgcactcagacactctagaatatttggtgttgcatgtttttgccccaagaaagaacccattaaaatgaaactttccagttcgtaagctttgccctcaagaagggaaagaacttcttgcaaggtttctgaaacaaaaagaaaatgaaaagtaactttactgtatctgggttttctgattaaattacggtttttgcaagcttgtgcatttctcagtgtccagatagccaggatttttccttttaataaatatcactttaaaaaacaaacacacacattcttaaatgcatgattaactgtatagattgatttagttataagatgtcctagcctaaatataagaaggtgtatgtgttagaattaatttcttcaataaagagaaagaaattcaggaattgtggttctgttggtcttctgtactgtatatttttgtgcagccaaagcagcatgccttgcttcttggtttcatgaccacatgggtagtttcttgaagttttttcttttgagatggagtcttgctctgtcacccaggctggagtgcagtgacgcgatctcggctcactgcaaccttcacctcccgggttcaagcaattctcctgcctcagcctcccgagtagctggaattacaggcatgtgccaccatacctggctaatttttgtatttttagtagagacggggtttcgccatgttggccaggctggagtttcttgaagtattgactgatccttgactctgaactgtatgatcaaagacttttgaaatggcacaccgtttcttaacatttaggccaatttcagttgctcatatccaaaaataagtcatgattttcggagtcagtgcgcagcacttagtacaacaatccaaacccttgtacagaccatcctagtagaaatgtggatcttgagtatctcagcttcttagtagattttgaactccgtgaaagcaggagccaggcctctcamagcaagtctctccaatatgctcagtaaatatttgtcagatcgagcaatgaccagatgatgaaatacattaaagccttagggagaactgagactactgcaccagtttttgtgcactatcatgctggaaatctttccaacatgtattctgtacttctttgcttcttactccagtgaatataatttagtcatttctggccaacttgaggacatcagcgagcataaattgttgtattatgcataatacagtgataccctcaaggctgagtgggaggcagtttgccctctgctgaaggtttcttgtgcttattgtgttcttatggtttggttttaccatttttatgtctccatttctgtttaatagacttatttcagtaagaagagaaagccgtctccatcagcccctctgtaggtgattatttgccacttcctttttgctgtgagtgctttgaaaacagatttctaagcttgttagagttatgtgttaagagtaaataggcagtaagtgaaaccaagcttcttcctggtgcttgactaccccagaaatgtttatttgctgaatagttgagttctggaaaggtgaggtataaatgtgtgataaatttattcctttgcatgatttttttttctttttcttccctccctccctccctccatctatgtctctgtctttctctgaacatctctccgtctcagtctgtctctctcatgatagttgctggaataatttaaatgaatgtaactcatttacccacatcgaagcccaactcagtagtgaaaaaacaaatcttccaaatgaatgcactttccccttgatgtgctatatacaagaccttggcacacctagttcaatgacatagtattttagaagggcctccttacaccttcctctcagataaatatacatgcagggacattctgaagaagtttgttatcggtcttctcccctcctactattagctccgccctcctagtccttctctttcaccatgctgacccgcgtagggaggacccttacaccctctgcatgcagcgctggtgctccttagtgttcataaccccaacctccatggcctctctcgcagttctcaggttaggccctgcttctaggggacattagctttccaccctctactacatacttcctagttgttgcagcctttgcaagcaaaacttgttttcatttgggagacagcatggtctgacagagcctagatcctggggtgaagacattctgggtttgtatcccgtctttaccacctctgagcctctgatgctggacaagtcagcaagtctttgcaccttagtctcctttctgtaaaaaggagcttatggggatgtaatcagagaagccttagcatggctcttggtacaaggcacggaccaaatccatggtacgctcactcctttcctttcagtaatactgcctaaatagggcacatgtacctaaaaggattttgtacattccttgacagcagaattctcatcttctgttgcatatcccataatgctgggaacacaaaataaaaatggtagcttttcacattcacttttggcctcaattttttgttattccccaatgaggatcatttcatttggggctggtctccggaaaaaagtagatcaagcttttcagatgagatttgggtgaaaccctgacaaactcttttttattgccttccctaccacatagtggtggatcaggaaactgtagggcttatgatgctgggaaatttctgctaatgcaataaagatttttgctgttgaaagaatttgatctgttttatgtataacatgcagagagcagaagcatatattatctgtagcagatgatagagcagggtatatgggcaagttagaaaaacacagttctcactacatttgaagaaaaaggacaaggagttgtcacaaggatccaggagagtcgcacataattttctgtcgtgcattttgttgactgttcctctttgcatccttcaaccatcttaacttcccacttgcacctcgctggaagacaaatctaagctaaattaaatgctaggcaatatgtcagaatggaaagggccctcaacttgggatgcccggttctctaccagcctgaataaactccagcaacagtatttctctaggaatcatctgtaaaaagtagaggtttgtcatatctctaaactagggattcaccttatttattaagctatcagtgactttatcttgaggtgcayggcttttagtaactctggttcaagtgcaaggaatgcaaagttaagtgtatcattggaggtgggatttttgagtttgtcagtcatttattgatttgcatgtatccttatagttcaaaggtctttttctcaacttagttgatgatcatgctgtaagttgttttcttttgctttatcaacttttaaaaacgtttattaacttttwaatttgaaataatttcagacttgcataaaggttacaaagagtaccaggagttctggaacaccctccacccagcttccacagatgttaacatcttacataaccgtaatacggttatcaaaacagtgttcactccatactccagtgctgttaatctccagactgaattcggatttcactattttcccactgatgtccctttttttkgttccagatccaagagacgatcctacctggcatttattgtgttcagtttttctaattctgggacgttttcckgggttttctttagtcattcacgaagttcgcacttttggagaacatggggccagttattttgtagaatatctttctgttagagtttgtggatgtttcctcctkattaaatttggggggtacatttttaacttggagatcacagaggtgctgctgtttgtgtctttgcgcatcctgtcaggagatgcgtgatgtttcctttcctggtgctgttagctttgatcccttagttaaggtggtctctgtggcttcctccattatcattactatttttctctttgtaattaggaagaatcttttggaggtagatacttgagactatctaaacaagcattctgttcctcattattctttcacccactaattttaacatccattactgtgatgtttgccaaatggtgattttctatttctgttttctacacttagtaattggattctactctcaggattttatgtattttttaacagtgagggacataaactttttaactagcagtggcaagtccacttttatttgggaggacaattactagtcacatgaagaagaaaaaatatgcagaascttaagaaatcccacatatgaatgttatttgaaatgttcttgccctttctccctacaaaggaggtgaagaagatgacaggagatgttaattgccaaaatagtctcatagttttggtcctggctgcaaatctctcgtttttgatactcaagagaatgctattggggaactgactctgaagcacagcccagatgcttgagatgggttgggaaggtttacatcaacaccatgaatttaatttatcatgtgacattttatttctgagtttttaaagctgtaattaaaagaagtgttcaaagtgttgctttcctcttttagaataaacgtggctgggtgtggtgcctcatgcctgttatcccagcactttgggaggccataggcaagaggattgcttgagccaggagtttgggaccagcttgggcaacatagggaaaccacatcactacaaaaaaaaaaattagcctgtcatggtagcatgcacctgtggtcccacttacttgggaggctgaggtgggaggatcacctgagttcaggaggtcaaagctgcagtgaggtgtgatcatgcccctgctctccagcctggacaacagagcaagacactgtctcaaataaataggcaaacattaccaacatggcaaacaagttggaggaggccccctatttaattaaatttcagcagtcccaaatctaattggtatgaagaaatcattattcagaattttccatcactgaaatactaaaatcacttgttgtttgagacatcttggcctgtcacccaggctggagtgcagtgttgctctcatagctcactggagcaggagcctcaacctcccaggtttaagttaatgctcccacctcagcctcctgagtaactgccactacaggcgtgtgccaccatgcccagctaattttttaatttttcgtagagatggggtctgtgttgcccaggtccctcttgaactcctggcctcaagctatcttctccagtcggcctcccaaagggctgtgattacaggcgggagccacagcgctcagcctaaaaataactctttagccaaaagaaagttttaaaaaattgtctgttgtattctttgattttactctatgtggtcttttctattatttttaaaataaaaaagatttatactcctcaagtgtaacattttatcaaatctcatgcttctgtttgatgaaaccgaatggctaaattttttaaatatcatgcaatccatcccagtttgtaattttattatggccctcacacaagagcgtgcaagctatactaagcttcctgtggccctcgtttttcctcactgatatttgtaactcattccaaattaaattttaggagtctgaaatgtagctgttatatttgggagatgtgaagaaaagaatcgtaggcatctcagtaggctaggtatcagatcacacatgcttgctggaccaaagaggactccttacagtaggatacatgattctgagttagtttgtgtactaagtatatactatatagcttttgaaggggagacgggcacagaattcacaatatcatgcactaagggttattttgtgtttgcagtttccagatgaatgttttaaagttggctgcagaatacagcgagataggtaaaatctatttgagtattacttacagaccccaaaggatatcccaaaggatatgttggactaattcctaaaatatcctgtaagtcattgcaggtacaggcgtggatctgggtttggaaacgccgcctggatcgctggctgggctcctgcagccgccaaggaggggctggctggaggtggggctcggcgtgcatagcggccacgtgactgcgccccggccacgcccaccgtccctcacgtggtcccaggccacgctgggcttcggcatgtgctaaagtggatagaaaagggagtggggcccgggcgtggctttgtggtttgggaagatatgaactccttggggtttttttctcttttaattctttaattttgatatttggaaatgcgtaaaaggtttttcatttgtccttgaccacgtggtccaaacctcaatttccctagcagaacgcggtttcgatcactggtggatccgtctcacagcaccrgtcatgctgcctcgctgggaagtggagggctcaggattcccgtggttcacgatccattttatgttggaaggaaatcattttgaactatctcagtacacaccctagtgtatctttaaacctaattgagtgttgatggaaaatctgcggtccgagaaccgtaagaaaagggggctcccacctcccgctctggggtcgccacttgcctcgcaggcaggaggaggctcccagagtagatacaacttgcccgtcaccyggatgggttggtagtgcacatatgcacggggcgcagtttaaaatgaaagtaaaagatgcaaatgtgtttgcaaaagaaaaattaacataggatacgtgcgggcgttctcagttgaactcggtcttactgttccacgcgagcaccccatgactcagagcccaaatctcagcggaacagcccaggacgctcctgccgtccacaggaagacgcctctgtctctgtcccccgccgccaccacacagatgcacgtactctcttcacttccgtgtacccagtaaatgcagatcctgatttaaatctgcagcaygctgctttcttcccattgcatgtgggaagcttcaggttctcttcggtttattttctcatcacctttattaaaatgcagtaaagcaaggagtatattaatgcgggcctctgcaaatagagggaatttattgaaaagcagaatggcttgaaagattgaacttcatcttaaaaatcagaaacagactcttgttattaatagctttagaaacgaaaatctaacttctgataaattatttcagaggagtggttcaaacgtgtagtagatagctctgcctggtcatcaattatagtgacgtccttgcatcagctccagaaactcagaatattcatgagctttccagtctgactcagaccttcaggagccatgaaattttcctgttgggatgagaggaagcgctggcggtcgtttcggcagcttaatgaaaccagaaatagataagcacgagtgaggggtgatgtccgcttgtttgctcccatcatgttgtttttaatgtgtgaaagtgaaagttttaaaagtcatactaaatgtgtgatcctttttagaattcactgggtacgggtacgtggaggaagtgtttttgtttttgtgaatttgtttaaacaaatgactgaggctttgttttccactctgtctggccaagcaccattgctacacttttttaaattcatgacatcctgagcagtgaagctgttcttcagcccgcctctccatttgtgactggaagacaaggaggcagacaccaatggcgcctctcacaatggaggtttatttttttttaatctaacggagggattgtagatggtgtaaaacttccttgtgccaggagagaaagggggagagagagagagagagagagagagagagaaataacccattctaaacaactttaggaatagatgatccgtaggcatcaactttgcgcagcaacaaaagccactttctgaacctcgttctgtgaagttttaaaacaaattgggtttgtttaattaaaatatttcttaaaggcaaaaagcactgagctaatttttaagaattttaagttatatattaatatgagtagtgatttataattttctgttgaaatacataaattcgagaagccccacccctaccacttgccagtcttgagtccccacggctcctttgcctaggtctaaagtcactgcttgcacactcctgccttgcatatgccttgccatcgtgtgggcctcttggctggaagtgttcttgtcctcccgttaggtatcttttatgacgtgaatccttacctctaattattatctgtgtgtacatctcatcacctgcatctgactgtgtgccttgtgtatgtctcttagccctcacaattgcctgacatgccttacaaacgggtagaccaagtgttaaatgaacaaatatttaataagaacttaaaagctttttgactttatatatttttaaagccattgtgattaaacactatgtttgatgtggtgctaattctgtgctttatcaactgtgtgaattgtagtatttttaaagtaggaataattgagaaatattttgaagttaggttaagcatagcagtaaagtttccactttttaaaatagccaaatccaggccaggcgcagtggctcgtgtctccaatgtcagcactttgggaggccagggcgggcagatcgcttgaggtcgggagttcgagactagcctggccaacgtgrcgaaaccccgtctctgctaaaaatacaaaaattagatggttgtggtggtgcatgcctgtaatcccagctactcagagaagtgtttgaacccgggagttgggggttgcagtgagttgagatttcaccactgcactccagctggggcaaaagaatgagtgaaactctgtctccaaaaaaaaatcagagcgtggtggtgcacacctgtagtcccagatacttgggaggctgagatggaggtcaaggcttcagtgagccatgatggcaccactgcactccagcctggacaacagagtaagmccttgtctccaaaaaaaaaaaaaaaaaaaaaaaagccaaatctgttgggtttttttttttgggggggggggtcctttagaatggccctgacagatctttaaggcatggaaatgagccttatgcaagctcctggcaatcagtatgtgagttctgtctccttggcaagatacagcctcttagaccctcagtctggggaaataatgctgatttctcctacgagttacgagaattacgctagaaaactctgtggcgcatacaggtgccctgtagcctgttggttagaagcactgaccctgaagtcaggtcgcccaggttggaattccagctctgccttcttcaagctgtgtgactctgggaagtcacacacactctctctttgtgcctcaggctctggttctgaagatgggaacggcaggccctccctctttggcttgttgcacagatgaaatctgacagcgtatgccaagcgcttagcacgggtagcagtgagtgccccgtaaatgttaggtaccttcctactactactaaacattcattcttcccttccctgctagtacctgcagctctgactcatctcacacccttgagagaggattatcttcattaaaaagtttttggtctgcccagaagcaagtgttacctgtgagagagctgggcttgtgcataggttagattatttctttgggttattcctggggaaacctgcaaagaaatgcagccagaggcctctggttcattttactgctcatctcctaaaagtggtttctcagatttttatcctttttttctctttttcgaggaaggggcaaggaaatattttttcatattattcttgtcatcgtctatttatttaataacagttgactgttgaaacataggaaagtacttatccgccaggaaactcccttctattattggacttacttgctttccatttatatgttgtctaattccaaagagatttcgagacagctttcaattaaaaaaaacaaacaacaacaacaacaaaaaaaamcaccacatrccgcatgggtattacacaggacctgtatggtcaaattggcaacgaccacaccacatgagaaggaagattattcttcctggaacctggctcccttgagattcttttttttttttttttttagacggmgtttcgcccttgttgcccaggctggagtgcaatggcacgatctccggctcaccgcaacctccacctctcgggttcaagcgattctcctgcctcagcctcccgagtagctgggattacaggcatgtgccaccacactcggctaattttgtgtttttagtagagatggggtttctccatgttggtcagggtggtctcgaactcccatcctcaggtgatccacgcgcctcaccctcccaaagtgctgggattacaggcatgaaccaccgcactcccttgagrttcttgtaagccaaggcagaagaagagacatcttaaagtctgtatgtgcacacctgcctccccccattttatatacaattcaagggctttgcttttggaaagtttgcctatgtagtcgtccagggctaaattaacacctgtctctatctgtgtgtaaggctctctgggaggagctgtgaggcaaataaaaataaggaatggtgtcccgcaaggagcttacaatgtgtgcattacaagtatatactgagcatggccctgggaacacagtgaaaaaacaggattcctgccctagtacagtgtacactagtggaagagagagaggcagtaaacctaaaagtaagtcttttaaaaactgtggtaaaatgcacataacataaaatttaccatccaaccgtttttatgtgtacagttcagtgacagtaagaacattcacattgttttgcagccgtgaccatcatttatattcagaactcttttcatctcgcacaactgaagttgtacctattaaacagtaactcctcattctctcttccacctaggccctggccaaaaacaaaaataagtctttgattgtaaacacgatcagtgctttgaaggagatgggaaggatgttatcataaaatgatggggctgcaggaatggcacctactcagagagggcggtcaggagagacctcttgggaatgatgacatccagcaggcaggtcattaaggcatctctaggcaggtccagagtgcaaggaggcataagccaggcaggtggaacagcgtgtgtgaaggcccagagtcaggaaatggtctgcttccttccaaggaaaagaaaacagccagtgtggttggagcaggggctaggagagaaaagatgtgcatgtgtgtgtgtgtttgtgtatccccatcatgatttagtactgtcagcgcttctgtgttctgaacctggagtacaggcagacacagccgcatcccagaagctcaagagtgcccataccaggaaattacagaaatctttgccaaatggatgartgaatgcaacttccttgatacagggtcagagaggggaaatctgagaaaagcaggtgggcaatgtactcctgacatactcccttccgttgcaatggccttgagtgatggagcaagagtgaaggaatgttcccatggcactggcaccaggatgactttttgtgaagcagagcagttggtcttagatagtggaggtgcgggaggcatgagaactgggcagtctgacggctgcaccagccagttggctgtcctttccacctccatgcccaggagctggcccagggcgcgcatgcacaaagccagtgctcttttcaatcagaaaacagcctgcgtatgttcttgcttgcaactcagatatccagcccactgatccaggaagagattcctttgacctgggaagtcataatggcagatatttaracccagctctcaagcaagcmtccaagttgttccggtgaaccygtaactttgagtaacctctgattgaaccagagagtaggaactaggtgcagaaccttgttgaatagaattgtttagcatcgtccatttgttagagcatttcaggatgcctgtcctaaaatttggtatcataatggtatttacctctcactcacctccatctcagcccagtaattaataacaagggacttgcttcttcacctgtttctttattggttgtaggaagtcttttccttaccacagaggaaggagcttctggatccctttgctacgtccagagagttttcatctaatctgggtgtattagtccattttcacactgctgataaagacatactcaagactgggcaatttacaaaagaaagaagtttattggactcacagtttcatgtgactggagaggcctcaaaatcatggcggaaagtgaaaggtacatctcacatggcagcagccaagagaagaagagcttgtgcagggaaacttccattttaaaaaccatcagatcttgtgagacatattaactaataacagcaagggaaaaacccaccccatgattcagttagctcccggcgggtccctcccacaacatgtgggaattataggagctacaagatgagatttgggtggggacacagagccaaaccatatcactgtgtaaaagttgaataaagttatttaggagcacattgtattgggagtttgtttgtttgttgaagagccaagtaaagtcattggaagcatgggaaacttttttccctgtctaaaaggaactccttcctagtggaagttgaaagctttcttggcagcctcagcccccaccctacctccaccaccccagtgggtacctgcatcctgaagacccttcacaatagcatctgaactatactgggccttcaaatgatgtcttgggtaaacccatgtccaacctgcactaaatgaagattattttcgagcgaatggattgaagaacagtgctgaaaaactagaatttgtaatattttcatttgagcagaggtgaaatttgaaatattttagaatcttgtcttatgattttttttctttctttgccacatagccctcccctggaaattaaatctgtggattactagtatatgaactgatcagagacatggcttggggtctccccatttacccacttcccagcacgttataatccactggacacctccaaggatgagagaccagcgggtcataatgcgagactggacatctctcctaccccatgtacacttcagctgagcaggcagaattagcagagtcaggactagaagttcagtctagggatcaaataataatagtagctaatgtttaaagagtacctaagatccgccaggagacatactcagtatagttccgtggtttgccacatttcatcttataccagtagcacaggtgaaatttgtcttatgtgtatactgaggaaaacaagtccctctgatacacagcagccaataaatgacaaagctgggatagaaacttacttcattctaacccgagagtccctgttcttgcatgggcacagcctgccatccccatgctctgcctcctaagcagaggatgaacttaagcatcttaaaattttaaacattgactttccctaaaaccaattaaaaaaaaaaacaaracagacagacagacatgacttgtgcccttaaaaatgcagccaggctggcatataaatgggcgtaggctgtttctaaattttttgctttaaattttgccagcatagcttctggactggtagttttgtttgctttttaatatatttttgacactgtgtacagaggaatgctacctcgcgtcatcatgtcctcctccctgaaggcaagccaaggatgtcaaggggccacttcaggggatgtgcaccctgaaggtaaagctgctccagtgggaggggttggggtaaatgacaatgttagcagctggtaaatttttttacatgggatatctcacaagacttattgatgcatgttatacgtaataacctgaggcacatcaacattttccactttttcctattctttctgtattttcactgatactttttttcaaaaaaatctccaataagtttaggatcagcttcaagatttctctttaggtaaatagatttgtatttttgatggccatcctagtccagtgtaaagatatggacaagaaaccccacataaaggaagcaagatygctggctgctttctctaggtagcttgagttgtatactaatttgtagattatttctcttcatcgaaaaaacaaaacattctgcagagggcagtcatgtgtccgctgtgcctctgctcctgtgtgcaccataaaacttgaaagtgagccagaatttgaaaatatcggattgggatgtgatttctttaagcctctggctaatttaatataaagtgtttacacttcatttttctggcagtggattttctatgtaggtggtggaagatttcctgtaagttttgcaagttccagggcaaagagagttgcaatatgcaatatctttctgtggtcacaccaacagaaagggcgatttcttaacctgctgcagttaccatgtgtgtaggtggatgctggctattacagatggtatcctttcaaccctcaaaattgttgcaagttcacaggtatgttaatgaaaatgaataagtggcatttttaggaattccaaatactgagtcttggaagtagataatcttttccctaaatgtatgctccggtcagaactgctgcctaccacacctcgtgggtgaaacagatatttcgagcatgactgagcttattaagagccctgcggcgcttcctctgccgggggtttagaaatttcaaaggatgggggttgagggagggaggagttatgggcatgtgatgtggacagggcgggcaggaggatggaagtaacaggtccaaaatgtatctttggtggcccggcagagctcttgcatggggtgagaatggtaatttaggaagagcaagtcttcccatctgtgaagcagaagaaaaaagtggacttaaggagaagttcgggtgctgtttatttagataggagtaaggagagtgcagttggggaaaagcacttcagaggctttacttagactagcagaagtctgtttggcagggtgggaagcaagtgcagttgggagaaaaacgttttcaataggcagtttcagaattggaaattggaggagggcagtccatttcaacatttccaacagtattaaagaaaatttgcgggttgtttgtcaaaaggggtcatatgctttaaagattgagagatcttttcggtgaagtaggggagctggggacatcgtgatgtgacaagagccgtgggctcagaggctggggacctgggtgtttaacccaactcttgtgagtggtgtggctttcatagctttggttctctggtcttcactttatctgccaagtgaagacatttgactggatgtcgtgatcttgagttgctttcagctccagawttcgaagaccccttccattgggcattcatctaatttcaaagatgctccctggctccagctctgcagtgaagcagaacaaactgatacagcctagcttgggggtggggagtcggccctccttttcccctcccttcccaggtcctctgggtgattgggggaaactgagaagccgttctcttctccagagcactccatttaacaagcattgcagagcctggctcgtgctgcagtgaacaaatgctgacttcagcctttaccctgggtttcaggtcacactgattgtttgcaaaacatgttctttttttgtcacttgccagtacttgttctctgtgagtaaaacacaaacacatcctcagggatgttgcacaccagtttgcagcctgcagcttctgccctctggcctgcccaggtcctcggctccgggacgaggatgctccgggatttcgggagacagcagttgttttgacatgaatctcaaagttcctacaaagcttatttctttgaagaaggccaaaaaaaaaatgaaacattttcagatctttgttttcagattattcaagtccagaatgttggataagatttttgaagaagagatttatgcttgagattccttttagtttctttctttcttttcttttcttttcttttttttttttttttaggtgacttggccagtttgggtttttacggtgttcagggaaagggttaagaagttaatttgggaagtacagtcatgtgttgtacaagttgctgtctactgatcccttcattgagcaagtaaacttcacacattctcgtgtctgcaaagcatgtggatgcatgggcagttatgtgtatgaactttttttttttttgagaatggctttagtgttcagaccaaggatggaatgaaagatcacgtgtgctttccactgtagagctgccctgcttgttttgattttatagttattctaagtgttaagttccttcatctttcaaagcaaattcctttgatccctgaaaatcagctaatgtttgggaggcaattaaaagatgaggctgtggggttggggtgaaggcttccccagcaggaagagaggagaagcccactggatctgggagcacggtgctaggactctctaagcgtgacctccttcagtttggcccagagtggtcagatagtttgccggggcataggatggatgacaggcytcatacgcatcacgtctgaagggaaagcccttgaattttccacgctactttttagtaacagtaggctttgtcataattggcttcatgttccagctttcctaaaactgtaagtgatgttgggtgggccagcagcaaaataattcacttwacaatttgcatgatagtctggaatgaaccgaatacctaaaaccaggaaataatagtagatatttaatggtttggggatcaaataagaatttactcccagatgtttcctaattaattggaaaaagcagaaggttgctggaaggccatctccattgggcatttacaggtgaaattcactcttcaactaggattttactcatgggatgcctgtgttcttcatttgaacccaattttacctatcatctacaaaaaaagaaaactattaagagttaaaaaaaaaaaaagagagagagagtcttgaactttgaaatccttcatccacgttttataaagtgtggggtcagattttttccctagttgaaattgaggaaatgagagttgccaatatgattggatttgtactgccaagatggggttttagcacttctaatgcattctggcaaggctggtatacttgtatcaagtgcacagccccactaccaccacctctaccacccacaaaaataaaaactagcaaaataaaatatgagccaacagaattctgtgggaatggcaagtgttttgtttttgtttttagtagtaatctttgcgagaacattccaaagatgatagttttacatttgtatgtttttttccgaggcacttttgaatcatcagatagattaaatataagttccrtgtatttttgaaggtgggagtgttctttggtacagttcccccaaaaaactggttctcatgaggcttatgtggtaattctgttaacgagaatgtatgattatctgggatactctgttctgctctccatcctggataagagtttactttgaaagtctagttgatcttttgtgatttctgcacaatgtaaaaggtactttaacttcaggagatagggccagcaatcagatttgatgatggaaaagagtagtgtagcatttaagcataatgtatactctataataaatgtttacaagtccaaaagtgtgccatcagaaagtaaccagatcaaaggagaggtgaccagagaagctggaaagataagaaataaacaagtttcaaggttactgatctgtagctgttgctgtccatgcttcttggcagctttaattatgacagggagagggacccagagggagagagagagactgacttacacataaaggcattttatcacaaagccatctaaaacaaaagtgttaaaggcacaatgctgtgtttaaaaagcatgtacttctttaagagctcaaatttaaatatataatacaaacttaagatccaaggaagaaaatggacccaggacacgaagagaagttaacgccacaggtaatgcagatggccaagagatgtgtgaaaaagataatccagcctcaccaacagccacagaattgaaatgagatacctgtttctgcttctggcattgggaaagaaagaaaaatggcactagcagccttttttttttttttttttttttttycccaaaaaatttgctactcttgaggttctgtcaaaraatgtgctgtggcctctagaagcatttttaaaaagagactttcacaagtgattgtgcaaaattgtgaggtcactgaataggtgtgtatcctcctaaggaggtagcgttggaggagctgttcttgttcaatttactcagcacctgtgaagaggcttcactgtgatttgcctgtacaggtgtgcaggtaaaaatctaagttccacaggtagtgcaaaaaaatctacctccctaggtacctcgtacatttatcacagtttcctggtaaacagttctgctgttgttgacaaaattttatcagaaacattgcatactcttctctaaatagtagtttccctacaagtggctgtcttcagtttagtcgtttaagttatgttgacataaatgattatgtgtgtggcaggggcttttgcgtaggttgttgaaacattgcaccttttggactaacagtttttaccaaaataggcagaagtgacatttgcagccacagctgtgtggcattgagcgtctaaggtatgtgtaataggcagtgtatcggtagcattgataccttggtcaacaccagtaagccatgtaattgcccagaagtgggctctaacactagttttaggagatgcagccaaaacgacaaagctggaggcctctccctctgagcttggcctccacttggtcaaaacagtccccagtttgtccctacgggacacaggcctgccttgttaggaaatcagcaacatttaggagcccacaatacctcacataactctgtgtacagtaacagagaatggaaatagggctgtaagcatgaacaaccagtcaagttacaaatatagaatactctctcaattccactttagttagtcatggagggacagtgtgagttttataaacttataaggaatatacaaacagttccaaatttaaaataacttgaagtaacttttaagtgtgtgaaaagaatatttttttccaccctgtccatttaagcatctgtgacaggcagtattaagtgatgggtgtctttacgtacacatgcctgttgctcacagtactggggaagagttgcaaaatagtcacccattctgcagtgatttctctcttcttatttgtgaaagactcaaaaaaaaaaaaaaaaaaaaaaaaaaaaccaacaacaaaaaaaaggccaggcacggtggctcagacctataatcccagcaccttgggaggccaagtcaggtggatcacaaggtcaggagagcgagaccatcctggctaacacggtgaaaccaaccccgtctctactaaaaatacaaaaaattagctgggcgtggtggtgggcgcctataatcccagctactcgggaagctgaggcaggagaattgcttgaacccgggaggtggaggttgcagtgagccgaaattgtgccattgcactctagcctgggcgccagagcaagactctgactcaaagaaaaaaaaaataggggggatgtgggttgtgagagcgacactgtgtgtccatgcgtgaagaaacccggctcatgatgacctcgccccagaacgccgaagcagggccggtccagcctggatttcacagtgttcttcattgcctttgtccttgattttttgtcgttaccattataacttatctctctttcccaaatgtataagtaggctttgaatatgagtttaaaagaaagaattcggggatgatttcagagtacactagaatattttttaaaagaatattttataaaaatacagtgatagtaaaagaagtagaaggccaaattcygcccccagccccttcttaatattggactttattcctttgcttttttcccttgctgccatctaaggaggctttctgtgctatagcatccagttcctctgccaggcatttctgtaaagatgaggcaccttccactgttttattctccatcattagagcacgtgtcctgctgactcggagcagaggggaggcacacgggggtgaacattccctgacagattggatgtctcttaactcttttttcctggtatcaaagaatggcacaatttagttgatttgatagcgttaccaaatcgtttttcctttagaatgaatctagaatgcagatagattctgaggtccagatgggcctctctccaccaacctgtgaccagtgtacctgtgattttatcactgcacattcatagaaaggttacagggctaatcttcccgtgatatgaatcatgaaagtcaaaatttatgaatgaaaataaaaaggaatgaagtactgatatatgccacaccagagataaatattgaaaacattacctatgctaagtaaaagaagccagtcacaaaagacactacctattgtctgattccattcatgtaaaatatccagaataggcaaatctatagcgacgaaaagtgtaatagtgattgcctgggaaaggggcgtgggaagcatggctaacgggtattgggtttttctttggggtgatgaaaatattgttaagattaattgtggtggtgtttgtacaactctctaaatatactaaaagctaccaaattgtacactctaaatgggtgagttatagggtatgtgaattagatctcaataaagctattgtaaaaaatgtgtgaaggaaggggaagcatcctataacctataccatcccaacagcccagctagaggacgattcctgagcctccttctcagcctttgtgttaattctttgcattgatgacttctctctctttacccttactaattagctctcaaaacctctatttaataatgatgctatttataactttcctccttctggtttcttgcttgccctttttgtggtgtttgcttgtttttcttttttctcaatactctgcccagcgttgcgtgttggttccggagacttaagtgatccagtgggcactgtcaggcaattatttcttttgctcattaattaagtgttcacagatacattcagcagccaaaccttgtggcatgccttctgtcccagacagtgagaatctacttggaacttggatatttctgtgagccttgattatatacaccaccaaggggatggcatagaactaagttttttcttcttctccacaacagactttgttctttaatttcacaagcttgacatagcctataagacatcatagtggtaccatagacagttttcccttgatgcccatgggggatttgttctgggacctcccacagataccaaaatccacaggtttatcagcaagggtcactgctcaattgcaacaactgaagcagaagctcctctcatcagaggcagttactgcagcatgttctgtagggcaaatataaccatatgtaagtgactgtgctatcaggagacagaacaacaagacccagaaagactcagtgacccacagagccagttccacccaaacaagtcttastaatgagattagataatgagagtgtattttcttcatcaattcatgtagctcagcaaggctggaaactgcttgcacacttctgcagagaaaaaaaaaagttccatttgctggaactcaataaataaagaaggccttagtgggtacgtgttatctccttagcatcacctggatgcctgacccttttccagagtgtcatgttgcctgggttttgtccttcagtctaagtgatacacctcttagtgtggcggagaaaagggtgctgtatttcttcctgatggatacatgcttaaatggaaaagtagcatgagatgaactcccatagccccttccttttattatttttaaaatattcattcatttatttatttatttttgagatggagtctcactctgtcacccaggctggagcgcagtggcgcgatctcagctcactgcaacctccgcctcccgggttcaagcaattctcctgcctcggcctcccgagtagctaggactacaggtgtgcccaccaccacacctagctaatttttgtatttttagtagagatcggctttcaccatgttgaccaggctggtcttgaactcttgacctcaggtgatccacccgtctcggccttccaaagtgctgggattacaggcgtgagccactgtgcctggccggcccttccttttagacaatagaaacatgctgcaaccacataccaccataaacacggtgggggaagaggctgcaatcaacagtcaggaggatctgggttccaagcccaggtttgcagtgtaacagctgtgtgctcttggtgygaacatttggtcatgtacaaatgaggataatgatactgcccccttgtgatcattagggggattaaattaaatgcagaaatatatgtgagatgcttaatgtgttgtaaggcgcatggaatatatttagtgaatattaactgtatattaatacaaagtcctgtattcagaatctccagtataaattacatttatatagtagagatatgaatagtttttgtgaacaagaagacctggaacttcaggtgactagaagctcagagtgagccagctatgtttgatgatagttattcttaagatcacacagagaaacggcaagcaagctgctttgggcaaaaaagagcatttctacactgttcagactgcctctgtactgttagaataggtctagggcgtgttgcgtgagtggtgactgagtaagatgttcagagggaagccgtgaccgtcatcttggaatattgtttgaaagtctgacctgtacaaagcagcactcacttcccctgcgtgtcagacacctgcatgagggctggggagggtccagtacaggaaagcgcatttttaatatgtgtatggaggaagttcgtcaagatgggtgccatctggcagtggagtagcacttcctggaaagtaatgagctcccttggactttgtttgaagagtcacccaggtttttgtaaagaagtgtttcagatcagtatgcaatggatgactgtaaatttctcttcagatctaagaatctgtgaytggatgaaagggagaaaggactgcataagtgcttgttgcttgtaaactgggccaggtggatgtcatggccctaggagcttcttgcctgcctttgcatgccataaagcagtcctgcaacccagtgtcacctcagagggatgggaatgtagaagaagagagtgaatagggacagtgatgaggggtgaaaatatgtaactccttgccccttctgtataccctagtacattaggaagttcacccttgtctaggcttcctgttaggaagacagcagactcaaaatggagtctcaacccctttcaaagactgcaagatctccttgtacacactggacttgggagaaaatgagagctttcaggcctgctatcttaacaggttcagaaaggtgtggtccagccccctgactaaccagccctgctgtgcacactgagaattctgctcaggtgtacctttctgtgtgctcctgggtgcacccccaaagtgctggttctcttgaaaacctttttatttaggttcagacagacaaactgtggtatcttccattctgaccataaagtgtttcttctgggtctaactactatagtgggatattttctctagaacaagaggttgtttctttttggcattgagaaatgttgccgatgtgattttcttttgtgaacgtttaagacacagcgcttgccacttgaactttcttttgccgtgcgtagctgattccacataatggctgcagctccaggcagaaacctgtttggaagttgttttaaactcttcctggaatctctaggcagtggctcagtggggtttttttccaaccattccttaggatgaccagaagcttgacagaatcctcttgtcttcattttgagaaaatatgtctttactgtgtgtatgtgcagcatttggttttacctcgtgggtctaagcattttcaactaagcttccttttccaacctagcagacttgtttaaagaacttcaaactaatagccaagctgtaatacggtggctctctcagcctgagaagcctgtgctcaccgtcactctcttcttccctggggtgatagggatggggagtagtgtgtgtgagaggacagaagcgaggattgattgaagattattttacgaggcgagagcatggtggcacacctgtcagctgagtggactcagcgcctgccccggctaggctgtcctcctcctgtgccagccgtgggttccctgagtccctctgcagtcattcatgggtgctgaaaataaagataccctttctgtcgaaagtgttcgccgggctgcctctgcctccctggaaaagcagcagggcacacaggcttcctaggcagcccctgagggaggggctctttttattgtcactctggttagtttgaagaccagacagaaggcagcaaaaaccaaccctttgttgaaaactctttgcctttaggcccttggtaccatgttcatgaggctccagataattccacaaatacattattattgttacctagacttggggacagagaagggtgaaacatgggtctgggaattcacagatgaatatactgtaatcccctcgagcacatttcttttaaaggaatgggggtattctaaaggagtgaacactccactggggggctgctaggcccctgtgaacggtggcagccttggccacggtgtgtgctgtgatctctcctgggtcccccgggcatcctcagacctcccccacacccaacccacagtcccttctccatccatctgctgaccacaccccaggatgtttccagctcagatcacgcctgattgcatccacacaaactgcacgccaggcatttccgtttggatgtgtacacaaaaacaacacgtcccagactgagctgatctttctgtacccctcaaaagaaaagttctgtacccggccaggcctggtggctcacacctgtaatcccagcactttgggaggccaaggcaggaggatcacgaggtcaggagattgagaccatcctgggtaacacggtgaaaccctgtctctgctaaaaatacaaaaaattagctgggcatggtggcgggcgcctgtagtcccagctacaggagaatggcaagaatccggaaggcaaagctggagcttgcagtgagctgagattgagccactgcactccagcctggtgacagagtgacactccgtctcaaaaaaaaaaaaaaaaaaaaagaaattctgtacccttccagatggtcctggacatatcttgaatctaccctgcttttcctcatctgcactgctgtcctcttgatctgggctactgaggctagaatgcacatctgatcatgtgcctcctgcttaaaatagtatttttcctcttaagagtagtccaaactcctattgctggattaaaaggctgttccaggctctccctacctcagggcacaccatctttcctcccagtctcccctcccctctgtctccagtgcttccatccttcagtcatgctgaggttgtctttgttacctttgcttctcttggcccgcactctctgttggctctgccagcatccctatgcacctgctagctcctactcacttgtccagctttggcctggaagtcccttcccctggcaggcagccctaagctaccctttgcttgctactggctcatattctcactgcttgtcctcaggctgtgagccctgggagggctgggctgagtccccgaacctgccacgtctatagggtgtaacctacctgaggcctgactgctaaaatcaaaagaagcctttctcatttgcttagctgagctaagtcctttctggagaagaatgcccacgtcctgggtggacttctgttcggcctggggcaggacgctgcatgtcagttcacctagagcccctcgcttgccctcacccctctccctttccttctcctccccgtgttgtctcatggtcagttcctctcctggcaaggcaagagaatcataaaatctctttggaccatgtgtctctctgatgcactttggaggttgaagctcactttcgtgaagttaggagcggttaatcctcctgcacgaggatgcatgcctgctagggaaagcctccctgcgtttatatggaacagtggtgtgtaccttagggcaacccagaaacagctgagatggccctaaactcttccgtattttgattcagaagctttaccttatttgaacatctgcagaataagttctttcctttagaaatgattggggataaaattgtttgcattatgaaatattgtatggccaggtggcccctctttcatgttttgttccttgtgaagaggttgagtctcctattttttttttttttttggagatagagttttgttcttgtccctcaggctggagtaaaatggtgcaatcttggctcactgcaacctccgcctcctgggttcaaacgattctcctgcctcagcctcccaagtagctgggatcacaggcacgtgccaccacacctggctaatttttgtatttttagtaagagatggggtttcgccatgttgggcaggctggtcttgaactcctgacctcagttgatctgcccgcctcggcctcccaaagtgctgggatcacaggcgtgagccaccacgcccagcctatggtatgcttttaaaaatggtttctctgcactaatgattatttaaaaaaaaaactctggcaagaacaaaaacaaatggttttttaaaaactctagaaataatttgatacattcgaggactctggagagggagagagttaaaggctgatgtgtgtgactctttttcctctccccccaaggaaaaaaaatgaagagaaggagcttttaagtgcagtgcctcgtttttatgtgattgcaaacctgaaccaatccttttagtggtggatgtgggacatgttagcttttccaacagtttagatgggcctttgtttttattgttggtcactgtaagaattccaaggaatagaaggatctcatgggcaaaatcagtttgcttttttctctgtatatttgttagtttayagcagcttctattttcctcctatttttaaaagctgaaatgcctttaatcgcactcagtgtgtttattcatggaagccagagaagagggtcccttcctttcccccatagcgccgtaattggaaatttggtagtactaggtgaaattctcagttttggcgctcgcatggaacagccatccatctgctggcgagacacactgcccggggcttttcaagaaatcccttaatggtcctgaacactaataatatttatatacattgagatgagacaaaatttacagcgggctctggggctggctccaggactctctaatcccacacttgctcrcgttctcttgcttgcctcctagaatcctttcaggttgtgcttcagtgaggggagcatggtgtccgtctctgcagcaatgcttatttatgcagttcgtcctctaacaaacagagcaactttccttttgaccttcccctcttctccccatcacattccattgctgcccccgcatagagcatgtgcttatgcatagtttgcatcatttaacacgaaggaaccccttgatttgtgatccctttaagaagttgctctgtatataaagaaaatgatttttcctggttggttttactgaagttccttcagaaatagctcccaccaccgaaacacacctgacttccccagcctgtgtatcggttgtggcacggactgactgactggatggtataatttcactcactcctttgggaagtttcgggggactactgctcagatgtgtgggaaatgcggaatatatctacaggtactttgtcagtttttttttttcttttctttctcatcctggaaaatcccggcattgatatttaggtataactatttgcaagcaagtgcagagggacatttttctgttcttttcaacgttcttattactactgcattaatagctacttgatcttaatgtctattacacatcattttatataatgttttctttaaattgtcagggaaagggattctgcaagtagatgttggtccccccagttagtgtctgatgatgatggtaagattctcagagtttccttcctctaatgacaaagcatggtgatggtgatgtctgaagagcagcctcggtgctccaagatgggtgtatgcttaatactgctggcacacgcctgacgagcgggaatgtgagcgttgtttctgtaaccagtttyactgaacctcacagatccattatacgacgtgaattttgtgggaataacataggctgggagtctgctctcttccagcctggtccctctcttctttcagccctaccctctctgatcatcatgtcccttgcactgcggccaggtaacctttctgatacgaaggtctgggcatgttgttcccttgcctaaaactttccatggtttcgtattatccacagttgggctaaaccctctgggacaggccttcagtgcctccccgggcagtggtccctggccttcttcagtaacacccaagcccttgcacccacagtgacctcgttgcttttacaagcatttacatgtgatgttctttattcctcccttgctcatctttccactttcaactccacaaaaccgtcctcggcacccagaagcccaggaaacaccaggcagctccactcactcccgtacttgctgtgtcgtccgttccctggggacaggattgtcgctgatcctgcgtgcatctgtctggcacacaggtgcagcacacattaaatagctgctaaatgaataaatgaagaatagatggaattatattctgttgtgaccagtttaaaaacatgaaattggaatacccaattgcagtgtttctttagatcttggaccttgaggtgacctctgtaatggatatatttgaaattattaactgtcttcaagtgggggtttgatgagagagagagagagagwktgtgtgtgtgtgtgtgtgtgtgtgtgtgtgtgtttacagaaaatatgctaggtttgtacattcaaatttgtgttatcctcttcaagaaagtcaccttggtagacagcatatatatcccaacattttaggaactcataaaatgcatacttttttggtgtgatcagagatgggtaactccttattacttgtgggttagattagtttttggaaatagcctggagtcattgagagccaatccttatcaacaaaatggcataaatggacaggaatgggtttcttcttcactttagagatagctctgaagacatgtctcagttgggattagttcagttgcatatatgaatagcagtcattgaaacaagataaaagtgtatgtctctcacatctaaagaagtctggagtaagcagtccagggttagcctagcggccccactctcataagggactaagttccttttatctcgcttcaccattcttgatgtttcgccttgtggtccaaggttggtacttgagctccaagcattactactgcattccagccagcaaggaggaggatggccatgccctctttgttctcaggagtcttccaggaagttccagtcacaacgtttgtttatatctcactggccagaacttaagtcatatggccacctctagctacaaggaaggctgggagatgtagtctgtaactggatggccatattatcaactaaaaattactgaaaatgacaagaagaataaataatggaaggcaacctgttgtttctgtcaaaggatgacttcaaaagagaaagttgcaaaagtatttcaagcttgacagtatcatgacagttttcttcagaggtgacgctattcatttgcatgtccaagttctgatatctgttttcaagttcacctatttgcagcgaaataggaactcttggaggcaactagtgggtgtgtaaaccggtacaaactttctagaggacagtttaacccaacaagatgaattctggaaattgatcctaatgaaatgttaagggtgctcatgaagattgctttgccgattgcaataataaaaagtaaagaaaatatcttataattggggacaggtgtaacttatgatacattccacaatggagtgtaatactgctgttaaatgtttgtggaattcacaatcttttatgccaaaagaaagctttcagaatggcttgtcttttttgtagatacttgtatttatatgtccatgcacatacataagaaaggaccagggaaggtctgcttgaagatattaataaaggggtcacttgtgggtaggtggacttacttgttctctatattctctttacttgtttgtgatctctggtttttttaatcatgtatttttattacaagaaaaaacaaattctagaatctccactcaatattgcatgtcagagtcaaaaagatacacatttaaataattttgtattgttttccaatttgaggataaagtaggaaatgtataatgcaaaccagatttcatattttgttgatttagacttaatttacaagtaaggctgacagcccacagagtgtgatcacgacagcattgttatggaaataaatgccagctcatgcatttgggatgtacaccatggatctgtggttattagatactgatttcactttagcacacgaagaggcttagcggaggtggcttctaatatcctatggttctgtgggctcggagatrctactcacccacttgtcagaggcattgaaaccagagcaactgcatcttgaataggagctaggtaaaatgaggccgaattcccagacagttaagacattctgagtcacaggatgaggttaaaggtcagcacaaaatacaggtcataaagaccttgctgatctagcagatgcagttaaagaagccggcgcaaacccaccaaaaccaagatggtaacgagagtgacctgtgatcgtcctcactgctgcactcccaccagcgccatgagtgtttacatgtcatagcaacatcaggaagttaccctatatggtctaaaatggagaggtatgaataatccaccccttgtttagcgtgtcataaaaatgggcaaccagcagccttccaggctgctctgtgtatggagtagccattcttctgttcctttactttyctaatcagcttgctttcagtttacagactcaccctgaattattcttgcgtaagatctaagaaccctctcttggggtctggatcaggactcctttcctgtaacacacctatgttcttggacttaagaatgaccctcagacatggtgacttctttgtcatctaacagctttggcttatttgaggtaaaacctttgatatctaaggcagcagaaatttccctgaagtcattttgaatggtatcatctttactatagtgtagtttaatcattttcaaagtaagcatttctgcacactaaggctttaaaagagttttcagtaaggaacatatttgaaatggaaagtgagcagagcacaatgccttttaaattactgataaaccatagagttcctgtagggcttccactggctgacccacgcctgaggcaaccctcaaatgtgggtattatccccctcattttacagatgggaagagagaggatcaagatcacagaagctaatggtttgtcccagaccaaacaaggagttcctaggagagactgaactttaaagatatcractctctgcaggtctaagtggatgaaaggacagtggtgggggtgaggatttcgtagtgtgtttttgcattgtctcctcaatgagtgatctggtgctggtggtagcagtgaatgacccagaaggatgctggccaggcccagagaaggcggtgcctcccctgcccggtctcatctccgtctctcctctctctccacagtgtgcccaagcacgtgtgggaagcgggcgtgcaccgagaacaatgagtgctgccaccccgagtgcctgggcagctgcagcgcgcctgacaacgacacggcctgtgtagcttgccgccactactactatgccggtgtctgtgtgcctgcctgcccgcccaacacctacaggtttgagggctggcgctgtgtggaccgtgacttctgcgccaacatcctcagcgccgagagcagcgactccgagggrtttgtgatccacgacggcgagtgcatgcaggagtgcccctcgggcttcatccgcaacggcagccagaggtcagtcgcggccacacgtgtggtcactacccgccccacctcacccgccaccctagcacacaaaggtagactctgtcggttgtttcatccgggtgcagccctcaggaagttcactgaggtgggtcattttgagagggctggcttaccttaaatgtttggtgagattctaggaacaattggcatggcttaccgcccccctcaccagtttgttttatattttaagtgcatactgcctggccatttgaaattaagtacttgcttgctggtttcgatacccagagttcatagtctctctgggtacttgccaagctgccatctaagagacagggaactgtagttttggattttcctagtctgggtgctgctagccaggtgaggctttggaagtgcaaaagaaaagacatgctaagcccccaccaccatccttgagaccagcaagcggacctaaacatcttagtgcaagagctagcagcagctcagagtaggcagtagcttaaaataagggacatttttccatcagcacttccttcctctcatccccctctaccttgaccctccctcagtgctcatcatgtccttcattttccttcctgaactttgagacttcacttgggaagcaaagaagttccttatggccaggcatgtggctcacacctgtaatcccaatactttgggaggctgaggtgcttggatcacttgaggtcagagtttgagaccagcctggccaacgtgatgaaaccctgtctctactaaaaatacaaaaattagcacctgtagtcctagctactccgaggcaggagaattgcttgaacctgggaggcagaggttgcagtgagccaagatcacactacttcattccatcctgggagacagagtctcactctgtctccaaaaaaaaaaaaaaaaaagagaagttcgttataacaaatgccatatgcccttttgtacrtgtcaactggacttctataaatttgtcattggtttatgcttttgaaaataagatgttagcattgtttaaaaatgtgataactataactttgaaagcaaaagaagattggagatttggggttgctgttccctttcctggagcagagtaaagaacttttaggggctcacgcctgtaatcccaacactttgggaggccaaggtgggcagatcccttgaggccatgggttcaagaccagcctgggcaacatgcaaaccccatctgtacaaaagattaaaaaaaaattagtttggcktggtggcacacacctgtagtctcagctccttgggagttgcaagtgggaggatcacctgagcccttgaggtcaaggccgaaataagccaaaatcgcctcactgcactccagcacaggcaacagagaccctgtctcaaaaaaaagaacttttaggaaagttctgttttagtggactaaatgcctccttcatgattagcaccagggggcctgtctttctgagtctgtcaaaatctattctacaaatataaaaatatcgttagaaaagtaggtgttaattttaaatataatttttgctgcagcttatgaagtacattgaggaagtgtttataaaggggattctttttctagtgtattatttggagacgcagcttctactgtaggcttaccttcaaatcaaagataatacattcttttatagtattagatgtagagcaactttctccctcttataatctgtataaccattagsatactaacaacaagaagaaaattactctgaatactttaaaatgataaataggccaaggacttcaatgagctgtagaggatacatattacatccaaaatcagtctaccacattgtactcacattttgttggcagccttcgagtgtaaaagggcttttactggtgcacacctcgggcccaggggcagtgcctggaaccaagttgaggctcagacactattcagacgtcaccttcctccttggggtggggttaggggagtggtagcttgtccatgaactcagtgtgctatcgtctttgttttgtgaatacattttcttaatgacatttggaggccttcagtcgttctgcagccaccagagttgtggcaaagtgggaatgctgtccatttgacagtgttgtttcttccgctctagtgcactcttcagagaattgagccattatttcccctattcattcttacagtccgttaaaaactatacatctacctttttgtttaaaaataaaacaccataaagaataataaattcccttctctcagcctttgaggcttatttaacaattactttgaaatatttaattttttcatcttgtttataccttctctataccatagtggatttgaggaagcttaatctataaacatgttatcaaaacacttccttagaaaaacattttttaagtgcttgatgactcctagactttttaccaaagatgattggttccattttttttttcttttcttttctctttgatagactctggctgtgtcacccaggctggagtgcagtggcacaatcatagctcactgcagcctcaaactcctgggctcaagtgatcctcctgcctcagcctcccaaagtgctgggattacagatgtgagccactgtacccagcttcagatttttctatttgagtgaaagatggagagaaactaaacatacacttatggtacaacccagcagttgtaaccctggatatttatcacagagaaatgaaatttatgtcaacacaaaaatatgtacaccatcgtccatagcagctttatttgtaataaccccaaattggaaattactcagatgtcctatgatagatagttagttaaactgtgggacatccacaccatggaatattattactcagcaataaaaaggaacaaaccattgaagtacactacttggatggatctcaaggacattatgctctgtgaaaaagccaacctcaaaagatcacatactgtataattccatttatgcaacatcctcaaaatgacagattatagccaggcacggcggctcacgcctgtgatcccagcaatttgggaggctgaggtgggtggatcacctgaggtcaagagtttgagaccagcctggccaacatggtgaaaccgtgtctctactaaaattacaaagtttggccagtcacagtggctcatacctatctcagcaccttgggaggctgaggcaggcagattgcttgaggtcaggaggccaacatggtgaaaccccatctctactaaaaatacaaaaattagccgggcctggtgatgggtgcctgtatttccagctactcaggaggctgaggcaggagaatcacttgaacccaggaggtggaggttgcagtgagctgagatcatgccgctgcactgtagcctgggcgacagagtgagaccctgtctcaaaaaaaaaaaaaaagacagattgtagacatggaaaacagattagtggttgccaggtgttagggacattggggactaggttgggcagggcagtgagtatgaacaggtggcattagggagagcttggtggtgacggaacagttctgtatcttgattgtagttgtgattacacaaatctacacaagtgatcagtgacacagcaccacacacacacacacacacacacacacacacacacacacacacacagagttaatttccaggtttgatacttatatcatgtaagatgtagtaaacattggaggaagttggatgaaggctatgtgggatctctctgtaactttctcgtaaatctttgcagctttttgtgactctataattattttaaaataaaatttttttttttaaatggaaagtttatagggtatgtagataaattagaaacaacagaaggccaagtaaaaaagtgctgaaggaagcctctacccaggctggaaatgagaatgttgaatgcaatggtagaggaaggactctccccatctgtgggtgggtccagttcctgtaggacccttggggaagccatgacccccattctcccaaacacacaataggaaaataccagagaagttttgtttacctgttagcttttaaacaaaacagaaccctgcatctttgtcttagatacaaaataaccttcatgggtagggggaagggacattaataaaaagagctataatttacattgtttttcttgaatgtttttacttcacgaaatttgagagatgatttaagaacaataatgtacatataatggctccccagcttaccatcctattacacacacatcgcataagttcgtattatttgtcttgtttggaaatcagtccaactttctgacccttgttctatatataactatagatcccaaaggttcagctgctgggctagcattttgtctgctatttcctaaataatggtaggtaagcaggaaaagtgccagtcttacttgtccctgactcttggtggttcgtggcatgttcaggatagtatttgaaacaagagctcattacaaagtaatggaaaccccttgcttttattgtgtatgcagcaaaagcaacatttggatcaatttacaagtttctgcaaaacaccgtcaagaaataatttcggttgtgctttagcaagaaaataatggatctgtgctataccacatgccttttggtatccctcactgggctttgccaaaacactgactgcaggagctagactactgttaggcagagacactgcactccctttgctgtccctgccttctctcctagcgactcctccaggtacacaggccagggtcacagtatcagaaagcagctctgttttcctccagaaccccccaagcttcctttctgcagcactgtctctcccacatggaaccagctggctcaccagtcaacagcctatgacacacaaatgccttgaggatgcagcatgtattttgtctggaagcaagcaacacgctcttcctttgtaggctgtttctccttttgcttgcaatgtgagtggcttatcttgggtgggcttgggggtgagataccatgtgaccacatgaacacttcaaaacagttgctttttctaatgcatgctgtaataacaatgaaaagcatatccttatggtttttttaatgcaagaagacagactcaattatgtgtgtttttgattttttttttcttcttcaacagcatgtactgcatcccttgtgaaggtccttgcccgaaggtctgtgaggaagaaaagaaaacaaagaccattgattctgttacttctgctcagatgctccaaggatgcaccatcttcaagggcaatttgctcattaacatccgacgggggagtaagtattccatccccctggaaaaacggctagatctcatggttttcttttgttgatgcttttcatgctcccgtccctgagtcaccactaaaatatgggcttagataaacaacatggtgtgtaagcctcacgcatgacgtctcttctttgagtttccctgaaagataaagaacagattgaaaggcaatctgtcttttagccattggcacgtcatttattcctgtaaagagggtcatcgctcatctttttgttagtcacatcttgcataggagaggcaagccctgacacatacaaaccccagaagagaccattggatcagacgtgtgactcagcagactccagctgtagccaaatccacacatctttcaagtctaaagagttttggttacttgaatttactgagaagactgagcaaagggaagtttagtgatatcacgttaaaattttatgaagtccaaaagaatgctagatttccaaatttacttgtgagagacaaaaggatacaagtgtgtgtcattgtgtacataaagtttcggtctcacccctgtacaatgacctttatttgcaatagatggcattcctggtaagttgcttctragttggatttgtgcaaaggatttcccactgacttagcctatgatctcttcacttctttggttttttgtgtgtttgttttttggttttgttttgagacagggtctcactgtatcacccaggctggagtgcaatggcataatcatagctcactgtaacctggaactcctagtctcaaacaatccttctgctcagcctcccacgttgctgggaccacaggcacacactaccatgtctggataattttaaaaatcttttcacttctgatttttcattgccaagggcttctagtaatggtgccttaaattctctgccactgggaccacttggtcaaggtactgatagttttataagctagaataaatatcgtaaaatggctttgaagttgaaaggaattttggggggggaatccttttatgaagaatttttttttttttttacagtttgagaggaaaaataatgtattttgagaatgtgttttccttaatatttgttaaatgagtagactgtattcttaaggtttagaaaggacagaaacaagtttgtgcttagttcttctgaattmgttgatatcccttgttgctgttcacaatacacccactcccagccctccgtgatggagataactctgttccccacaactagggcttgccsactctcatggtacttctgatgtttaattmttttggctgtgtctgcatttcctcrtttacttttaatttgcttatccctagaacataccttttgagtgcctaaacttttttatcttcctgtcctgaagacaaaaatttaatctgtgaattaaacccatggagaagtatcatttatgaagggattggtacatattgatgcatgatgatgaaatgtgtcttctggtttatgtccattgcaggaaatagattggatttaggatgatgggacatctcattagaggggaaatttcctgatcttgactaaggcatgcttcctgccccacgtttaaaattcaggatctcttccttaaaacatcaactgcacgcaacctctcatctttccaacttgaacttccctttaatttttcttggaaagctattaaattaaattagatgtagggctttatcctttagtacccttattattttatttgtatcaactcaaagcaaaatagagcattttattaaatatgtcttcataaattacgcacagtaaaatcccattaattggaccacacccagttcattatagtgtttattataattttagcattagttgaactgaaaattggtttttgtttactatgagaaaaaggtagactaaacaagatgaaacctgttgtttgcatattatgtttgtacatctttattagcaactatttttccaactattttcaactatttttccaactattttctagttataaaagcaatacataaatactatagaaaatttagcaatgcagaaatgaatttttaaaaatccctcatagatagccattgttaacattttggtgtattttcttcaagtcttagtaaaatggaacctttaaatatagatccctgtatcttaggaattagaaaggcagcaaaggcagttcctaatgagatggagaaaatgttgatttagtcatgcccttgtactgtgggggccatactgtctgttgacagagcatattaaaagacgttccctacattcgtcagccttagctaattggcagtctggtatttatgattttatattttgttaatcagcttgggagctgcagtaccccccagcctcctagaaacttggcttcccctgcctgggaggcctcgttccaggagtcgttgttgagagtcaagccagggaagtgtgtttttgtcagggagcagccagtcctgtgctgggagcrtctcagggggcacctgccgttgaattgttctcacttgtgtttgtaagaatccaagtatgtcacccttacaccaagtgagcacacagtgacacartcccctttcaatgtagataacattgcttcagagctggagaacttcatggggctcatcgaggtggtgacgggctacgtgaagatccgccattctcatgccttggtctccttgtccttcctaaaaaaccttcgcctcatcctaggagaggagcagctagaagggtaagtgccccaaatttcatgagctgacgttctattacaaaataagcagcgtgcttatgaaactgtgttgctgaggtaagagccctccctgccttgttaaagagaagaaaggaggaagccgcagtattgcctgtgctgctcgagtaggtcttgggtggagtcatggttctccattcttaggaggttgctgtttggaaaacagagatgttatcacccttactggattttgcctcatcagtcaagggttgcgtgtctgactgtgaccagtgagacggcagacgggggtgcrcttagggcttttctgccaagartgacagcagttggtctggagtgctcacctccctgtgaaatcattgttcgcgcgaccctcatctgcctcaggatgctgtactctactacgcacaactgctccatcttttaagatattggaagtgagagcacrggaggagcatgggcggttcgttttgttagaaagaaaccyggattcacgagatggtttttattgattagtttacaggatttgcactattgatagagtttttgccttggcacaggcctgctttgtgataggggttttaaaataaccgtgggcttttcactggaggataaaagccggtgcttattgcatgcacaattgctttccagccgtcagcctgtgtgtacctttgcatatgtacttttctctttaaactctcccttttaaatacgactcttgccaggctttaagtgaatgcttcaaaataaaaggagttatcaattaaagagtgaattccttccaaagagaatttgggaaaataatttaggaaaagaagaggcgagaaggtcatgggaaaggttgtctttgctgatttatctgccccaactggataaagttactgcataagggtttctttacagcctccctgtttttctcagactaactcttggtcagtcttaaattcttaaaattccatcatctgwtagagctaacgagagcgggcagctcttcattccatccttgaaaagcacagtgtcctccccactggggaacaccaatccttaaaaaacttctttctcattgcaaatcgaaggaggctgccgctgcacccagccccagactcctcagtcacttacctggcaagctgaggccctaccagtttaaggtgatgattattgtttcttgtattaaattttaaaatgaatttttctccgctttttttttttctaagtagrtttgtgtttctggaatctcgggtgtctgtgagcatttcttcttcagcagagcagtagctgtcaaattttcttgttgcttaatgatatacttttttgtttctagactaagcaaatgatagacatagaggtgaatgctgagaggagagtttaattaatttccattaggaattattatgtggttaccttttcatggagtsttaactaagtattgtgcacttaaatgtagttagaaattaaagcctgatttttatttgcaagaatatttatgatgtctttctcattatctgaaacttgcataaaacctgaagcatcagcaaaatctttttaaggttgygtgctcaggtgtttgggaggctttccaggtaagcccgggcccctggcctgctcttaccattttagatgcaggggagggcaagtgggccttgggttttccctgctgctgctgctccccagtagtcctgcagctccaaggatgctggctccagcctttcattcctgcgtgcagcttctaagaggctctttcttgagcttgggctcttaagaatcttttacctcccgatgggaagttttctctcaccctgtcttcctggcccatgaccacaaaggtatagcccatcctcacgatgatgagctccccaagagctctgtttgcttcaggtgttgagaccgctagcaacacctcagctgttcatttctccttagactcagggacagagttaggtctggccccttcactagctgccctcacttctgcaagaagggaagagtcagagcgagaaagagaaggacaggatacgatagtcagataaacatcagcagtgcaaagcagaactcgcacagtgatacaagggaaagaaagaaatgtgccctaggcatggagaagagccagatacctgagaagatcagacaggcttctgacaagaggtggcatttgagatgggccttgaaggctttcgggaaaaacttgaggaaagcagaggattgaagtgaagaaaggcaattcaaggtagggtggcaggagcaaaggcaacgagttggggcatcctggggcctgttgggcaactaacactggagaggtgggtggtactagagttatgtaagatgttttgcacgcaggtataaagggttataatttaggaagaccatggaacgtattcaaggcttttgaatagaggagtgttagcagagctgtctgaaatttttatttcggtgtgcttttggtttaagccaagatagctttcatcccagtgtttctcaaactttgctacacattatggaatcattgggggtgggggcaggggtggagttgagaaatcctgatgtccaagttgcacccccaccccaattcaataggagcgtttggggttaggatccaggaatcagtgcttgtctaaagatccctaggcwcttcagcaggcagcaaagattggaaaccactgctttatcccttcatttcttcccatgtgcatatcacaaagcactttgacggttttttttcctaaatattttcccctcacactgctgcctaatgttttagaggttcacccatgttgttaacacgtgtcacactattttcttgaacttttttttttttttttttttgagatggaatcttgctgtgtcgcccaggctggagtgtagtggcgctgtctcggctcactgcaccctctgcctcctgggttcaagcgattctcctgcctcagcctcctgaatagctgggattactggcacgcaccaccacgcccggcttatttttgcttttagtagagacggactttcaccgtgttgttcaggctggtctcaaactcctgaccttgtgatccgcccgcctcagcctcccaatgtgctgggattacaggcttgagccaccacgcccggccttcttgaacttcttttatagccagtgataacataaatgtttccatttggttcaataggatgaaagttctgttctgtagccttttgtttttgatggagaacagaacaattcaaggtacagagatccttcaactctgacaaccttggctttccaaaatgtcactgagatccccctcaaaaagtctcctgagccatccagaacagaaaattcaagcattttacatagagtagagctcttattcctcactcagagcctgttgacttttatatcgcactcggcgtgagctgattttgtaacccagttacaaaagccatagccatggtttcctcaaggacaccatagggtgtatttctagagtaatgaccttagacattaagaaaatcaagaccgctctgctgtttacaaaggaaacaggttttgtaatccacatgtacacaatttttataaaatagctaatttttaagctcttgagtaagagaatattttcactatctggaaaatccccttgtttggacaaccttgtttcctgatggcatcagataaataaggagttaaagtttcacattatttggtgctaccaaggattgttgccttgaaaagaagaaggaaaaagtagatggagggtggtgagttaaaagaattgaaattcgcggataggcatttctatgcttttgttcctaccactcgactstgcaacacgcagtgctttgtaataccttcttggagctcaaaggtcaggctgaaacatggccgctttttcacatttccctgggacttttggaaaatatacaccaaccctgtgacctagcaattccgggatccacccaagagaaatgaaaacatgcccacacaagacttgtgtatgaatgctggtagcagtattactcataatagcctccygggattcccccgacccccagcccaaaagaaagacccactggaaaccattcagatgttcatcagcagatgagtggatagaaagataaatggataaatgaaatgtggcacaaaggacaactgactactcaacaataaaaagacgtgaagtatgacacgtgttacaacatgggtgaacctctaaaacattaggctaagtgaaaagaaaaaatccagacacaaaagactacatattatatgactcattcgtatgtaatttgcagaaaaggcaaaactatagagacagaaagcagaccagggatggctgcaaggaagaggtggagattgaccaccaatgggaatgagggaactcttggatgatggaartgttctggaactgagtagtggtgatggttggacagttgtgtaaatttacggaagctcatggaatgatgggtgaattttttttttttttttttttgagatggagtctcactctgtcacccaggctgcagtgcagtggcgctgtctcggatcactgcaagctccgcctccgggttcacaccattcccctgcctcagcctcccgagtagccgggactacaggcgctcaccaccacgcccgactaatttttttgtatttttagtagagacggggtttcaccatgttagccagtatggtctcgatcatctgacctcgtgatctgcctgcctcggcctctgaaagtgctgggattacaggtgtgagccaccgtgcctggcctgatgggtgaatatttgataggcaggttatacttcagaagtaaagctatttttaagaaacacctaaacaaagaggaaacattgtctgaatatctgtatggtgcctggttccacctagatagacatatccacccttgctgaacccctaaggttgatgtaaatattggatttgggggagagtggacatgatataaaccagcctgtttgcagatggattggtgggagcatctgcagaaaggcaaaaaaggccaaatactcttatcagttgcagatggctctgttgctgatgacagcctgtgtcctgggttctgatgccccctagagacagccgtgaagaggcaattttctcctcgaaggaaggaactggaatgattggttgtataattgcagaattgttttcagtatgtcagcaagcactgaaaatggggaaactgtcccttcctacctctgtaggctggagacctcgggttcagctccatttatcagggcacaggaccttcctgttctgagactttgttccaggggactttcacacttcagagaatagcacatgtcatcctgcacttttgtggggtgattaaaagctcacggtatccttttatgtttagcccatccaattcttccaactggcctcagccagaaaagcagggaaggcacccccagtttgcagctgagagactccagcctgggagagctgaataaatcttttgcccagaggggttcctcagtaaatgctggagatgaggctcagacctgacctttggattcccagatggagtgctctgaaccgtgtacctggggctgtcttcaccactcaaatatcgatagagataacatagagatgtcctcaggaagataaccaactgttcccatcctgtgtggtctacagattgggagatagggcctacccaagtgtagaaataaacattttttacaacatagagaaggctgagaaccaggataccaatatcaataaaatctggatatcatagagcacatggaagctaaagaaaaataagtaactggtcaggtgtggtggctcacacctgtaatcccagcactttggaagaccatggcaaggcattgcttgagcccaggagtttgagaccagccagggcaacatagtgagataccagctgttaaaaaaaaaaaagaaaagaaaaattaaccaagcatggtggggcatacctatggtcccagctacttgggaggctgaggtaggagggtagcttgagcctgggaagttgaggctgcagtgctctgtcattgcaccactgcaccccaacctggattacagagtgagaccctgtctcaaggggaaaaaaaaaaaaaaacctaatttttaaaagcattctttgaatgtaaaggcagtaagctaagaaacaattaggaaatcacatttactgaataatttacttaagtaatctttttcttcaggaaacaatgataactttagcgtatgcatattttaaagatgtgcagacaggtctctgccttttaccttctcttaattctcacctaatcatggaaggaatttagcggggagccttgccccaagctgtggctcgaaaaacaagcatggtattgacaggcagctcatgaatggcttgattattattttgacaagggttttatttttatttttctttagcttccacaggctccataatgcctgggttttattgatattggtatcctggctcccagcctcttcaatgattgtaaaaaatgtttgtgtttactgtaaaaagataatcttgcttttcaaagtgattagtcaaatacacagaatttcagtgtgcctgccattcatttgtcaaattcctggtttataattcatgcttcctcccgtgggggagaagaatgttttgttcagaaggtatttttggtgtggttccgttccctgctagtgaaattagtttatgaaaagaggcctggttctgggtgtagatggaagtttggcctgattaattggtccttaccggcagcccagaggtttcttcatcaacaaggagattttgtcctgtaactaactcaggtacctggaagcagcccgacatttgggggtgcatcgctgcagtctcctttggagctggagaaaccyatgagcaagaatgggctwatgacacatccatttccactccatccctccttccgttgtatgactgcatggagcccctctgacctccagcagtgtcacctgcagcctggtagtgagaaacagcaggtatggatggggtctacccccagcaacagtagcgccagctgggccatatcctggcactgctccccaggaaacacaccttgtgttgcattgaccagatctgggatcatttggacaatgtcttatgctgcttttccaggatagctgtgtgttcaggagggagcccttactgaaaggaaagaactgttgacttacaagtttttgctaccggtttggtggtcactaatgtgtccagaggcctgaagatgggcgtgtgaggagcctgacttagcttcagaggctctgtctttcgactcacttgtgtgctcactgcacccctgtgctggcaggactccaacctccacccccagcacttgtgtggacagagagcccagtgctcaggaaagggttgggcttcaggcttgtgatgcagattccgtggtggctctgtgactccttctggtcgttcttaaagtagacagggagcttagatgtcacctgtgcattccccttgttgtcctacgagtgagtaaacagggctacagatagcactaagggatctgcgcatggctgtgcagctcattcatggcatttctggtcctgggtcccagtctctgaactccttcctggtctgacgtccctttgtgaatgttcaggaaaatgtcacagggctgcttggcagcattgtaaccataatttgtgctttactgtaaatgagaatcaggctgaggattgaccagctggttagaggtcctggtttgggtgtaaatgaagaccctcaccagatgcagagagatccccaatggacatagcctccagggcagacgaagccttaggggttctgttttgtcctggctacgctggctctgcagggagggctggggttctttctcctttgtgtgtttatacattagatctgtgagtggatcttagaagtcactcaaagtactgcactgattcccaaacttagtaagaagcagagcaggaagaggagaagaaggattcacggtccatggggatcaggcccatcagcacagaggactcagaagtcaaccctggcattgtctgctgccttcctggggaagccagagagaaaggcccactgcggggatctttctctagacctaagccgtagctgtctgctttcttgcctctccagggatggacttgtcctgccacctgggtagccagatagaacggcttcctgtgctggttggatctgctactcgtgtgcacaccctctggggcagaagccacgtctggtttggtgggctttggtcctccaccacctcactggaactcagcctctcctagattgctggttctccacgtgtggtccagggaccacagcaggggtcagcaccacctgggatttgtgataaatgcagattctttgcccaccccagctgaatcagaagctctgggggtggggcccagccctttgcaaacaagctttgtgcacactgaacttggagaaccactgtgttggactccgagtcctcttgcctggatgagaggcccaagagcactgcatgttagtggctcttcctyctcccccacacctccagggactggagctggggctgctcagaatgaaagatgaatgggggagggagaaggcccrgggttgaccccccacaagcttgtctccctgtctcatgctgtctcctatcccatcatgctgctgattgggcaggatttacttccatggataatgggagactttagagcaaagtgtacgctgttccgattgggtagcagagcatgtctgttctctcatggactgctttcaagcacgttgtacatacttggctgagaaaaataaccaaaggcatttcttgggaatgattctagtaacatcctctggtacaagaagcattatttgatggtaatagtggtcatagaattaattagcatcttaccgattttgatatgttatccttgaatcatgttgctgccattgttaacagcaactgtctgttctcctatagtgttaataactaaatctcttattggcaaaggaaatgtattgtggagcaggtggcaaagaggacctgtgttacgtgrccagcaggctagaggggactgtggccaagggcaggtgcgctaacatcgatttctgtgcttctaggaattactccttctacgtcctcgacaaccagaacttgcagcaactgtgggactgggaccaccgcaacctgaccatcaaagcagggaaaatgtactttgctttcaatcccaaattatgtgtttccgaaatttaccgcatggaggaagtgacggggactaaagggcgccaaagcaaaggggacataaacaccaggaacaacggggagagagcctcctgtgagtgacagcatccaaaacaccrtgggcccaaccatcatgataacagcagaccctcctcccatgtgtgatggcagctttcctctgcggcccctcctggtttcacatgggggaccactagaccatcttaactagcactttgctcctacttatatgtcatcacaatcagtagtgggcagatacgtgatgtattcgtatttataaattctgtacatctctgtgagtgtgtgaaacacttataagtaggttctcaaactttaaagtgctgcttacagaatgcacagttaaatgtccttttatacacaggtgcacagttagatatttctctttcttttttcttttcttttttttctttttttttcttttttcttttttttttttttttttgagatggagtctcactctgtcacccaggctggggtgcagtggcatgatcttggctcactgtaacctccacctcggttcaagcggttctcatgcctcagcctcccgagcagctgagattacagacacctgccaccatgcccagctaatttttggatttttagtagagacgggatttcatcatgttggccaggctggcctcaaactcctgacctcaaatgatccacgtgcctcagcctcccaaagtgctgggattacaggcttgagccaccatgccctgtccgattatttttcagggaagagccagtgtgctycagccctatgagctctacccttctgctcccacagaagggaagcacaggcctgtggggtggagggggctctgccctaagcgcagcccctgtgggccacgggtttcctgtcccttacactcggcygccttgtttctcccaccccaacatgaaaaagatggagtgagcctgcagccctgagttgatattgctttttaaattgagaacaatataattacagccttgtactgkttataaaactttaaggtctcatatcagagatacagcagtgcctttctcatctaaccctgtgtagaatacggctgttgagaatggcgtggctctctggctggatagggttataaaagtaaatcgtcttttcacctttggcttttaataagggaagggtattagaaaaaaagtaatttgtatgatgaagggtgatttgtgcgtgtgtgcagacagacacacatgcrgrgaggcaaatcagaaccgatgcgtgtttggctttggcttgtttcgctggtgtctggatttacctggcgacacttgttgctctgggggatcttagagggaagcacgctgactgacctagggctgaacagcaggctgacgaccagcgccgcctcccgccccctgctcactctatccctgcaaagcccctgccttgctccctgttcagatcatagtaaaatcggatgtatccgagtatttcagagtgcttgtctccttagagtcagccagtctgacctgtcagatcataatacrtagtagccgtttattttcttttgaaagcaaaatcatggtttcctctctaaataacacttcagcaggaactgtgacatttcccaatctcagttgcgcacattttgtcctaaagacttcttagctcttttactgtcttcagtccctctgcttcacctcttgagtgtgtagtgggattcaggcagataagagggcgaaaggacaattcgtcagagagctctgggtctccatgagggtgggcagtcatcagtctttccctggtccttatcgtagtttgaatttggtccaaggaataagagagacacttggcacagcttccctgccatacccgccagccaggctacttcccatagagcacgttaggcttggccaagtgagatcttcttgtcagtgcttaatccagcctcccgttgtttgtcagccctagctggaggcctcacaggagttcctgtgtccttccagtttgatacsaagtttagaccaagaaaagttcctttctgtggcacacctgtagtctcttacctgtctttggtggttgtacacgaacaggcagatatccacaactgcagaacaagtgtcatcgtctctcttaagaagtttcagggcagcctaaaggctcaccttcaccctaccaggccccctttcatagccaggatcttagggatggagaagaaagataagttcrcctcgttcactgaagtcgccccttgttttcaggttaggaaacccaggttcatgtccaagtccctgggcaagtagccagcgtaactgattgacctaaaacaaaggatggagcccttggrgctctgcatagtgaaatgtatgatttcttagtggaaaayragaaagccactgaggaagcccagaagggaacttagcatatacagccagctttggggaagggggaagcagtgccaagcaagacaggtgcttttcagagacacatgaatctctgtcactcacggatgtactctttgcmccaggtgaaagtgacrtcctgcatttcacctccaccaccacgtcgaagaatcgcatcatcataacctggcaccrgtaccggccccctgactacagggatctcatcagcttcaccgtttactacaaggaagcgtgagtttctgctttgggtgatgccattctgttgacagggctacgaatgggagaggccagtctttcgatccttgaatgggctggctgaatacagggggtcagcagagtccccagggagagccacgccaaacatccctacttcatcctcatgcaccctctcgggctgtccctgtgatgtcagtcacagccagtgacagccatgattgggaaagtgttagctcgaggcctgtcattctttagtgagtgattagagrtgtttgaataaaataaacccaaaatggggaaagcttgytttttccagaattaggtcagtccagactcatgaacgatgatgggggacttcactgaaatatcgtttcagcctccttacctactaggcctactccaggaacaccctgcaggcacgtggctcttttgtatcatcttattcctgtctctctctctgtgtgcctctcccaagctgtggccctctgctctaggtcatgagccttccaaacaagcgaagaaaagtggagagagaacaaccttcatgtcttgagccttttgtgacttctcctagactctgttgggagcttttcctgtgtgatcacatgacattcmcccatctaagcagccgaggcttattcctcccgactgcagccctctttgatctccctcttccttcctttgccttctatatccaggtggctaccccggtctacttagccatcccccttacccaggtcccatgttaatcccatagttctctctcccagatgtgtggcttccaaagagcagcaaccagaggcaccttatgacagcatcttgtactctttcctcctgccagagctggggtcctatgaatgagaaattgggtacttaggattactaggctttcagagtttgtacacaggggagcccctcatgatctcccatcccatgacagcagacggtgttttgttcatgtttgtttcagaagccagcggccagcagctgtccagcccttttagctgataaatataaaatacctacccaaccatgcatctgtgcgaagtactatattctctgatagtcacaccagtgctttggcaatgtcagctggtaatttcactgaggacttgatgctggtttctaaggcaatctggaaactaaatatttgaatattataagatgcttaagcatcagaattgtttatgagcaatctgaattttagaagctacttctgtttgtctgtaggaaagtcatttttctccaacagttaccttctttcaatatctgatatttgcattaactgactatgcttgtttttttcttgatgaaaaaatgctgcaatcagaagagagaaaaatagtttttgcatatgttcttaaggaatagtaactattgaatcccagtaactgttgaagtggctcttcctgaggcagaccattcaattctgtaatgcccgactggggaagcccagagtccagtcacttcatttcttcttctataaaagtctaattgattatttgtttatttagacctcccattatagaaagtgtgacatgctgggcctctggggaagatttttgagggttttgatgtcagagccccgaacttyctcygaacttaattgtctttcagaccctttaagaatgtcacagagtatgatgggcaggatgcctgcggctccaacagctggaacatggtggacgtggacctcccgcccaacaaggacgtggagcccggcatcttactacatgggctgaagccctggactcagtacgccgtttacgtcaaggctgtgaccctcaccatggtggagaacgaccatatccgtggggccaagagtgagatcttgtacattcgcaccaatgcttcaggtatccatgcctagacaagcccccagcatccacacttcttcrcaagctcactggccttgcttgtaccaggtgtcattgtagggttagcagtgagctatgcctgttgtctttcttgtcaataggtaatactgtgtcatattcatttccccactgctaacacattaggctcttctgtgccattttctggcctcggtactatcttccatcatctcctgctttgtgcctgtgagcccaggtcctccagggtgctgggctggtttcattggaaggcccagcctggaaacagccgtcttcagctgcccttgtttcttgtttgttttgatgttcaatcctccaggaactgaaaccatgctgatctgtgttccacttaattcatgtagctcactggttttccatcttcattctggagcttatagagttccaaagaggtcaacaaaagttgaaagcctgcagatgtagtatgttgtggatattcagagtattcactgatgatgaggttcctccttcctttatctttaggttctaaaccatctcatttctcaactccagatctggaaacagtaaaagcaaacgttaatagtttccagtatataaaaactagtttagaagtaggaaaatccacttcagttttaaagacactgattgttttagtgtattggagcttctatcacaaaaaaacagtgtagcctgggtggcttataagcaatagaaatgtatttctcacagttccagaagccacaaagtgcaagatcaaggcgctggcagatttggtgtctggtgagggcccactccctggctcatagatggctgtcttttcattgtgtccttgcatggtggcagggatgcgggagcactctccggggcctctcatagaagggcctggattccattcatgagggcttcactcccatgacccaatcacctcccaaaggccatgcctcctaattccatccccttaggggttaggattttgacatgtgagttttggtaggggacacagrcattcactctatagcactgataaacattctttgataatagccattattttagtgggtaaggtgtttttaaatacccataagcgagcacaaaatcagtttaaatggcagagaggagggtgagaagaaaatgctggtggggaaaaccttttgctgtgcacgcctgctccttcctccactcctaccccatctccatgaccctgtaagtggccacagtcatgtcactgggtaaagtgcttattgaaacaaaattggcacaggcttctgatcctgcgtgtgggttggtgtagcagaggttcagtgcarcagaagaagtttttcatcttaaaatttggaagtaacccctggccagcaattcactgtagtgtttgggaaacataggaatatctgcttattgtgacagattctcaagaaacctgtttcctttccrcaaagatggaaaccaggcactgtaccaatgagtcagttcactacgttttgtcctctgtccttacacgcagcggagacagacgagaacttggtcctctgcctctgctgtttggtgacacctatcgtaagaatgtatctaggaatgagctgtttgtttttgaagtacttatttttggaaaccctaaagtggctgagcatcaagtggttgtgttttctctgaaaacgccagtattagtcataacctttttccaaagtatcatcccttaaagatgttcagaaccttgtgtgtatcgtataacctggagcaccctcaagctgtccgcccttttcaagttttaaaaatggcttaggcaaacatattgcttaagygatatccagtgaaggtgtcycctgtgctttgaaaaaccatcaacattgatgcttttttgtgacccaataaggacaagatttcagtggttctgggatgcatttgatctttatgcacacttcagctctgggtttcagttcaggggtcagcataagtaaagcttgatcagataactrtgctttgcctataatcggcattcattctgctggtgacagagtcctttgctcaaaatgaggcttccatgcgtttgcagttctaaactgcttttcagagtcatgcctcagtcattgtactgaaggatgcctgtggaaatggtggacttccgtgttctttgcattgcctctcccccatccctcttacacacagctgtgacatgggcatgcacactccttcacacacacagactctccagscccctttccacttcctctttccatttggcttcatgacatttttatcagagattcaaaatctcagatgaaatccaagtcagcctgttttaccagttgtcgaaattgccggagtgcagcactgtggagaatggcagttgtaataaatgagaaataccaggtgtttgaattagctgtagattttcayattgtctcttctaaccctgcttgtgcccccgcagcctttttccatttacaactcagtaatgtttgttttcacagagattaccggaggaaatagattataaagggaaatgttggcatttatagtagtactatttcaaaataaggttcacttttcactttgtatttcattgttcattgttattttcttatccaggtcaaactggcagtttcctgttggcttgccagagtatctgatagcctgactcttaagttcatttcattttctagaatgttctttgttcccctctccagttccttccattcccttggacgttctttcagcatcgaactcctcttctcagttaatcgtgaagtggaaccctccctctctgcccaayggcaacctgagttactacattgtgcgctggcagcrgcagcctcaggacggctacctttaccggcacaattactgctccaaaggtaagggtgcagcagcggcctggacggagggtgtgaccgttcattcctgtggttgtaatgtgcctgagccctaatattacacgtatcagacaacagtgtagttctccattggaaaccagctatcttctggttttttttttttttttttgagacagagtctcactctgttgcccaggctggagtgcagtggcacgatcatggctcactgcaatttctgcctcccaggttcaagcatttctcattccccagcattccgagtagctgggattacaggcatgcacyaccatgcccagctaatttttgtatttttagtagagacggggtttcaccatgttgcccaggctggtctgaaactcctaacctcaggtgatttgcccgcctcggcctcccaaagtgctgggattatagccttgagccaccacatctggccgagaccagctatcttcttgattaaaggtactgagagctattatttttccttacaagcatgtataacggctttcattcccactcttgttttggcttttcttttccgagaagacaaaatccccatcaggaagtatgccgacggcaccatcgacattgaggaggtcacagagaaccccaagactgaggtgtgtggtggggagaaagggccttgctgcgcctgccccaaaactgaagccgagaagcaggccgagaaggaggaggctgaataccgcaaagtctttgagaatttcctgcacaactccatcttcgtgcccaggtacccagctcatgtgaaatttcakttggcaaaacccactgctcaggccggttctgttgcctttctccccaccaggtagtgtgtaagtcagcagctggggggtacaatacagtagccactgagacggagccgaaaaagatgacaggttcggtgaagtgagtccctgcggaagccagtcagccctgaagggaacagggaccagggcttgggttgctggggccaccggtgtgacaggtactgctgtctcagccacaaccccccacagagagcaggtgggcaccctgtggtagaggcagggaggggaaactcaaagagtattgacagctgctgcctggtgagaggaaaggccaggatttgggtccatctctgcccttcctaattatctttactgcctctctcagcctcacagaggaggagtgaagcaagagggaaaaaagtcagagtctgtgctggaaagggcctgacttcaaaacatagccaggtgccacaggcatcctgtacaagtaagtttgggaagcagtgtagggcgacagcctgcattggctgtttattccgtggttactctgtctttcaaagcaacacagcccctgccccagggactctgctcctctgctgtggtcttggtttctggggagtggggacaaaagcagaggaaagtaaacgttcatagcaggactgttcatagtagccaaatctggaaacccagtgtacatcaacaggtgagtggctcaataaaatgggctcgaaccttacagtagaatattattcagccataaaaagggaggaaattttgatccatgtcacaacacagatgaaccttgaagacaccatgccaagtgaaacaaggccagacacaaaaggacagatagtgtatgattttatgttgtgtgaaatatatggaatgggcaaatgtatggtgacagaaagtagatttgaatttaccaggggatggggatagagtgtggaggggaatgggaattattccataatygataggttttctatttggagtgatgaaaatttttggaaatagataatgatgatagctgtaccattctgtgaatgcaattaatgccactgaattgtacccttaaaatgattaaaatggcaactttttatcttacatatattttgttttgttttaaaattttattttaacacaataaaaaatgttaaacaatttttttttcctttcaaaaaaggattagcccagtagtgtgtgggaaaggagatggaagcacagtggtgctccctggccccctcttcctgtaagattatagtgcagattttggaaacgacctcatgcctgaaaactaggccaaggagttggatttaaatcagcatggcacccatgagctgcccatccgcagtccccacagcacccgctgccagcaccccacccagcacgttcccttcccctcactgcccccgaccctgagaggagcctgtagcggctatttattccacagtgactctgctcttacaggctttcttaggctgtaacaacaaatggtttttaaagtgattttttttttctgccaagtgacctttttgatatttgcaaaatggttgaaatagctatctcacttcgagaaatcagtaaagtgggaaataaagactggttagaactggaggcattatttccttttgagagtgcgcctcttcattgcttggtggcttttttctcctcccctcctctctcgaagttcaaaccaccagagcagccaggcgcggtggctcacgcctgtaatcccagcactttgggaggctgaggtgggtggatcacaagatcaggcgttcgagaccagccgggcatcatggtgaaaccctgtctctactaaagatacaaaaaattagccaagcgtggtggtgcacacctgtaatcccagctacttgggaagctgaggcaggataatcgcttgaacccgggaggtggaggttgcagtgagctgagatcgcaccgttgcactccagcctggacaacagaacgagactccatctcaagaaaaaaaaaacaccagagctgtgagaagggcctgcgaggccctcatggcctctcctagcctgccccgctgggggagtcttctgcctgctggtgtgtggcagggctttgaatgtgaaccttgaggttcagtgcccaaggccattttcttatccaggatatctttgtatcactggtggttcctagaaagcagaaagtttgaggactagaaagattgcaaagaggtttggaaactggaactcaatgaggtttggtgacttctctgacatcctaattaattaagaatccgtttgggacctggtcctcattcccacacaccgactcttttccccctcttctcctccattgcgttgcttctcgtggtcctttccacctagaccagcagaggcttagctcgtggcagctcctgctgcccgccacacggaaggatggatttagagtgtcccaaagcaggctgggcgggaagtttgtttttctctatcatgggcccttggttacgttgctgtcttgttccaccaaccagcaggaggttcgggttgtgagtcaaggttttggaaagattttgctgaaaggccccttgctttcagttgtagttacgaggcaagacctgtttttttctcatcagatgtggagcacaaggtgaagtgacgtgaaggcagagctgtgattgacatgttattaatgcacagcattggtggtgttgggttcaaaacaagtttcctgtgttctactggagaagtgtgtttatctgtcccccgagtccttcctttctctctcctaagacaagtccaacttgtgattctctgttttcatggatgtatatgaagacaatattttgtccgtggtgagaggccataatttttaagaagttaatatttgtttttttgcctcctactgagttctggcagagtccaggtgaaggagtgtccagcagagagaatgactgaatcacagaggctggctttctgttttacacgtggattgtccgaaaatggatttgatttctttcagttcattctgagaacaatgtatttgtgggataaaaccagttaagtaagatttagttccttataaattgtccagaatatcctgtatgttttgaagtacagtggaagctagagtttgtaaaacttactagtttctgaagtcaatattcgcagtaaatgcctttctttgactactgtctttattttgtaaatcacatagtttggtttaactagctaaaatgttgacagatgttggaaagtaaaaggttttccaatagggctaggttgtattatgggatggagtggggaaagttggcagtaatgtttgcttttgggcgtacgatttggaaatgtagttgtttaccaaaaaaaatgatgtatgggccattgtgcttcccctgttcctgccttccagataatgttctstgtcacctccstccccttgtcactgccttgatgtcatcagcattgagagctgtgcagtccctaaaagtgtgatgttgataaacaagtaaactactgagtatacttcatgaagtaatcccagttaaatgggggtgggctgagccgggagaggggttttgacagaattattttgcggtacatcaaacctaagcaacttctgacagacacaagtgtatgttgtgttggttttgaaggtaggcaggaaatttgttgatgatgtgttgacaaagatttccctgacagtaaatgtggtttcttgtgtttttcccttccgggaagcttggttagctagttggttggtttgcagagtgtgaggattgtggatgatcagcctcatgtccttacccttcctcccccagtattgtgaaagcaaatgtacacgccctgaccttgtggttttctgcttgttggaacgagcatatctgtgttgggcagttcatgccttcggtaggacccccgtgtgccactacacaaagaaggaccgtgttttcctcaggggaatccatgggctgagaagactggggagcctcagaggccctttcccraagccctctgctctccccttccaggttctgasctaaggaccagccagaagcctgccgagcgtcagccgaacctgcaagtggcttctgggctgttccgttccctgcgtgagctttccctctctgctgctgctgccgcgctctcccctccatggcactgatgagcttcccacattctggactttctcatttccctgggcagatagaattcatcccatttgccccctgccttttgcctattcctaagaccggtgaccccagccgaaggcctcagccctgttttctcaccattcgtccatggctgacctgagggttgccctttctccatctgggtgctcctctcgtattctgttygtttttgttggttcctgtaaacattagaattctgttttaaggtttctagggggagccacaaagcccatttcttcatatttgaccaaagcagcaattagagggtcgcaccctcatgcctcatctgccctttttggtgagaatgtcctttttgtgatgactttatgcactcccttttgcttttcggttgttccaagccccattcaaatccatgacraggactctgctctctgatgggcaggaccttgatgaggccacaggtgctcactgctgagtgggaggaagcctgggtgggctccagggacctgcagagtgtagcaagcacagacgcttggggttgggggtgggctcgcagcaggagcccccaagaagagagagccctggggtccgtggaactgcttgctgctagactccaggcatctttatttccacagtcagagcaaatccaaggagccaccaccacaggctttcatatccctctgccccaggtctctggggcctctgccacacacctcacctctcccctcctgccctaataaatcttaaccacagctgataggtttgccacctttaaggcttaaccataaggtctgtgaccagatggcctgagtgttctgatgacacagccaggactgcctggccaagagtggcagagacactatttgcctctaggtaaaatcgaagaaccactctgagagccggggggtgggggtgagagtttgtgtgcccattctgacacttgcagagtagagaaagcaagataatgaggaaggacatccctgtgttattcatgagttcttacctaagggggctcaatagctccttctattccayggttaagattcttctgttactcttactcaagtcatagaaaagacaaaagaggtaaaagtacttaaaagccacatttctctcctccttgcagacctgaaaggaagcggagagatgtcatgcaagtggccaacaccaccatgtccagccgaagcaggaacaccacggccgcagacacctacaacatcacygacccggaagagctggagacagagtaccctttctttgagagcagagtggataacaaggagagaactgtcatttctaaccttcggcctttcacattgtaccgcatcgatatccacagctgcaaccacgaggctgagaagctgggctgcagcgcctccaacttcgtctttgcaaggactatgcccgcaggtatggtatgatccagctggccccattgccaccttcctcacaacctagtggagaagatgtgttttatggacacagggtctgacacccagggccatgacccttagacccaggcctgcctgctaaataacgtgcagtcattggcaggtggcgtgtagaccagctgcccagggaacagagcccacgctctcctagtgacaccactcccagcttggtctctccatagaaygtgctgggagcagggagctgtctgcagggtccaccctccacctgctacttggtgcacatcgtgcattcctgctgtcctttgccccctcttgcgcacaaatcgggttgccccctcctgagctctcacatgtccagagatgtctccagttagttgccttgatccagagtaaacattgcccctcaagatcaactcctggagyagcctctggtcttgcttatttagtctttggctttcccttgttgttagacactgcctgtcacycgggcattcatccatctttgaaggtgggtgccttcaaagacagaacaagarctgccctgtcctttagtaggcctcaggtggtagaaagagcacggaggtgaccagagtctggggtgtggggtcctcctgggtgcagttctggcactgaagtccattgtagcgtgccttgaggcagtcgtcaggctccctgcctcagtttccttagccctcctgggagagacatagccagctaacccctcaagtgccttttccggctgtaactttccatgacctttgcttatcacaactttgtttactgcttcaagaagcaaaagcaagaaaggaaccactgcaaggtcagccagccgctggaggagttggtgccggcagggagggcttgccctgctcttagcaccagcctcctagcagcttcctcacaggccgggctcggggccatccttcgtgcctgcataaaaattgcagttgccgcgtgtagacgcgggccacggagggtccctgtcacagccggcaggccccgtgtcctgcttctgcttactcagcatctttccagggctgcttgtgtttgatggcttcacaaagctttcttttttcaagtggtaggcacagggtagaagaaagttacttaggttgccaagattttcctgctgtgcttggcagcaggctttttttgttgagggactggggagaaaggaggatcttgtggcatcttgagacgtgcaagttttgtggttggtgtattctgaaccctccgctgtgtgagcagcccgctcaggggcagtgtacgtggctgatctccactgtcctgcccgcgtggatgggggsgttattctcagtgtacgtggctgatctccactgtcctgcccgtgtggatgggggggttattctcaggtcagcccagtgttggcctccctccctgggaacccaaatccaactttgtcacctgtttaaattgtacagaaggagcagatgacattcctgggccagtgacctgggagccaaggcctgaaaactccatctttttaaagtggccggaacctgagaatcccaatggattgattctaatgtatgaaataaaatacggatcacaagttgaggtaggactggggcagtggcccgtgcctgcatgtacttccatccattgacagcatatgctacctgactgcacaggttacctcctggttagcataggacttaaaacaataaaatccatgccaagttggtgaggatttgggtctttctacccactctgtactctccaaggagtactgcatagtgtgcaaagagctaggctgctttttgccctcaagaaacgatttcattgtgtaagataaccttgtggcataggccaggtcagttctaataacttttaatccttctggagttcttggttacaaaaatgtttggttaaagcttttgggtgtgcttaaagctacttgaagacgaccttttaagatttgatttctttgtctttactgacactcaggatcattgttaggtgggaggtcagatcaggcagctggagtccccagtgtggtgagtttagttggcaggccccagattyctcctgcattcatgggaaattgacatgtatgttttatttccccaggatcagcgagaatgtgtgtccagacaggaatacaggaagtatggaggggccaagctaaaccggctaaacccggggaactacacagcccggattcaggccacatctctctctgggaatgggtcgtggacagatcctgtgttcttctatgtccaggccaaaagtaaggcttgtggagggagamgaaacgtggtaaaactgaaagcagggtggtccaggatcaggacagcccgagtgttcatggctgtcttattttctgttaaaatggagttggccagcttccagaagggtcatgctaaggtgccggcacataccggcactgtgtgtgaaaggttgggcagggcagatgccgagctttgggctcctacctcatgtggcaggaagggagaggatccgagcctctcctttgaggttgtgtaaccactggagagccagaggagacagttgctttcaacctggcttacattcaaagacttttttttttttttaaacaaaagacattttataaagcattgaattgaccattccacctcctacttggtcagtaaagctagatagggctcggattcagggcttgaaatcctaaggggtgtaaggaactccagaggtcatctggttcagcctgctacagggcaggaatctccacggtagcatcgcagaccctccactgtccttttaaagyccccacatgcattggaaatgtacggtgctcaccctttggtacagagactgaggaatgtgagtttatgctcaagtcattaacaagacagaattcttaggctgttctgtgtgatgacttcagattttaaaacaaattataagatgtataagcgcaacaagggccacatacttgttgtttgaccaacaaaacttagtattttggtgaaattagttctgtgttgagtttctgttatttcttatttcaaacccagtttttaagattatttcatgttcatggaatgggatcaaatttggcataacacataaaatagcaatgcagcctcacttagtggtaacacttttgggtctagtgggctgatctttcctggtgtccacatttctgctactcacatctggagttacgttaaaacatgcactccgccgggtgcagtggctcacgcctgtgatcccaacactttgggaggccaaggtgggtggatctcttgaggtcaggagtttgagactagcctggccaacatgggtgaaaccccgtctctactaaaaatamaaaaattagttgggggtggtggtacacgcctgtaatcccagctacttgggaggttgaggcaagagaatctcttgaacctgggaggcagaggttgcagtgagccaagatatgtcactgcactccagcctgggtgacagagcagaactccatctcaagaaaaaaggaaaaaaaacaaaaaacagcgcactcaataggtccagcaatctcacttctagtatatttccaaaggcaatgaaataggtatgtcaaacagctctctgcactcccatgttcactgcagcactattcacagtggccaagacatggaatccacctgatgtccatcactatgtatatgaatggataaagaaaacctggtacatatacattatagaatactattctaccataaattagaaaagaaaaatgtcgtttgtggcaacctggatgaacctggaggacatgatgttaagttaaataagccagacacagaaagagaaataccacatgatctttctgataatgcggaatctaagaagttaagctcatggagagtagaatggaggttaccaggggctgagggtgagggagcagatttggggagatgttagtcaaaggatacaaaatttcagttagataggaggaataagttcaatagatayattgtacatgatgacagtaataatgakgtattcttaaaaattgctgagacaatagattttaagtgttctcaccacacacaaaaaaatgtgatgtaatacatatgttaattaggctcattcagctgttctacaatgtatgcatatttcaaaacaataygytgtacatgataaatatacaatttttatttgtatattaaaattaattaattttaaaaaagatctccagtagtcacctggtcagcaccagatattctaatctgtttgtgatatctgaaaatcctaatacagacagcaaaagcaggatggggtgaatagaactgcaaatcttgagccaacattttatgtgcctggcactgttcctgggttcaggtttttaggggtaaatggatgtttaggcagataattttgtcaattaaaatagtctgaattgttccatctagtccagttaacctagtctcaccagttagtctatgccacctttgcagcacccagaagcttcataatattcctgcagccttgtccagggtagtggcttgcttgctttctrtctttccccagcctccttccctcctctttttcctcccctccatctcctagaaacagatcctagtttgggggtctgtgatctgtgaaacagcaaccttggcttctggggttgagtgaactcagcttgttttggtgacatgacatgttcctgtctgsctttgctgctccatttttaaccttgtaagtgccaggatgccagtgggaaatcgggagtccttctgatagaatttttccagcagatgttatcacgtactgcagggaaattggatctgcgtgctggccttactgttgagaaatttttccttatgtcagacaagactctgtcctgctacagtttagtctcatttcctcttatttaatcctcagaggagatggaaggtttggaagctttcaggcaactgccttccttttaggaactccttgtgtgcctgaatactattaaattactcctcagacttctcttttccagatgaaataatctcaggtcttttggccttttcttgtagcccaatatcatacaccagtttcctagccatttaatcatttttgttattctctggatgtgttccattttctccatgtccctgttgaaatgtgaaactcaaaaagaacacagtacagcctgaccagtagtataagtgatataaacagtgatataagggccttgggggaagaaagaaaaatctgccagctttccgttggtaatgatcacctctgagtgtttttaggaattgcaaaatgctggagcctgcatccattttgagagctacaatatcaataaaaatayttctttcttcgattaaaatacttctmattttaaaaattaaaatagctgtagtagtctttaaagagtaaccatgatcacagttttccatggcaaaataatcattgataggggacttacgattaatgtttacttgatccccagtgattccaggcccatttccacatagacatctgtatttggacgtcccagagaggtctcagattccttgtgccaaaaccaaaatcacagttgttgccctcgaaaggcctcttctctcctttgctccttagctcagtcagtggtcttgtaatccatttgttacccaagccaggaacctcacagcatccttcactcttctttctgttcagccacccctttttcattccaacccaagcctcatggattctgcctcttaaatgtctctggaatccagccctctgtcaccaccagcaccgccacagctcagactccaggtcactcgccttggggggatggtakgagctgtcatactgtatgagcctcatcctggggccatgacttaccaagccagatcatctctgtgagtctgcctggtgkaaagacaaggatcagtgacttctttgtaggtctgaactgggtaatgcagagcatgccctggagacatggcatgtccccccaattctccaagacatgacagtgccttctcttactgccaggtccctccgtctgtcctcagcacagccatttccctggaacgcgaatctgatcagttcactgctgggcctgaaagctttcgctgactccttttaatctgcagaatgagggtgaaactgcttagcttgggctgggtcccttgtgagctggccctgacttctctccagtatcatcattttctaggaaagccatttccccacaacccccaaggaaagcatatcataaacaagttttcccttggrgaggttccctcgactcccttctctcctctcccttcctctctgaattgttgccatatgtgaagtccacttttctagttgtcatgctacctgttgacactaatttcccatgtcccacagaatgttccagggtatgggtccatgtgcctggtgcccagcctagcatctgccatacaagtgctggttctgatgatcagtggcttctgtggtcttagacttgtagcaggactcaaatgtctgcagcggcattggaaaggggtgccgtccagtgtgtgcatgtgtgtgtgtgtttattttaaattgtctrtggaactatctcaaagattgaggccagcaggacttgacctatacatagatgtagactgtacatagatgtaagaatttctattcattttatgaaaatgaatagaaattttcattctatttattagaaatagaatgcttgctgctgcaagcatttgagtccttttacaggtgtgagatcacaaagaccgcttaccaacagaaccaacacttgtatggcagatgctaggctgggtaccggggacatggaccaaaccctggaacattctgtggaatgtgggaaattagtgtcaaatgtatgcattttcactaacagtcattaaactgcgtacaaagattatttttcttcagtctatcattgaaactattgcaccagaatatactgtactttaaaaaatgagtatatgcctcagtctgcacatatttactcttttttcaaataattgtttgtttgccgtgttctatttctgacaccatttaccttcaggaattcttactgtatgatggggagtaaacgaatatacaggtatttttttcatacttccaactgaatgtgaagaaatgaaaygagcaaattgttcacctggtgatattttatcatttcctcctctttgctgcagcaggatatgaaaacttcatccatctgatcatcgctctgcccgtcgctgtcctgttgatcgtgggagggttggtgattatgctgtacgtcttccatagaaagaggtcagtgatgtgcaragttatgacactttctgtggctgagtggtttgatgatttgaatgtgagtgaaggtgatatttttgaagatttcaaggaaatattttatggactggaaaacctgattttcccatcaaatgttcttccaggaaaagagaaccttttctaatgattttaacaacagccaaaataatttttcgatggtacagaccttcccctggctgkcttttctggtatacagatactgctgctggtgcatacttttccaaacgcgatgcgctagccttcccaatcaaataagcctttttatttccaatgaagtaaagaaacagatgtttcttaaaaagcgctaatctcaggctactgaggaagccagaagatgtgttagcaaatgtctgctggctcacccaggcctgaattgggagtgtagacaagagctgctgtagacagtaagctctccccattctgttctgataccgtgtgagagaggataaatgaaactgttgtagcgaagatgaaagtatwtacaggaatgtatggaggtggggttttgttaacgtgaatttaatctttttgacagaaataacagcaggctggggaatggagtgctgtatgcctctgtgaacccggagtacttcagcgctgctgatggtaagagtccgggccaccagcactgccagcgtgcagggcaggtagatcgggagctttcaggagggttgctartttgggaaaggaaggaggtttgcattattttgagctacctttggccttggatctgtcttcattaatatttctttctttctttttttttttaatcaaagtttttagcagttcagtgaatatgtcaaaacttgtgggactgtrtggggtgccccaaggaaacacaggctttagagatgaatgtggccagcgcagtaatcaatttatttaattgcttgagatgttatgctagaatgaaaacagctttttaattgttaacatctagtcagaggatatgctgcagctgacaaaacagtccttttaaactagtttcagcttgagtatcatctcattataattgtctttgatgaattacagctctgcttttttttttatcatggaatttttctgtcattcccttccgactagggtcatacgctcgtggctcattcacattccccttggtaataactaatgagggccattcagttaagtggctgggaaggtctgacatggaagttgggtgatcctcaatggttatttccttttttgctctttctagcatttttatatccagaccttttgagtgagtcggattagggtgaggggttggtcactgagtccagtgatactaggacccttaactggcactttgctaggggcttttacaaacaccatcccatttgtttcttaaacccctgcaatgtgcgttttcttaatgcccatctgcaggtgaggaaatgaactctgggaaaaaacttgtgcaggctcacatggttagacagttgagaagtcaggaggagaatggaatcactgtggaaagggctgtgaggtcccccgggcaggcaaggaaacagccctcaggaggggctggaccggattcatcaaatgaataataaataagtgcatgatgttgagtgagtacatttagaaaaagtgtttgctgtcttcttgcctcgggagaagtgaaagtagatgcaggagatgtgaaataaagagacatgattattctaattattgtgatcaaataagaaaacataagaaaatactttaataatgtgaaaacaccgttatactatgtagggttttactatggtttctttaataatttctaattcagtttatagtaaagtcaatcaaaagcagcctcctctgaatgggaatcaggtgcagaataatgactttatttctatctacataaaggtctcacaaagttggttttttaatagtaatatatatatacatacttctgtagtgtgtgtatataaggcagagagaacattctggacggatgcacaccacacttacaagagttgttacttgtggagaggatctttccctttaaaaaaaaaaaaagccagatgtggtcgaaggcacctgtagtcccagctactcgggagactgaggtgaaaggattacctgagcccaagagctgcagtgagctagaatcccaccactgcactacagcctatagagcgagactggctcttaaaatccagcaagaagatagatatgcattgtttgtatgaataatagcttctaaaaagaaaatcagtaaggaagggagtcatcccagatgatggaattgatagaacaaggcaagaccactttcyccctctgtgagggtggactgtgactctacgagagaagctattctgctttgaaatgcggcactagaggttggygtgtgtagcttttgactgtgaagtgtccaggaagagaaagcatcaatacaacaaattcagattctcagggctctcatggtgacttgaattcacattttgtgtccttctagaatgctttcatgatacgtcttggtacttcattacaacaaaaacaaacttattgccacccaggtcgacaggtgggaacagtgtcaccttatttgaacttratttattcggcctttgagaagcacttatagccagtttcctcgaggggcaacaaaatgacattgcagttcaaaagtgctttaaaaacttctttttcccaaagctataatctgcatgtcaccattctccagagtacattgaaaatcccctacaggaaagtgctgataacattgtgcacagaaaccgctcctggctggtggcactggggacgcctgcttaaagtcggagccgttgggttgaatcgagagaaaaggattgagcgtattgacttcagggacctcccagggaatgaatgtgattggtttcaactccatgttttatggcaggctaaacagttaattctgattaaaagcaagcctggattctcagagataaatggctggagacagtgaactctttacactttctgaggcgcattgtgaagagccttatctcctgggttgtcttgcatacttactctcctctgacaagcacccgcctcttcttcaggggtgcaagccacctatgccagctggagggcagagttccattcgtgaaacccttgaaacatacgtactatgaaatacaaaaatgtgtaggaaagaaaacaagattattaatgaagttcatattggacacccctcagaggtctaaaatgatggtgcccctcctgggcctaatttataataaacatctctcctttgagacatcacttaaaggttgatagttgggatatggagatgttaggatacagttgtcagcctctcacatccagccacaggcccagggtcagcatctgaaagcatgaaagcaaaaacaggcaccttctccacctcctttctgagccaggaccacctccttcccacagtcagtgtgtggtagagcctggtggcaggtcccgtcaggcaaggacattagcacacagcgtcagaggaattactgacatttcatatggatcttatggaacaggttgattttattttcgtttttaccctacccatttggaggtgtagaattgagcctgtgtttggttttgttttctttctttccaacctttttcctttctttctctttgttttgccttccttcctgcatagaaatatttatttattcattcattcatttttttgagacaggttctcactctgttgcccaggctggagtgcagtggtgcagtctcagctcccwgtagcctcaacctcctgggctcaggcgattctcctgcctcagccccctgagtagctgggattccaggtgtgtgccatcacacctggctaattttttaatagagacagtgttttgccatgttgcccaggctggtctcaaattcctgggctcaagcgatcctcccaacttggcctacgattacaggcatgagccaccgcacacggcccatttattttcttaaaccagatcgaatctaaacagaaacagaaactggagaagaaatcctattcaggcttggtatctactgtgcattcctcccaaatctctacccattggtcaaggtccctgagttcacagagcccaggccagagccctggaaacgcctctgcccgtccgctgcctaattgcctgtccacrctgggcaccaccrggtctctccctcagtctcagagctcagttgcttctgcacctcatcagggatccagccatcaaagccaaggctgggggacacttggrctagagtaatcctaccaataatgcagttcagctttgtaaccgcaaattttctagtagccgtattttttaaaagtaaaaagaaacagatcaaatgcattttaatagttttttagttccaataatacgtttcgtgtaacccagtatatccaaaatatccattttaacatggagtcagtattaaagttacctaaatatttcactttttttttttttttgtctaatctttgaaatcccatgtgcatgtctcaaattggactggccacatggaatgctcaggagtcccatgtagggaccagctgccatgttagatagcccaggcatagcatctgtgttgagggccctgacacctcttttggattcatccaagaagtaggaccttacgtgcaccatcatcacctctcatatgtgactctggcctttttcccgacccagcataagaactcttccctctccctactactctcctcctttttacatttgcgttttaatctgttggtgaagatgggtaaaatcctgcttgaccatttcattcagtttctcaatcccctgtggttaatttgtttttttcaaaaatgtrtttttatgtgatgaaaagaaatttttaaaaaccaactgctttctttcctatactagacttccttgctttgttctggtccttctatctgttagtatcctcaaattatcttgaaatcctcagagatctgaaatactagtactgactgtacagttttcttactcaaatctatagcatgtggaaagttgacakcaagccatgccatcgcctcctggtattctctgtgggtttaaggaagcagcatcttatattctttggcttagagttcccccaaagcacgttctgtctaagggcttgtttctgtacctgctttaattacggtttcttctccagtgtacgttcctgatgagtgggaggtggctcgggagaagatcaccatgagccgggaacttgggcaggggtcgtttgggatggtctatgaaggagttgccaagggtgtggtgaaagatgaacctgaaaccagagtggccattaaaacagtgaacgaggccgcaagcatgcgtgaraggattgagtttctcaacgaagcttctgtgatgaaggagttcaattgtcaccatgtggtaagagaaagttcctgaaaagycaaaatgcagcacagggagagggtatcacacaagcctcccagtatgttcttggctgcatgtacccgtgggtttggtgtcttgcctttgccttctggatagttaccccattacctcactgctaccttcagacccctgtgctcagaccaggccgcagcaccacagagacagttccagacaacacaggcaccagcaagggccaccctgaccctctgagtctttctctttttgattcctcccaggtgcgattgctgggtgtggtgtcccaaggccagccaacactggtcatcatggaactgatgacacggggcgatctcaaaagttatctccggtctctgaggccagaaatggaggtcagttttcatttccaccggtattgcatgttgcctggcctgctctcttttcctttayaatctccctgcaaggaaatgctgtgtctttaaatcagtttactttccagcatccagtgtttcttactgcatgctcagttgtaggtcatttatgcaaaggatttccccaactagagtcagactctgatcttcgtgaggggaacttcctgttccttggatcccctctgctaagcccctctgtgcctttgttcctgcattccctccacccccagtcccctccccacatcagtgtccacctgccaagccaggccagygccactccctccccgaagctttcctgccccactccagtagctatctcctctgctaacttctcgatgcgcttgactcacatcctcgtatgtgttctctctcgttatgttgtgttgtgctgttgttggagtgtgtcccccctccaccccgttgtgtttagcttttcatctcagtccaagtgtgtggctcagggccgcatttgtggcaggcactctgtcaataaatgtatgttacagttcaaggttaagctgcctggattcttgcccttgcatctgggaagttgctgggtgatttcccacccagctcygtgcgcaagatgtgcactcattcataaaccccctccccacacacagtccccttccccggcattgttggcggtccttgtctttgccactgggaatctggtttcctcagactctacgtccacgtttcaggattgatccagagtcagtgtcctgcttaygcttttgaatgaatgatcccacctcagctgcaggatttctgcttagtttcctaaaaatttcactttgggttatgagcttccaattctaaacctgctaaagtcctatgcaatttttcattaaaagtcaccgtggtgtctcccccctctgtagtattaacccacaggccagctttttaacatatgcgggcatgacttttgagtaattaattctacaaataaactgggagataaatgctgagacataaagccagcaagaactgagttttcatttggttgcctccgtgggtctgaagtctttgacccttactttgctgcttactgrgtaagcagtgtgtctgcttttattccttagaagcagtgacttccccttctcggcccctttggaaattcttttgctgttcttcatttgggcttaatttttttttttttttaatgttctttgaatcggcaacttaatcatctcccaagtgacagtttcttaattttagttccaaacacctgttcacatatgacttcatktatttgcagcacatggtgtttggggccaagtgtggactggggcttcaagcaggatggtttacaaaactcccaccctctgttctgccaagcattggtccccagcacccctgggtgttagtgcctcttcctggttcactcactcactttctctggccctctctgtgtctctstcactctctttctttcgagatggagttttgctctgttgcccaggctggggtgcagtggcatgatctcagctcactgcaacctccaccacctgggttcaagcgattctcctgcctcagtctcccaagtagctgggattacaggtgtgyaccaccaygcccacctaatttttgtatttttagtagagacggggtttcaccatgttggccaggctggtcttgaactcctgacctcaggtgatccacccacctcagcctcccaaagtgctgggattacaggtgtgagccgctgcrcctggcccttggttcactttaatacacaaaacagcatgaaggagaaaagcttgatgaaataggtgactggagatctggcagagtatttcttgccagcatcgattgaggcacctctgaaaagtccaaaactcactcccttcctcyccagtttcaggcacagaataaaaattcagaacacatggccttggtcctggctctgyggctggctgcctgtggtcctcagacagcygctgcaggttcctgggcctcagtgtcctcaatataaaataagagggtgggacaagattactgaagtccctttcagaactaaaattcacctttagattggtcagatttaaactttttctttctagctcatgtcargtattaaaatgtgtgcacttaccctgcagtttcattatattcaacctgctcccccgaccaagtttcacttacgtatctcactacgagtaggtgtatatgtatacttgtcttaaatagctctaaccaaattaaaggaaagaatggcagtgtaacaccatgaactgacaaaatttcagccctctgtctttctccatgcttaaagttgagtgcttttgttgattctgttgctcacggcaattataaatgaccacttcataacacatataggtcatactgtaatatttaagaattgtgagcataaactttacatttcatgtgcatatttcctcatgcatcacacgtatctaaagccctgaaaagtagtgatttggacttacccccagtgacttaatgttgcttccccagataaccacgtgataagtgttttaagtcaccaagagacagctttgacagcctgttcagaattcaaaggtttgtgtcaccaagtgtagagaaccaacccagaagtaccgaggagttgttataatgattccaaatactagctttcagtagaaactagcacctcacagggcagcagccagcatccactgggcattgactatgtgccacgcaccactgggcactttctgtgcgtggccccaggtcatcttctcgtcagtgaaaccactgtgataccccatgtggaaaagcctgggcatgctcagctggtggccggcctgcaagtgtgggacctgtcagagccctatggctttgcagtgctgtgtgagatgctttgtggtcaagaaaaccaaggtgtagagtctgttgcacttgtatatgcaaaagtaaaaggtaacattaaaattagggactagtgattgttttaggatggagagacttgggcatgtgttttatataaaacttttttctaaatggatgtattatttaagggtaattctttttaattccaaagccagcacgttgctgtcctctgcaaagaggaatgcttatccctgttacttattcctggtttcctccaagactagtttcagctggacttcagttgccaaggacttgtcttcygtaatgccsacagaaaataataatgccacattgtaaggtgaaaacagtaatcctggtatttttgtattttagaagaaggttgaagggaaagaaaaggattaaataatttataacgatgctyttatgggaaataaaatataccatgtccatttggaaacacatttgcttacttccacacagcctttgtaacgtgctctccttcctcttacctgtacttcggtgatggaaataaaaggaacatataaacaaataggaatttgagtaactgagaatccttactaccaaaaatggcttgtttcactttaaaaaaatgttgccctacccaaaatagaaaatgttggtcctaaagagtgcaaattggtgtttccctcaccagctctgatgtggtcagggagcaagtgcaaataagcttgcggggagcaagcaggtgccatgctctccatgatggtttgttccttccgagcaagtcctggtttcttagcataaacaacccacggtgcccagattgaacaaagatgatatgcaaacctcgaaagaaattggcatggaaaaaaaaaatccaaaattctcatgtgaatttttttaaatctccaacagaataatccagtcctagcacctccaagcctgagcaagatgattcagatggccggagagattgcagacggcatggcatacctcaacgccaataagttcgtccacagagaccttgctgcccggaattgcatggtagccgaagatttcacagtcaaaatcggaggtgtgtccttagctttccaggtctgggcaagaactaaactcaggtgttttgaggactttgttggcattagtctgcccctggagaggttttctagtgtgtcccttgagtgcacggactccttcttgggaatgatgtgattgtctccagttgatggtcacaaacctggcacggtcggtcccaatgctgatagctcatggacatggtggttcagatactgggcacggtccctgaggctggctctccagacgtttgaggcatttcttggtagaacacctcttagcattggttacagaaataattaagacaatgtcttcaggagattttgacttgggaataaaactcactgtccaaccttgcattcatccctccaattttyctagcttttaaggagcattgctccccttccagggacccacattggtttmtaagaggcaagctgccctaatgacgaagcctctgcacggagcaggagcagtggcaggagctggcatggcagtcccttaggtgagggacgatcactgctcactgggtttcacggctggggctggccagcctccaagctctcgaccactctctcacaacacttactgtcctgctcttagctcaccagcctactggttagactcccttgttgccaccacccactgtcacaccagaaaaaagggttggattgaatttctgagcaatggttaaaacccacttcagcctttaggtttgtgtttttacttcggtcttttaatctgcctaataaaaacacacataacatcagggctgctcaggaaaccacctgcttttaccaggaytctcatcttcccactatgatacaatgatagtttagaaaaataccaaatatttatcctgagaaactgcaggggagatttaacacccaaaagaagctatttcaaatggacctctgtgtctagttcttgaactgccttttctggaagtgttcaccttcctttagtaacatatttttttcctttagtagtgatgttttaatgaaatgttttagcccctttggtgaacaatgagaatcttttagagaacggtttctttttttgagacagagttttgctcttgttttccaagctggagtgcagtggcacaatcttggctcaccacaacctccacctcccaggttcaagtgattctcctgcctcagcctcctgactagttgggattacaggcgcgtgccaccacacccagctgattttttatatttttagtagaaacaggttttcatcatgttagccaggatggtcttgaactcctgacctcaggtgatccacgcacctcggcctcccaaagtgctgagattacaggcgtgagccaccacacccagctgagaatggtttctaaagtaggggtgagtgtctttctttttactctgtaggagctagaggtattgaaatggaaccatatcccagagcccacatccctccgtcatcagagttcctcattcaggatccaccagtgtgtccctaggtttggcacgttgagacgtcctcacgtttggtgctctgtgaagctgggcagccctcagagaggcaaagaagtcccaagaggccgtcctgcctcagggctctcaggaaagagccgcccgcgtccctggctgggcttccttggtgcacccagctcatttctccttccctctctgtagaactcacattgtccccrtggaaatgccagccagctcccctttcccagtgcaggggggagccaggtgggcctgaggtgggccagttctgccgctaatgggtgagagacttgggccaggtgccttacatccgggagcctcagtttcctcacctcggaaatagggtgataatgtaacagaccccatggggttatgagaaggacttggtgcaggaaagcagcagcacgtgcctggcacagggcagggcctctccagatggcagttcctgtctgtgtcttattcccaccctccgrgcacatggggggaactcagtttctccccactgcgcrtcaccctgggagaggtgttttttgtgccaattgccattttaaatccaaatcagcagggatcatgtttgctgttcaaccatgtggcatatttatagtgattttttttgtaatcatggtttttctttctggaatttcaagtttttcrtttgtgctgaggaaggtcgtttgtgttttttaataggattccttcttttccaccttgtgcaagtaaaggcaaatcccctatttgcatgtcactgtattaattcacagataacactttcacacttcatttttattcttctcaagggctcaagatgttttcccaatgcccagcgtctcatggatgacaaatatgacaagtaattttaccagaggcagtttgagggctcttagcayagcacaagtaaattatgttggttcaagtccaaggaactttgttctctttgtgtttgcttttgtagccttacctctttggggcatgagttagagacatacatgagcattttaaagtggagcagccctttctcctgggaaggagaacggaagagtccacttaagaaaaggttgtatgattgagtgcaaaatcaaaatctgacaaagcagcaataatttaggattataaagcgagcctgccatcaaacataattatgtggcatcttctggagacatggaaaatggaagaaattttcaaaaatgagtgggaggattatgttgaaaaacagtattgagtaatagcttcaggggcctcgtaaatagcatcttttcggcatcttactgggtacttttgtcatcatgaattgttaccctgaatattttcccccttattaagcagtgaaattatttacttttctccagtggtggggcagtgctaccaagttaagtaagcatctgtactctcctgtttatttggtcaggttttaaaaccatgtgtaaatgaccagtggtctctgcagtactatatattttcttaaattgtgggactctaatttttacaccgcttccttttttcttatttttattttcaagacaggttctcactctgtcacccaagctggagtgcagtgttgtgatcatggctcactgcagcctcaacctccagggctcaagtgattcytccaccttagcctcccaagtacctaggaacrcaggcgcacaccaccactcacaactgactaatttttaaaattttttatacagacagggtcttgctgtgttgcccaggctgatcttgaattcctgggcacaggcgatcttcctgtcgtggcctcccaaagtgctgggattacaggcgttgagtcactgcgctcagcctgcctctcatttaaatgcaataagggcattaacttcctaagggaatcaaattgtaaatatattaaaagtggagattgcttggtatttgctcatcatgtgattaatcatcccttactgtctccaccttataaaattgcaaaccctaatatttggccaccttaaagtgggacgtgtctgtgtcttgccttgcgtctctccacacataatgagtgtagggtcctctgctgtgacagcagtggtgcctgctccagcgtgtgactctgcgccctctcttcccttacagattttggtatgacgcgagatatctatgagacagactattaccggaaaggagggaaagggctgctgcccgtgcgctggatgtctcctgagtccctcaaggatggagtcttcaccacttactcggacgtctggtatgagaacctttactgcattgccagcctggagcccccagyctctgcactttccaccagctcagtctctagggctttatctttctctgttcattgttacccgttgccagctttagctcagtgttgtgtgagccacacttcttcatcrttgaggtgttcctgttgtcagtgggctagctaagggcagaagggcattcgtgggattttaaagaatttatgggaccaacattctttccgccttcagcagataccgattatgtttccaggaggtgggatgtgccagaagccgtcacctctttttgtttctcccctgcctgccttctttctcttttcctctttctcaataaacagatactgtctgtgtgtctgcctcacctaatctaaccctcagattgcagacagtgctttatttagacccaaagcttatgagtcctgattgtgttttcctgctggtcccatctgctgtctgtctttcagtgggcatccaccgttgtggacccagggatggttatgggaagcaaaacgtctcccttaatcataaacagtgtctaccagtggaagcccatcgaccgagggatcagaggcctctcagtagtattgtttattgcagttccttggcaacattgcagagaggcagtcaggttctgaaatacaactgaggttattggcaggctgaggccctggcacaggcaccttctagaatatcagctagtgtcttggctttcctctggggggatcccgttgctgttgtgttacagaaatggtagttgtttactccaacagtctggatgaccgcatagaggaactatttcartagtgactgacatcattttttttttaacctcgtaaacctttcacagttcaggggccttggatcttattttgaagacaggtgcaaattggaaatagcatttgaatatgacccggcaaagcatgattgcttcttaagctcaagtatgagatctgttttgcaatcagcttgtccaagatggttatctcttcactgtcaaatcaaagtgctctgcatggtgtttagagattgggatggtgaggagagagcaagcctgggtatgtgcatgcatctgtttattctaggcttcgtgcctccaggagcttggaggtcagcttgtagtataataaaatagaaaactatacagccggggagaacagaagcagaatagaaggataaagtgttgttcatatctctcrggcaaattttacccaaattctgacgagcagttactgcacaagcaacaacaaagggacctagagtgtgttcattgccaattctgtccatttggctacataactactgtgaaccaatacaaaaagatatgtataaacatgaataggcgtttggtattcattccatgaaatgctcaggcattgacagcgcttcaggttttgtttgctttttaacacaggctttgaggatagcacaggtcaggaaggctagggcgttggagcaggtttctcagcggtccaggctctaaactaaagctgtccctctcaaaagaatggaaatgatttcagattgtattcagcagcacgaagcaatgattcctaaatagttaaaaatctagaaagaaacactaagaattgtattkggctttgtagaagagaccccagaattttaggatttgggatgtatccctgcagtcaggcccagtccccagtgcacctgcagatctttgacagctgctggttgagcttctgctaagaggtttccttccagggactccatgttcactgcctcacaaaggcaggccagcctcatgctttagacatccttgctcttarcaaatctttygtgttctgctacgtcagcctctgtgtgacacccattggaccttctctctgtagcacaattgcataccttgctctgttcttgataagataggtctaggagtcatcgaagaggtgtgtctgttctagccagaacacctccaagtttcctgctgtcttccaggacttcattcccaggcccttgggcactgtggctgctctccctgcagctccctgtagcaccatgtccctctgaaatgacaagggtgccctctaggcatggaggaaaccagacgaaggactggggagctgcaccccacagcctagagctgtgcttcttcccgagcatctggatcacccaacacataatctttattttttattaagaagctttccaaatagtcacaaatagccaaggttatttgcttctttcatgactaattaccatctgtggggaatgtggatttctctgtaggttttaatttgctggtgagtgggccattgctaccatcccctcctggtgtggggaagtatagttactgaatgctgcctccagccagcacgggcattgcagggggactcacagccgccggtcttccccctggggaaacaacgtcaaggttcctaattagaaagggctttacacagagacatgtatctactgtttgaagattaaatctgtccatgaaatggaagacttgattttatatgaagtcatgaagagccaacaccacatagtaaaataccggctttgaaaaacacagaggtgttgcatatttctcggtgcttctgactggctgtgtggccttggttaaacctcagagcttctctggccttcggttgctccatctgtaaggcaaggtctgtctcgagaagtctgcggtacctgaatagatgttgaaatggctcctgtggcaactggtattgtgtagagatggttcagtgtccacaccttgcagttgtcacattaagctgtgaaggacgactgactctagcactcagtggtcctcagtggcaggtgatgttgacctcagacaagagttgctcaggagataggctttgcagttcacctcgacaagcgtttgtggagagctaggtctgctacctcctgtatcgttgcctgtgggtgatggtaaggctcttgggggtgtggaagatgcggggatgatgatgatgacgatgatgacgatgacgacgaygacagcgtcgtcgtcgtcctggtcctggaaggataaagtcttgtggagaagaggaggcaattctgacagtttggggttgcatcatcttcttcacagaagagatgaagttgtgtaggcaccctaagtatggattgtcacaaaaagagcactaggaagcggggcggggcggggcaggggtggggggttcctggcagtgggaatgctgggcaggcatggcagtagggagcacctgctgcaggtggggttggtgaggtttcctcgtgggacttaggctgcagagagatcaagacaggcctcagctgttgtattaggcatcctggactaattctttaagccctgttaaggtttctgaaccagagggtgattagagctgtgcttgaagttcttgttagccggagtatacagctgcattgagcaagatgttgtaaccaaaggagaggtggtggtgggccaggcaagcaggatcctgcacactcagggagctctgagggacggaaggagggtgccagaccttggacagatgtgagcctgggtggacagttcgcagtgggactccgaggaggccaagggcatgggtgacagcaggcagactgctcgggtggaatgggcatcagctgcagggaagccgggggaagaacagggcacaaatcagagttcagtgtgagacgcrgtgagtttgtgggtagcccagtaactgggaacttggaatggagcagttgggccgggagggccagggtgggagccgtgccgtgagaactggctgcctgcaagccrctgacacagccaggaagggcacgtggggcaagaggagaagtgggtctgggagggagccacatcctcaggccatttcccagaccagcctgcagtcagcaaaagcagagagctagtcatttcttcttattttatttttaattttttgttgttggagagctagtcatttcttgtaccaagctgcatttcagatgtgtgggtactactgccactggcatctgaggcatgctgcctgtatggctgggctggttgtggaaggcagagcttcccgcacaaagctgatggagagccccttctcccctgggcccaggcctctctaaactgcacttttggcctctgggtgtcttgtacaacatgaagacgacagcatttcttggtcacttgtaattaaaaaggaccttgggttggtctgtcctctgattgctaagattctatttctgtctaacatctacttttagtatcaatttgtacaaaaatctttgattcaccgaaagtagctgaagcagygaataaaacgttctcatacagtcaggagcactgtgggcttgggcacaaggtcwaggtcccaagagctcttggttggaaatctcctgccccaggtttttccatgtggcttgaccagcacctgcagcccaggacaggtccagctagaatccctgctccccaccctgctcccgcccctacttggtgatgagtagcctattttactccaccaaagtgaaccacatggaaaggcacacaggtcagggagaatttgtgaattacggaatttgccctgggagggcacatttgttttgcagattccagcattgtcttttttaacattctgtctgaaagttgtgtgtgtactctctgttttgttttccagtggtttgatcttctaaactggcaaagctgcatgcatatggcagaattgctcactacaaagttattcctcagccaacttctctgcttaaggattctttgtccatgataccccctcccagccagtgcagcccaccctggtccccccacctgtgacacagaggccctgcaggccagcagctccccagctctgttgtgggtgggggagcagcaggagttctcttctcccttggcccaactggacctcaagatccctatagatcttctaaacattccaggtcccaggccctcaccccagaccaatcaaatcagagtttctattgggtgcccagccctctgtttaaaaacctccccaggagattctcctgtgcagccggcagtgagaaccacctgggtagaggtttccaaaattgtctgattgtaaaaatcacctgaggagcttggtaaagcttgactgtcccaggcctcatttgaggctactragtcaatgtccaggctggggcttggacaagaatgtcattctttttgggtcaaagccaggttaggtgataccgccttgccagataaatggccgggactaggtagatgctgaacccagtatgctctgcgttcaaagcacagatcaggggcttcctgaccrtgcaagggatgccggaagcgccctcaccaccttccttagctccaccaccggggctgaatttagtttacggggaacattagcagcaacagagggaggatgatatcccgcacttagcccagggcctggctcgctgtctgacaagcactgtcaccatagtaaggacagtttatctgctcgggatgtaagaagtgctggaaaggagggggcagcattgttcagtccatccctttccaagctcctcacagtttttttctccctgtaggtccttcggggtcgtcctctgggagatcgccacactggccgagcagccctaccagggcttgtccaacgagcaagtccttcgcttcgtcatggagggcggccttctggacaagccagacaactgtcctgacatgctgtacgtacttcctgggccctccgtgctcttctgagttctcttctcaaatacctgttttcttgggtcacaggagattaggagattaaagccattctctctggtcctgcrcctcccttgccaggcrtggctaagaggtttgtccttgtggaaggagctgagtgggttggtcgacctgtgcttttccgtgggtaccttaattctaccccatattccgtaatgctttcgttccgatttgcagttcacactgtagtttctcaggccaaatgtctctgtgaaatgtttggccagagtaatccatccttactcatcctctccatgtgaggtttttgtttctttttaaagaaggctacaacacaacacatactactctgaagtygaattcaagagccccgcgccccacctgtggcaggcctgagggagccgccgcagtgagtgtgcacacagctgcatggccaggactccggcatgcaccacgtagggtcagcttggtgtcttctgaaccctgccccacatgtcttctctgttaagtgtttacaaaagtcataaaccatctaagtaacatgctctccggagcttcatccgctgaccaatgtggacctggagcgtgtgtgagctgacatccctgcggacagaaggatgccagtgctggtgaatttgtcttctcactgcacttttttttttttttttttgagatggagtctcgctctgtcgcccaggctggagtgcattggcgtgatcttggctcactgcaacctctgcctcccgggttcaagcaattctcctgcctcaccctccaaaatagctaggattacaggcacccaccaccactcccagctaatttttagtagagatggggttttaccatattggccaggctggtcttgaactcctgacctcagatgatctccccgcctcagcctcccaaagtgctgggattacaggcatgagccatcgcacctggcaaccccacttattttgaaaaaacactttgcagcttttagtcctaagttttgtcagatgacgagagagagtttgtgatgcctcacagtgttggtgaggcctctctgctcagcgccccctggagaagccccccttttggtggaggacttgctctgtgtccgtggacggtgctgttttgtggctcagtggaggtcagagctgctggagcagggaggccttgttgtccttcctggaatgagtttgaggagggggtgaaggtgttccagttcagtcatcaggygcacaacaggtacaggttgggagcagtggccttgcttttgacatgcactttaaggcaggcttcagagattgatctggatctccatagctgaacaggaaggtgggctcccactagtatctcaagaccaattcaggagatttccagaaatgcttttcaggacaggtttggcttcattttggaaaggatcctgaggaattgctgggctgttatgtctgcatgaaggcacccagctcctatctctcacccatccacccccctggagccagcacagactcaggctgggcccacagtggcgggataatagatagatatgaaccagacatgtgtcaggtggacaggagggaatgagggctccagcagccacaaaagttttgctcatttggtctcctacagtgtctgtgggccaggaatccagatgcaggtgttcttgctctcagctcagagtcacaggaggcagaaatcaagatgtcagtggggctgcagtctcacctgaggctcagggacatcttcaggctccttcagggttctgcacttgcaggactgaggtccccatattcttggcacctgtcagctggggactgctttcaactcttggaggccaaggccactcacagtccttgccatatacagcctccataggccctctcataacagcagcctatttcttcaagactgataagaggacagctctctactgcttctactggttttttacctgataaagtcagatctacccaggatactctctcccttttaagtgattcacagtcaattgatgagaagcctgattagaggagtgaagtatcctctcatgttcacaagtcccacccgtactcaagtgaggggattatatgggatatttacaccaggggcaacgatcttggggggcatcttagaattccatagtctcagaaatcattgtccctaatcaaacaatcaaggtgctatttttgtttcaaagcactttgagtgttgctacaaatactgaatccctaagctccttgtaaatggccggccagcggagggcatggggtggggaagactggatacacacccctgtgctctgggagtacgttggctgggcggcatgctcattarctgctgcttccgaacataggttcagctgaagtgtatcccaggcagtggacacttcgtgtggaattcagaaaggtggcgcaggaaggataccagggaaagccagagtgaaggcatcacccttgcacagctagcacatgtgggggctcccattgtcccatcaaggcagggccagaaccagaaagtcggctggtgccctgggcctgggccagtgatgggaggctcctcttctctgagggtggcacctacagatgcagtggcactgggtttcctggagccctcatcaaggaaacttcccagcatggcctcttcagaactccacaatccaaacttggaagagactcgaaagaccacttagtaccttttcttgcccagtatagaaattcttcttctccccttctgtgttagttttttatcgcagtataacaaactacccaaaacctactagttaagagcaacagtaaacatgtattatctctcagaggtttctgaaggcgaggaacgcaggagcggcatagctggctggctctggcttggagcccttctcgcggttgcagcccagctgtccgccggggctgcagtcatctgaaggcttgcctgggggaggcagacccacttccaaggtgttgctgcataggtagtatgccctgcatgaatcgccctgttctacgtgggcctctccgtagcactgcccaagtgtctcaggatgtgtagctggcttctctgagtgcagagttcggcacactctttctctaaaaggccggctaaaaaaatgtttttggctctgtgggcccatacgaccttgactgtgactactggactctgccactgtggagcaaacacagctgtgggcgtcacataagctagcgtggctgtgttccaatacagctttatttttaatactggaatttgaattccacatcatccctgtgttgtcacaaaatattcttattttgaatttcttttagccatttacatgaaaaccattcttagctcatagaccttggaaaactaggcagcaggccagattttacccacaggtacatagtttgcctgctgtgccctagagtaaaagatccaggacctgagcagaaggcacgacgtcctttctgaccaaacctcagaagtcacactgaggctctcaccttctccttcaggttacaccatgtgagagtcaatcacgtggggatgtgagctccaggacacaggggagaggaccactggggatccgggagcctggctaccccccagtaccccaccaacacacacacacacacacacacacacacacacacacactgcccctcacaggtgaccatctgctccacactttgagcagcgcagccactgttttcttgccagccattatgagaaaaatcatgctttcaagtctgaatataagccatggagtaagaggtctgatgaccactgaatctgcataaaggtacagtgctagaatctaggctaatactagaactggtggtattttagcaagcttagaaacagcccatgaaagcaggtgtgagttctgcttctgtggtttagggtgggtgagggagagcggtattgttctgtgctttctctttgactcgggtaaacgtttatctacaagagacttgtgggattcttacttggtccacctccaggtgactgggcttttactattaatgtaaactgcctgggacgcagcccctgccatgggaaacgcagggcacttcctgttctcagcatagagtgacaaggaaatttactcagagcggttactctgacattcaatgtttagttcaggaggcatttctgctttgccatcgagaatttttctcccttctaagaaaatgttttctcctgagaaaatttttctcccttccaagaaaagagtagaatgaaaggaggcaacttggtttcatagggagtgtcatgttgtccttctgagtttactgatgagcttacctgagaaaggagggttctagcatgggagttctgttgytacaagacatgaaagaatggcctccgtttatcccggagaggagagtccctgagcccttgggagttgccttgaaacctctgccgggtcccaggtgagaaagtgtgtgagttgtgtggttctgagatctgaacaggcaccrtctggtgacactaggggctgaaggagctcggtggctgcaggtggactggagctcaccatcaggaagtagccagattctcacccctcagtgtcaccgagtgttctggctttagaggaaggactccgtggtccccaagccacaaggtgtcgaggtctgagtctcaacgccatgactcagtgtgaattaacttagcaggtatcacaacatcagatttgggttgtggttccctgctgggtctgtactttagattgatgacaaagcccgtcctcagccttatttcagcccagatctcggtatttatgccacagatactgttgagctcctctgggtgcgtgctgaccctgaggtcacacagatgagccaggagtggccctggctttcaggaaacgtagtgacgtaaaaggtcccggctgctgcgggataagggccagggcagaggtgtgaacgcagccgtggaagacttgggccaggragccatttgttctgctgctaacacttccacagctccacrtgtccagactgttgccagagacgtctttggtctacaggattcaggagggaatctgaactttagcctggagcattatcaactcatagatgagtctgaaacaaacttagtgaaatctgatgttttttgtagttttccagtacagtttttcccatcgctggaatcctggtttggttctgcgggaatcgagtgcttgagtgggacccagacagacaggaagggcgctcctgctcagttagccccagtaagctcactgaggcacacaggccccatgtccacagccgctcctggctgaggcgtggttcctaagacgacccttactgttgagggctgccaggagggagagacacattcagccccgcaggtcctctgggaatccggtgagcgtcggcaccgggctggggccgtgctgattcccggcagcgtgtgggaatgtgcgggtgcctcgtggcctgctgacatcgcacacaggtcacagcctgtccagttcaggacatcagggccaagagtgaagtgagaatacggaggcacctctgtgtgctcaccctgctgaccgtcacccagcctccggggggggtcacagctggcccccaggaagctgcttcccagcagggcaggaattccatttgagtcttgtccctgttccaggagaagggctgggtatgtgtcccccaaaggggagagcattcgagaaggatggcgccagcctccccagaactgacctgtggttaaaaaaaaaaaaaaaaattgtgctttttaaaagatgagttttatcagctcacacatccttctagagtctaatggagattttttgtgtgtgtggaaatagtaaacaaggtcttgaatcccacagagcaaaaaagacttcctttcatgggcagcactggaagggttgttactctggaatggtttaaaagaggcgtcacatggcttgtttgtgctgatgtcactgcctcgctgctctcctgtggcacctcctcggtccctggccacagggcacagagccaagcacatctcrtgctcttggcccagttacgcttctgcccaggggtaagtcagctggagaggaattcacagcccaggcatttcatgtcgttatggcctattttaatttttttaaccccaatcatttttcttaggaagtgatggggagtttggaaaggcaggcttatttgtcatcaagctgccagcttttatcaatgcaaaccacatccctgtgacatctgtgactgttccttggacagttaggtgagggagggtctcctggtggccccagggttactcttatttaggttgagaaaaattcctttttccaggatcgttggtgatcaaagtgtagtcattctgttgcgcagagaactccatcccagctccaccctcatgaattttgtaatcttggacaaattatttagtatcttagtgcttctgttccctcatctgtaacatgggggtatattatagtcagtagcacctgcttcacaaactcgtgaggacttcagcagttcacacacataactgcctcgctgcctggcacctagygtgcacatggcattctaccgtggggtagacttttaaaattctggctacagagatacttttccataaaagtggccacatggaactctccaaatctaagaagcatactgtgggggccttcatattttgtctaattcttttctccccagaacaggaacctgcacccttccttcttttaaagggcgacgtggtaaataaacatttttagacttgcaggccacagtctctgtcctaatgtcctcagctggtagttgtagctggaaagcagctgcagcccacatggaaatgagggagcgtggccccatgccagtgcagctgatgtagaggcgggcagccccgggttaggccctgtggagacgcaggcccccgggctctagaacgctgaattctagtgaattctggatggctctccctcacacccaggcccaccctccctcaaggttgcaccwtctccacctgaaggaagctgccaggtggccataggagcccttctcttggcaggccagcttccaggcccagtggcttctcttacatcaggggcctccccttggaatgttccctgaaggccagacacgggcaggtagtctgtggtcaagcagccaccctgacaggaggctagatgccactgggtgtgctttgagtttcctagatgtggagagttctgtgtggccacttttatggaaaagcatctctttagccagaattttaaaataaagaggataacttcctggtgagaacagacgtggaaaggaaggcactttggtttcacgctcatgtaagagagggctgttggcggtcactcctcagaactatggccagccctggatggtagccagctgctttttgccccaaaagtctgtttagctgggtctctgcattctggaagcttgtcaaagcccgggcctttcctgggtcagggcagccggctttccttgtccacgtgtggccggctgttttcttggggagccccggccacagccggcaggactccctttgctccatgygactctgagggcctcacaggtatttgcagcccaggtgctgtcggagcccagccgatgckaccgacacacagcacaagcgtcatcctgttctgcctgtcccttgcgtgtggaggggactcgtgcccagggctctccttgctggcttgttggaatctggcttcaggtctacacggggcctctcgtttggtccagaacagcctggctcatcggctggggcttgcttgtgcagggctggagcgagcacgtgctagatggagacagcagactcggagtgtgcatttcttcgtgttgcaagcctggcctcacagtgccttcttcctttggttgtctgccaggggtagccctgcaccaggaggaagcttagaaatagcacaggtgggaaccggagagagagcactgttggggaagctgcggtcactcatcagccttcctggtgagaaaccaggggtttcctgctaattctggaaaggatgtttcagcagtgcctgcatgagaygcctcagatagaaaactggttatttttgtttcttagcactgccaccatagataacagctgtcacgatggacagtgtggacctggattagtccttcttgggaaaggagagtttgggttttgtaccrtggtggttytgggttctgrgggaagagaatggaaccgtacgaggtaaaacaggagactctgaaggccacttggccatccaggcagaaagccagggatggagaggggcagcagggctgtgttcagtgctcccgccgtacgcttgtatgcgggaaaccactgcaggcggcccatgaagcctcctggccatgtgcgccctcccrgtttggaccccctcccgtgtgtcttggctgcaggtttgaactgatgygcatgtgctggcagtataaccccaagatgaggccttccttcctggagatcatcagcagcatcaaagaggagatggagcctggcttccgggaggtctccttctactacagcgaggagaacaagctgcccgagccggaggagctggacctggagccagagaacatggagagcgtccccctggacccctcggcctcctcgtcctccctgccactgcccgacagacactcaggacacaaggccgagaacggccccggccctggggtgctggtcctccgcgccagcttcgacgagagacagccttaygcccacatgaacgggggccgcaagaacgagcgggccttgccgctgccccagtcttcgacctgctgatccttggatcctgaatctgtgcaaacagtaacgtgtgcgcacrcgcagcggggtsgggkgggagagagagttttaacaatccattcacaagcctcctgtacctcagtggatcttcagwwctgcccttgctgccygcgggagacagcttctctgcagtaaaacacatttgggatgttccttttttcaatatgcaagcagctttttattccctgcccaaacccttaactgacatgggcctttaagaaccttaatgacaacacttaatagcaacagagcacttgagaaccagtctcctcactctgtccctgtccttccctgttctccctttctctctcctctctgcttcataacggaaaaataattgccacaagtccagctgggaagccctttttatcagtttgaggaagtggctgtccctgtggccccatccaaccactgtacacacccgcctgacaccgtgggtcattacaaaaaaacacgtggagatggaaatttttacctttatctttcacctttctagggacatgaaatttacaaagggccatcgttcatccaaggctgttaccattttaacgctgcctaattttgccaaaatcctgaactttctccctcatcggcccggcgctgattcctcgtgtccggaggcatgggtgagcatggcagctggttgctccatttgagagacacgctggcgacacactccgtccatccgactgcccctgctgtgctgctcaaggccacaggcacacaggtctcattgcttctgactagattattatttgggggaactggacacaataggtctttctctcagtgaaggtggggagaagctgaaccggcttccctgccctgcctccccagccccctgcccaacccccaagaatctggtggccatgggccccgaagcagyctggcggacaggcttggagtcaaggggccccatgcctgcttctctcccagccccagctcccccgcccgcccccaaggacacagatgggaaggggtttccagggactcagccccactgttgatgcaggtttgcaaggaaagaaattcaaacaccacaacagcagtaagaagaaaagcagtcaatggattcaagcattctaagctttgttgacattttctctgttcctaggacttcttcatgggtcttacagttctatgttagaccatgaaacatttgcatacacatcgtctttaatgtcacttttataacttttttacggttcagatattcatctatacgtctgtacagaaaaaaaaaagctgctattttttttgttcttgatctttgtggatttaatctatgaaaaccttcaggtccaccctctcccctttctgctcactccaagaaacttcttatgctttgtactagagtgcgtgactttcttcctcttttcccggtaatggatacttctatcacataatttgccatgaactgttggatgcctttttataaatacatcccccatccctgctcccacctgcccctttagttgttttctaacccgtaggctctctgggcacgaggcagaaagcaggccgggcacccatcctgagagggccgcgctcctctccccagcctgccctcacagcattggagcctgttacagtgcaagacatgatacaaactcaggtcagaaaaacaaaggttaaatatttcacacgtctttgttcagtgtttccactcaccgtggttgagaagcctcaccctctctttcccttgcctttgcttaggttgtgacacacatatatatatatttttttaattcttgggtacaacagcagtgttaaccgcagacactaggcatttggattactatttttcttaatggctatttaatccttccatcccacgaaaaacagctgctgagtccaagggagcagcagagcgtggtccggcagggcctgttgtggccctcgccacccccctcaccggaccgactgacctgtctttggaaccagaacatcccaagggaactccttcgcactggcgttgagtgggaccccgggatccaggctggcccagggcggcaccctcagggctgtgcccgctggagtgctaggtggaggcagcacagacgccacggtggcccaagagcccctttgcttcttgctgggggaccagggctgtggtgctggcccactttccctcggccaggaatccaggtccttggggcccaggggtcttgtcttgtttcatttttagcacttctcaccagagagatgacagcacaagagttgcttctgggatagaaatgtttaggagtaagaacaaagctgggatacggtgattgctagttgtgactgaagattcaacacagaaaagaaagtttatacggcttttttgctggtcagcagtttgtcccactgctttctctagtctctatcccatagcgtgttccctttaaaaaaaaaaaaaggtattatatgtaggagttttcttttaatttattttgtgataaattaccagtttcaatcactgtagaaaagccccattatgaatttaaatttcaaggaaagggtgtgtgtgtgtatgtgtggggtgtgtgtgtgtgagagtgatgggacagttcttgattttttgggttttttttcccccaaacatttatctacctcactcttattttttatatgtgtatatagacaaaagaatacatctcacctttytcagcacctgacaataggccgttgatactggtaacctcatccacgccacaggcgccacacccaggtgatgcagggggaagccaggctgtattccggggtcaaagcaacactaactcacctctctgctcatttcagacagcttgcctttttctgagatgtcctgttttgtgttgctttttttgttttgttttctatcttggtttccaccaaggtgttagatttctcctcctcctagccaggtggccctgtgaggccaacgagggcaccagagcacacctgggggagccaccaggctgtccctggctggttgtctttggaacaaactgcttctgtgcagatggaatgaccaacacatttcgtccttaagagagcagtggttcctcaggttctgaggagaggaaggtgtccaggcagcaccatctctgtgcgaatccccagggtaaaggcgtgggtcattgggtttgctccccttgctgctgctccatccctgcaggaggctcgcgctgaggcaggaccgtgcggccatggctgctgcattcattgagcacaaaggtgcagctgcagcagcagctggagagcaagagtcacccagcctgtgcgccagaatgcagaggctcctgacctcacagccagtccctgatagaacacacgcaggagcagagtcccctccccctccaggctgccctctcaacttctccctcacctccttccctaggggtagacagagatgtaccaaaccttccggctggaaagcccagtggccggcgccgaggctcgtggcgtcacgccccccccgccagggctgtacctccgtctccctggtcctgctgctcacaggacagacggctcgctcccctcttccagcagctgctcttacaggcactgatgatttcgctgggaagtgtggcgggcagctttgcctaagcgtggatggctcctcggcaattccagcctaagtgaaggcgctcaggagcctcctgctggaacgcgacccatctctcccaggaccccggggatcttaaggtcattgagaaatactgttggatcagggttttgttcttccacactgtaggtgaccccttggaataayggcctctcctctcgtgcacatacctaccggtttccacaactggatttctacagatcattcagctggttataagggttttgtttaaactgtccgagttactgatgtcattttgtttttgttttatgtaggtagcttttaagtagaaaacactaacagtgtagtgcccatcatagcaaatgcttcagaaacacctcaataaaagagaaaacttggcttgtgtgatggtgcagtcaytttactggaccaacccacccaccttgactataccaaggcatcatctatccacagttctagcctaacttcatgctgatttctctgcctcttgatttttctctgtgtgttccaaataatcttaagctgagttgtggcattttccatgcaacctccttctgccagcagctcacaytgcttgaagtcatatgaaccactgaggcacatcatggaattgatgtgagcattaagacgttctcccacacagcccttccctgaggcagcaggagctggtgtgtactggagacactgttgaacttgatcaagacccagaccaccccaggtctccttcgtgggatgtcatgacgtttgacatacctttggaacgagcctcctccttggaagatggaagaccgtgttcgtggccgacctggcctctcctggcctgtttcttaagatgcggagtcacatttcaatggtacgaaaagtggcttcgtaaaatagaagagcagtcactgtggaactaccaaatggcgagatgctcggtgcacattggggtgctttgggataaaagatttatgagccaactattctctggcaccagattctaggccagtttgttccactgaagcttttcccacagcagtccacctctgcaggctggcagccgaatggcttgccagtggctctgtggcaagatcacactgagatcgatgggtgagaaggctaggatgcttgtctagtgttcttagctgtcacgttggctccttccagggtggccagacggtgttggccactcccttctaaaacacaggcgccctcctggtgacagtgaccygccgtggtatgccttggcccattccagcagtcccagttatgcatttcaagtttggggtttgttcttttcgttaatgttcctctgtgttgtcagctgtcttcatttcctgggctaagcagcattgggagatgtggaccagagatccactccttaagaaccagtggcgaaagacactttctttcttcactctgaagtagctggtggtacaaatgagaacttcaagagaggatgttatttagactgaacctctgttgccagagatgctgaagatacagaccttggacaggtcagagggtttcatttttggccttcatcttagatgactggttgcgtcatttggagaagtgagtgctccttgatggtggaatgaccgggtggtgggtacagaaccattgtcacagggatcctggcacagagaagagttacgagcagcagggtgcagggcttggaaggaatgtgggcaaggttttgaacttgattgttcttgaagctatyagaccacatcgaggctcagcagtcatccgtgggcatttggtttcaacaaagaaacctaacatcctactctggaaactgatctcggagttaaggcgaattgttcaagaacacaaactacatcgcactcgtcagttgtcagttctggggcatgactttagcgttttgtttctgcgagaacataacgatcactcatttttatgtcccacgtgtgtgtgtccgcatctttctggtcaacattgttttaactagtcactcattagcgttttcaatagggctcttaagtccagtagattacgggtagtcagttgacgaagatctggtttacaagaactaattaaatgtttcattgcatttttgtaagaacagaataattttataaaatgtttgtagtttataattgccgaaaataatttaaagacactttttttttctctgtgtgtgcaaatgtgtgtttgtgatccattttttttttttttttttaggacacctgtttactagctagctttacaatatgccaaaaaaggatttctccctgaccccatccgtggttcaccckcttttccccccatgctttttgccctagtttataacaaaggaatgatgatgatttaaaaagtagttctgtatcttcagtatcttggtcttccagaaccctctggttgggaaggggatcattttttactggtcatttccctttggagtgtagctactttaacagatggaaagaacctcattggccatggaaacagccgaggtgttggagcccagcagtgcatggcaccgttcggcatctggcttgattggtctggctgccgtcattgtcagcacagtgccatggacatgggaagacttgactgcacagccaatggttttcatgatgattacagcatacacagtgatcacataaacgatgacagctatggggcacacaggccatttgcttacatgcctcgtatcatgattgattactgctttgttagaacacagaagagaccctattttatttaaggcagaaccccgaagatacgtatttccaatacagaaaagaatttttaataaaaactataacatacacaaaaattggttttaaagttgactccacttcctctaactccagtggattgttggccatgtctccccaactccacaatatctctatcatgggaaacacctggggtttttgcgctacataggagaaagatctggaaactatttgggttttgttttcaacttttcatttggatgtttggcgttgcacacacacatccaccggtggaagagacgcccggtgaaaacacctgtctgctttctaagccagtgaggttgaggtgagaggtttgccagagtttgtctacctctgggtatccctttgtctgggataaaaaaaatcaaaccagaaggcgggatggaatggatgcaccgcaaataatgcattttctgagttttcttgttaaaaaaaaatttttttaagtaagaaaaaaaaaggtaataacatggccaatttgttacataaaatgactttctgtgtataaattattcctaaaaaatcctgtttatataaaaaatcagtagatgaaaaaaatttcaaaatgtttttgtatattctgttgtaagaatttattcctgttattgcgatatactctggattctttacataatggaaaaaagaaactgtctattttgaatggctgaagctaaggcaacgttagtttctcttactctgcttttttctagtaaagtactacatggtttaagttaaataaaataattct

SEQ ID NO: 17567 - DNA, 42419 bp, Homo sapiens
agctgcaaatgtttactgggccttgagcgcatcaaatgtgctatgtcccaggccgtactcactattttgtcctatccctgccaccccaaactgttcatcccccatcccagttaatatgctcccattcactcatttccttccatgttttttctctttttaaaaaaactctaatcccataacagattacacccgcattaaaaaaaaaaaaaaaaaagagtctcattatgttgctgaaactggactggaactcctgggctcaagtgatcctcccacctcagcctgcagaagagtctctgcccacccccattttattagccatttatatccattcaaccttcaaaattcattaaatctgctcctctccaccatccccatacctctgccttgtacacatctgtatcttctcttgaatagactccagtccaccttctcaatatccccagagccatcatagtgacctttgaaaacacaaatgtgcctcccttcctaaaaagtcattagtggttttacatcatacacagaatagagatcaaagttctgagcccctgttacaacattgcatgtttgtccaactgcctagactctgaccgccaccaaggcagggaaggtctgcctccgttatctttgaattcccagtaactgcttggatacacagaatatcatcaatattaagtgaattactgaaagcaggcagaggaaaagtataaaaagcaacctagttttaaactctccctcatgcaagtttatatgatgcaattttctacaactctcactaccagctcattcatctctgctctgaccatgaatagcaaagaaatagaaatcatattttatttgacaattaacaaaagacatatcaaggtgggtatgtggtctcagtataaatttttttatactaggtcctgaccctaccatttccaggtgtataaccctgggtcagagacttaatctctggcctcaatttcatcatttatgaattggggataataatagtacctaattcaaatggttgttaaatgaggcagtgtgtggaataagaagtgctcaataaattatacctgtagttgttacttcagcagaccccttcattaagcctgtttcattaaggcttctaaaaggagtagaacgtacggttcattcatggagaactacaaacaatgctgctttggacaatggaaaacgtgcatgcatttcctagaagaggatgtaacatgtctttactttttccatagagttcagcccatccaaagtcagcctcacatggaggttggggagtttttgtatctttctcttcctgctcccctcttttctcccagtgttttcttcctctctgtcctcttccccagggttcaatggctcctggaagagaggcagcaaagcctatagctctccaaataaataggcttgggtctcatggggacaggcaagccaactggcctagacgtgaagtttacaaagagccctaaatgttgactttcaacattatctcacaattcatttattcatacatcacaaagatacagtgacacaactgaaaaaactcattcattttaaacttgagttccatgactggaccactcttcctatagcaaaccaggaataaatattttttatgaattgcataattattttgtaactagcacattacattgtattttatctctgtttatgaatttgacctctacaaacaagttaatatcattcaacctattatttgaagatgttaatttgttgaacataaatattaaaaaaaaactttatgtttctgttatgccatttcttcactttttaatatgttggaattctcagaaaacggcctggctgtggggaggtttcctttactctttgagaagccacggagtgaggcatctacaaggcaaatctttcttttgctgataataaccatctttgatagcatcccttcaatgcatttttgttccctttttaaaacagaagtaaggagaagaagggataaaaggaatatggagggccgaactccctgtcacatattatataaaattacaataatcacgagtcacctatttcacaaattactgtgagcgttacaattaagaatacactgcaaagaactttaaagagttaaaagtacaattatgaaaggcagtgtgctccagggaccatttcagtctgtgaactctttgtttctggtccatggctagttaagtataaaaaattgaaagtaagcatttagaaactgttacagaaatttgacaaagtaattttatgtctgttgaaccaaataataaaagatttgggcttgtattttgtatgtctggtttttttacttcctcttccagtaagtcattttcattgcattttacaaaggccaagaaaaacctgtccttcactgcacatagtttgagaagcactgataaaaggtattattatttctgaaattttgcttaaaaaaccacttaataaccactaaataagtcagaagtcattatttgagaaatactgtttcataccaagtataaggagttgccagcacacaagcaagttccagaacaagtttgttttgtattgagtaacttggttatttggtagtcagaaaccactttccccaggaaacaaacgtaaaccaggggttatgttcttggtgtggcctatacatcctagttatctcaaaagacagctaaactatactatacaatgtaacaaccactataacattcttacaatggtttctgatttccaaattagaaaatacgtctcatctccatccccatgtgaggaatgacaattccagccctagcatggtggtggggctgggggtaaagatggatactacttctgcaaaagttgcttcaaccgcaacattcagaaagagaaagaatatgggggtagaagattcctcacacagattattgggggaactcactggtcatgttaataaagttaaaataaggtttccatttctcttgattctctgagggtgagcttaggtaggttttggtggacttgaaagtcctggctcattatcacaaatgcttccatgctaaatcccaaggtgttgttcctcctgaccacccagcaccaagatggcaaacaggtttcatcctgaactgaaatctgttccctagctcagggattcttatttcccttttgttgttgttttaaaaaattgtgaggacaagtctgggtgtgatgagacactttgccaaaatcaattagtgacgcctaccatgggccagggaagaaaggaaagtcagcacaaaagctggttttggttgttgttgttgtttttgctatcctgagactagcctaaaagatgtagacctccaaccctttaatgtcacctggaaccaggttgaagaacatgactattaagaacatgacttttttctttttaaaaaattgggaatagcaaaagggaaatagacagagaatagcatatacttggatattcttatttgccatctatgtggtttcctcattttgcagaacttgtggaaagacacggtagcctggctcctgacccagaatccatgaggcatagttgtatgtacttcccttggggcctaagagattaagagagaagcccagacaatagtccaaggccctctgctttaggtctttcttctaaattctgattctttaatttttttttttttgttaattttaattttttttttgtagagatgggttctccctatgttgcccacaatggtcttgaactccccgcttcaagtgatcctcccacctgggcctttcaaagtgctgagattataggcaagagctaccttgccaggcctaaattctgattttgtatctgaggctcttctcttcctcaataattgacaccaaaaatagtcctagaaaggagattccacccttctctaaacagtcatagccttagcctatgtcagagttcttaacccagtggtccattgatagttcagaggaattaatgaccttggataagaaaaaaaaaatcttgatttcaaatggaatttagcattttcttcaattacaaaactagcagacaaacctcagaagcatttgcagtactcgtgactgttactaatggaaataacagttattttcattatttcattatagttgttttcagtatcatgaaagaacatttgcactcctctttatttaaaagaatgttgctagatcttgttatttaatatgttaaataatgttgcacacattacattaccacattactatagcaaaaaattatgttttagatattttaacaattacatttcaattgttgacctttaattttaaagctaaggcaaaattaatgtaagtagagagtttatttgggccaagtttgagtactgcaacccaggagtatagattcaagtttccctaaatatacactctgattagcagcagttacacatagatttttaaggggaaggaagaggcagttcctaaattccttgcgttaaaataacataagctgtggattggttatactttgttctttgtatcataaattccaggaatatgaagataatgggtgggacagctactcgggaacaaaatgtctttaaacaactgtccccaggcatgggtattggggcgtgactgaagtcccatactcatgttgctctgggcctgataaattttgcatacctcacaaagctcagactgctctcagctattttttttccttacaatgtaattgattttctttgcaatctatacattttattcatttatttaaaatttttttttcttctttctttttttcatgaaccgcacagagaaaatttatgcattttattgtaagcatttataaacattattctaagaagttatccacaggctcaccactgccagaagggtccacgacacaaaaaaggtaatgcctcatgggctttcaaaggacaactttttacttctctttctaccatccagtataatccaatatccttaggactgaagcagagatacacacacacacagggagagaggtgtttgtgcttttttttttttttttttttttttggtgagaggcaggtgggaaattggcatccacttttatttactggttctttataaaactgatatttgttgaaaattgtcaagtgtgaccatttctgcctacatattgtagggtggcaattaaataccgaaaaccattagaagcttatttcagatgtactcatttattgtaatggtatcaatcttgatgggtaaatttcattttacttttaaaattgtattttaaattattccttcatgttacggttgttagagtaaaaacggaaaagaaaaaaactacacttcttccctttgagtttggatgaaaaagacgtgtctaagtccttaagtctgtagtctggaagtattaatagaggctgggcatggtggctcattcctgtaattctagcactttgggaggctgaggcaggaggatggcttgagtccaggagtttgagaccaacctgggcaacacagcaagactcggtctccacacacacacacacagacacacacacaacttacacacacttagctaggtgtaacggtacgtgcctgcggtcccagctactcaggaggctgaggctggagggtcccttgagtccgggaggtccagactgcagtgagctatgattgtgccaatgtactccagcctaggcaacacagcgagaccctgttaaaaaaaaaaaaaaaaagtattacgaggcacaggatgtttatttattcgcaactacgtcctgttataaaaagtagtgattccaacgtgaaatatttacacgacgcatcccgttactttccctcccttggccaccgacccccatccccaaaagctgctttctatgtaagtttctcactggaatagcgagtgagaaatgtgtttgaagactagggaaacgagaaaggtatgcgggctgctagagggtttcgggtgggttgtttgaaaaaggaagtgaaggaattcaaagtttcacatcatgagcctaatgtaaggcgtgtccgggccgtcccgaaggtatctggggaaataggtttgtgaggacaaagaccagggccaggcccagggcggagcctccgcggccccgacgcagggactcggcctaggcggaggacggggcggagcgcggccggcaccatcgagccgggaagatggcaccgcccacggagctgctggccaggccggagcgaggcagcgcgcccggctcccgcgccatggggcggctggtggctgtgggcttgctggggatcgcgctggcgctcctgggcgagaggcttctggcactcaggtaggtgggactcccgcgcgcccctcctcggcggtccccaggctcggggtggccgcgtggtgcggggagggcgcaggctgggggagggattcctgcgggacctggccctgcggccgggggtggagaatttttgaatgctgtccctcccccagctagttgaacccccatcaccccgactctccgcttctagtgaaaaaactagcaaagtttggagtgaatcgcgacactttcttgaaagtttataagcccttgctgctaacaaagttctcttctgcttaggctgacaagagaatgctttgcaattacccaagggccaaactagtggtttaaattgaaaacaaaatgactactcatgcattgaaaccttaactatgaagatttatttcaggtcattggtgctgtttctccttgttgcccaaaccagacccgtctttaataaagttgttctccacccatttctgcatagtttgagaaactcttcagctgtmgatcaaagacacttgaaatattcagctactgttcttacttcctatttattcaccagggaagcctgaagccagaatgccagacagcgcagacactattccatctcgcattttagttttaatgaaaatctctggtaggtagacatcatcgtttataaattaccaactcaacgtttgttttttgtttattttattttttgtagagatggggtcttgctgtattgcccaggctgttccctaactcttgcactcaagcaatcctccagcctaggcctccccacagtgctgggattacaggtgtgagctgttctgccctgcctcaaccaaaattttataggcctcatgcaaaagagttccagaaagactgagcacctgctatgtgtaatgttctctcttaggcttctatagtagagtacgacccttatggagtttgayacaggggaagagagaattaaaatacagtaaatgtataaattaggatgttctaaggacagacacaaatgaaccgcataggcttaaagaggaaagattccatcccctgagggtggagttctagagggaggaagagacattcgacctgaccttgaagggtgggtgcaacacatatgagcatgaaggggcccatgccaaatgtatagtgcagcaggagcaaaggggctaaggtgggaagttggaagactagcaaatgggccaatttgaagggarcataaagtcaggagatgagaatagtagggtggtgggaaggataggttttgaggccattaaatataagttgaaaaatggggccccactttcataggcccaatagtgcttcaaaagggaaatattggtgggttttgcttttcaacaagaacttaatataactagttgtgttttatagagataagcctggaaggggggattggaggagarcaatggttctctgtacattagaatctcctggagggctggtgtctgagtggcaccaccaaagattctgattcagctgttctggatcagaatctacagctcacacctgtaatcccagcactgttggaggcctaagccagaagattgcttgagcccaggagttagtgacaggcctgggcaacatagcaagatcccacctctacaaaatgaataaataaataaataaataaataaaaaacaaaatttgagttggtaatttataaactatggtgtctacctaccagagatttttcgttataattaaaatgtgatatggaataatgtattgtttggcaagctggcttcagggttcccaggtaaatagataaataaggaagtgcataatgtaagaacagtggctgacagtagcagtggcattttttatttttaaaaacattcctgataattctaatgagcagtcaaggtcgagaactactagaatagagagcagacatggggtaactggttaaggtattgcagtaggtcagagaggataacagggacccaaactctggaaccccagggatgagggagaagtcaaaggtgctaccagagtttgtgccacagctccactgtcccatggttgtagtttcatctactgataaagcagtgcaaagaggaagcgtgtggtggctgagatgggagtgagatttgaggaaagaacgcttatgggtaggaaatggacatgttgaccttaattttcatgttaggtaatgcccattgtgctctacagaacattcatgagttggatgactttgtatatgatctgtcctgctctccatttcaaaggcaagaccaccaaaattcacaagcttattatgttgtcactaatgtgyaagccaccagtttttctgcaagttggaagttttctcaacagtcaaatattcccccttctcactaatcttaaggttttaaagttatagctgcaaatctaaaaaaaaaagaaaaagtaaataaaacttattgacagaatgcctgatagtttatttacaggtttttgtttgtttgttttttgtttttctttgttttttattttgacacaaggtcttgctctgccgcccaagccagagtacagtggtacatcaaagctcactgcaatctcaaacacctaggcacaagcagtcctccctcctcagcctcctgagtagctgggactacagatgcatgctaccatgcccagctagtatttttatttcttgcagagacagggtctcactttgttgcccaggctaatctcaaactcccagcctcaagtgatgctcctgcctcagcctcccaaagtggtaggattatacacatgagccaccaccctcggcctactttacaatttgatgcaccttttctttacgtgactgtgatgcactttaatgggcagtgactttataaaatggtaactttattggatatgtggagccccaaatgggctgacgtgagaatgttggggtaggtggtgggtggctggatttagcaaagaaaaatgtaggctacccagttaactttgaatttcacatggattttttttttttttttagtataagcatgaaatacttataccatacttttagcattaagcgtggaatttgggacataattatactaaaatatcattcattgtttatctcaaattaaaatatcactgggtaccctgtattttatcatatgttcgagtgccttctgtcagaatttggtgaccctttgagtctgttttaaaaaggagcatgtttggccggacacagtggctcacgtctgtaatcccagcactttgggaggctgaggcgggcagatcactagaggtcaggggttcaagaccagcctggccaacatggtgaaaccccgtctctaataaaaatacaaaaattagccaggtgtggtggtgcatccctgtaatcccagctacttgggaggctgagtcaggagaattgcttgaaccccagaggtagaggttgcagtgagccaagattgagccactggactccagcctggacaacagagaaagactccctcaaaaaaaaaagaaaaaaagcatgttcccacctccccataaggaaaggctcttcagaggaagttgaaggaacagaggctttatgtttgatttttgctttaatctgatgcctactgtttgattattcaatatttagagatggtactttggcaatcaagttatttctctccccaggttgcccacttcaatttttagtataaggatgtcccagagggataaatgccatcaaagttgtctttcttcttctgaactgtaactgggattccacaccctccttttccacccctccctagttgagcaataaaggggaaaataacagtatacaaatattcccaggccagttcctggtgtcaaggtacacagccatggatgaatcatgaggcttgagtgcatcagagacctaagcgtgggcaggaacccccagagtacccatgtgaatgytctgcttgctgcctcgcaccttttatgacaattcccacaagaagctatgtggtctgtttctacttctgaaggagcagcctttttccctttttttttttttttaaaccaccatcctttaaatcatttattatgtaactcttgtgtgctggtcagtcagtgtgtcaaaagtgtaaaaacttctttatttatttttttaatctatcttttaaaaaatattttctttctttttttcttttttcttcaaggcaggttcttgctctgtcacccaggctggagtgcagcagcacaatcatagctcattgtaacccagaacacctgggctcaagcaatcctcccacctcagcctcctaagcagtgaggactataggcatgcaccactacacctggctaattaaaaaaacatggccgggcacggtggctcattactataatcccagcactttgggaggctgaggcgggtggatacctgaggtcgggagttcaagaccagcctgaccaacatggtgaaaccccatctctactaaaaatacaaaattagccaggcacggtggcacatgcctgtaatcccagctactcaggaggctgaggcaggagaatcacttgaacccgggaggcggaggttgcagtgagccattgcactccagcctggcaacagagcgagactctgtctcaaaaaaaaaaaaacaaaaaaatttttttgtagagatgggggtcttgctgtgttgcccaggctgatctcaaacttctagccataagtgatcctaccgcatcaacttcccaaagcactgggattatgggtatgagctactgagccctgccaaatttctttatattaaaccaaaacgtacatttactgatatttggaaagaaagctcttttacttttatgccttcatccagtcttcatagatatcttcccttttacattataactgtaaatactgaggttagagaggttaactagttagttcaacagaataatataaatattgaataatataattaatgaataattagtgctgaacctgtcgcctcagccaggtctcctgattccaaatacagtttgccccagctccccacagtcttctagcttctctgccagtggagcaaattttccctaggtttacaggcctaagcacagattcttagttacttagtgcaagtattgccagagcccaaggggtgaattccaaagggtttttacaaggctatacataaaagataaagccctggcttgtatatcacttgcacataggagataaagccccagcagttgtatgtaaatttcaaaagcagagaagtatggcacaaagaaactcctgatagtaacactgtgttcccactttgcttaggggcatattggcaccgtagcatggtacacccttactgctacctgccatgaggccagataatagctagcagcccctggtctcattctactctggatgggtactgctgtttcctgaatgaaagacactgagattgatttcatgctaatgactgttggttaagagttcatgctttctattcacaatagcaaagacttggaaccaacccaaatgtccgtcaatgatagactggattaagaaaacgtggcacatatacaccatggaatactatgcagccataaaaaaggatgagttcatgtcctttgtagggacatggatgaagctggaaaccrtcattcttagcaaactattggaaggacagaaaaccaaacaccacatgttctcacttataggtgggaattgaacaatgagaacacttggatacaggaaggggaacatcacacaccggggcctcttgtggggtagggggaggggggagggatagcattaggagatatacctaatgtaaatgacgagttaatgggtgcagcagaccaacatggcacatgtatacatatgtaacaaacctgcacgttgtgcacatgtaccctagaacttaaagtataaaaaaaaaaaaaagttcatgctttgtggacaggtagcctgagttcattcatagctctactatttacctgaaaccttggactaattatttcacttttctgtgccccagtgttgtaatctgtaggatggggtactgcctgctccacagtgggactatgagaatgcttaaaataatgccaagcgcacagtcagctcaataaatgtcatctatgtagacaatgaaattcaagcataattccttaaacctttgtgccatacatccctttggcagtctggtaaagccttcattccttctcagcatcatgtttttaaatgagtaaaataaaatatataggattacacaggaaaccaattaaatactgctaccaagctatttaaaaatctatgatataatatgctttttwaattaaacccttaaatggatctagaggtaggtaaatgtctaacagcagatattttgaagttgcaatgaatgtaaatggcactttgagctatctacaactgaaatgcgatagaaaagtatctataatttctattagtgacagtcacaaatactactaatagtattgtggtttgttgcttatactcatcatcaaaggaaatactcaatttgagttaaaggtttaaataaagatgtatttttcccccatccaagttcatggatccctgaattctacccatggattccttggtcactggactccataggggtcacttggggaatgattgtgacaccaatgaaggaagccagcggatactgtttgctgtattatacctaccataggctcgtgatgaggaaataataaaataaataactgtaatgaaaaagaaaagaaaggaaaacaaaaggaacctaaaacagagaaggcaaatagctttccttttgagtgtcaattttaacagactccctgtggttgcgaaacaatgtgtctgaggctggctctgggttagagggagagtgctgttattgattagcaattcctgcatgacagcagagtggcaacagccatgcatctctgacctggcacagtcataagcatgttatagacataaagtgttagggaacaaataggctctagcaaaagtaaagagtgttcctcctctcatatcatcacttatatgtgtttataccatttatgttgtattttttacatgaatacttttagatttattaatctaatccaaaaaggtttgtatagctttctctatattaagagaaatatatgtatttcttaaatacacaaagttcttaaatctgatgccagcgaggattgcttccagccacaagtaacatatatcagattaatagtagttcattcaaagagggatttattttcctcacatgaaaaacagctctgtgggtgacccaatatagagcttgttcattgagccagtgattatatcaaggaactgggttcttcatatattttcattctttgatctccccctattgactttatagctgtatctttctcaaggatgcagaatggctgccgcagtctcaaacactgcgtgtgtgttcaaatcatgaagaaaggagattgagtgatgccagctagctctcttctcgtgactctcctttgtatctagaacacagtgtctttccccaaaacctgggtcatatgactacacctcaatacagcggagtctgggaaagcaaatatttgctttgcccaccactacaatagaaacgacaagggagaaagaaagggggttgggcatggcgttaattttgtcagccgctagggtctgccacccagaaaacagaagtccactaacaagcagggaactgattgttctgccagggaaaaagtctggcagtttcctactgaagaaatttggaagtcttgatggtccaggaaggataaaggcaaaaccttcattttcttttatcaaaaaggaaagccaagaaaaaaattagttaagtagaagttatgcacaaccctcatgtaactcttccatgttaatagcaggtaggctgcatatgaaaacatgatattatacaagaaaactagttgatgaagattgccctatttagcaccaattacttacgcaaacctaagttgactctgaaacaggaaccccatattaaacttttcaaacacatcagaatatgttactttgaacagattttatttaatccaaagagattatctttgaaaaaggtagatggtaaacatcgttatccctatttttgtatagtcaaataggcatagtagtaagttgtgtaaaattgacatccaaaccaatgcatgatactaaaacttggtgtacaaacagcagttacatcctattgctttgtatctacatctgtttctggagtcatataacatttgtagaatcttggaggtgttttaggctcatccttattttatccataaagaagactgacacctatagagattaactgacctgccaagggtcatggcagtttcactgctgagacaagaacacagatccctttacttctttctgagaaaagtacaaagtagtttaaagcaaaagcttccctgcttccagcacttctggctaagttgcgccgtgggaaaattgttttgtctgattcagttttctcatcttttaaactggaataatgctacctaatttacagggttgtttgaagaattaaatgaatgcatggaggtaaatcacttagaacagcggtaaattatacttttttattatttatttcctttgaccacccacaattatcatcagtgtcatcctcatcatcacaattaagattactaccacattaggctacrtaaactttttttttctctctctctttgttttataatttcaattttattttagattcaaggggtacatgtgcaggttttacatgggtatattgtctgatgctgaggtttggggaacaactgatgccatcacccaggtagtgagtatagtaccctatagtttttcagcccttgtctactcccttcccttccccttctagtagtccccagtgtctaccatcgtcatctttatgtccatgtgcaccattgtttagctcccagttaaagtgagaacatgcagtatttggttttctagcttatttttcctctcttaaatcacttctgtgacacgtaggccatgagatttattgtattttttaatgccttatttaaaaatttgtattatttaatacatttaatgcattattttttattatatttaaatattgatttatttgtactttttgccttattgctatattgtttcaaaaaaattaacattatttgagttacatgatttcaaatacatactgattaacattttaattagaaactttatgtctgatatgaattgccaaaatgtgtagttggtacaacctatgagtcattctgggttatctagaagaaactggtagcctgccccatactccagaagccttccccagtgtctagacctcagaagctgtcaggaatatgcacaggagaaggacacatggcaaatagctatttcgtctcttaaatgtatggtatgtgggaaccactgaaaaatgtaaagtttctacaaggtgctatttttattatttatggctctagagaacagagaaggtgaaaaatgtgagagagaagggaaagccaatagtatgtggccttcaaaacaaaagatcccacagatattgtcccaaactgcttcctggccctctagagtggagagggagggggaagacatcctattagagttcaacattctcttattatttccttcttttaattttctgggtatacaacagcaaatagttttgctgaagtagttacagaactagttggtgttctccaaccttcctattccaatacatactgtcatggatgggtacactaaaatctcagaattcactgctatatcactcatccatgtaaccaaaaaccacrtgtacccccaaaagctattgaaataagataaatacattcttatttaaaaaaatactgtcatagggatgctaccttcttttcttttttgttagtaactatttgtgggatgtctttggtgtgtcaggctctgagcaatgccrttttctcttggcttctttgcagtctctgtgtgaggcttacagtcatttttcacgtttgactcttcagaaggaagacagggctwctggttctacatctggaactcttttcccacaacaccaacactgagaaatgtgacatggtgctgtgtttacatttgcataggaacttgcattataagttttatttgttgagttattggctttttttttttaataacccacatcagtatatagaactttgcaataggcatttttgttttaacttcatttctggtgcagttttattttcctacccttgtctttctattttctctttcatctgctttagacttmaactgtgttttatgtattgctgtaagcctctttaaaccctttctaaaacaaagcagggaatacataaacaaatagttttttgttttttgtttttttttctttgtaacagaaatcgacttaaagcctccagagaagtagaatctgtagaccttccacactgccacctgattaaaggaattggtatgtatatgaaaatgcttgttgggcacattgcattttttggccattaacattaaaacactcattaatggcattttagcatgaaattactscttttcagtggataaatcacattagatcaacaaaaacctctttggtcaacctcttgatctgatgaaccctgtatttattcttctttcctaccctcactgtaaattattcttttttgtgtgtaattctatgtttagcatttgatttcttgcttgttttgtgacttctctgaactatttttgttgcgtctgtattgtttgtcaggtatggccgctgcagtctgtgttctgtgagccttgtggtcagctagtgaaggaagctttatgtaggcagtgacagcatttaccctgctcactactctataactaggatctgatcttayggctaacacgwaactgaccaatatggtttggttgtgtcmccacccgaatctcatcttgaattgtagttcccataatccccacgtgttgtgggagggacccaktgagaggtcattgaatcatgaggtggttaccctgtgctgctgttctcgtgatagtgagtgagttctcatgagatctgatggttttataagggcttttcccccttttgctcggcacttctccttgctgccgccatgtgaagaagggtgtgttttcttccccttccaccaagattgtaagtttcctgaagcctccccaaccacacggaacagtgagtcaattaaacctctttcctttataaattacccggtctcaggtatgtctttattagcagcctgagaacggactgatgtaccggcacttcacaatatgtattgtaaaaacttgtttttattttatcttctaagctatgactgcagagggggagtctccctcttcccttgactttatgtaggatgtattgtggagtctgagtctttgagtaggggttcctaagagcaagccccaattttgctatagataaggagggatctgtccagattcttctccagcactgagggtctctctggtgtgtttgcagtttttctccaaggtagagtctgtgtcttgctgtcttttaccctttatcatctactaagtacatgtccctagtacataatagactagtagttagattatcaatgaacaataaatattggctttccttttttttaaattttaattttttttttttttttttttgagaggtggcctcactttgtcayccaggccagaatgcagtagcgcaatcttggctcactgcagccctgatatcctgggctcaagcgatcctcccgcctcrtcctcccaggtagctgagactacaggcacatgcccccactcatggctagttttttatttttgtagagacagggtcttgttatgttgtccaggctggtcttgaactcctggcctcaagcaatcctcccagcttggtctcccaaagtgctgggattgcaggcatgaggcactgagcccagccaatattggctttccttagatatggttcatggtatgattagaaacaaaaagaattagcagtcamaacacctagtttctagttctattctgccacaatgtaaccttaggcaaagttggtttttgtatttgtcacctataatgatgagtttgtgattagactaatggtttttagactttaaaaagcctgggaccatttatttataatcttactctgagagccacagtgtggaaataactagactgtcattgagtcacttctagtcctttacaacaacatccttctctagaggtaggagagacaatttaatattttgttttactctttagaaattaaaactcgggttacatggaaatgtkctcttctctgaataggtaacattgttaaacaagttttgagtgtccttccatctttttctttttatgaatactcctgtacataatttttaaaaacataagtgaggtcaaattatgcataatatttcaaaactagctttttgtacttaatactaggttttggaaacttatgtttgtacataatgttaccttttcttcacaactgcacagtattttttgtgcaaagttcatataaacagtgtatgtgcaaacaatatagaaagatataaaatggaaagtaaataaaaataaaaatctctcatcaaactcttcatcacccccaacagaaataaccccaaagataaagctyccttttttatctttcctgatagtttcagtgcatttgcaaacaaatatattgactctttttttcacaaatagaattttagtgtaaatatttcacaaccttcttcattcctaaaacagtgtgagcagctttccacatcagcatatatagttactttgttctttttaatattttcacattccatgatttatttaaccattccccttttaatgtacatttgggttgttacagttttttgcaactatgaacaaatcagtgaacatcattgctgttgagtttgtgtgtctgtagaatatgtccttaacaatgggattgttgttcccttagaatatgtgtttagagttttgacagtcattgctaagttgctctcaatttggcaacagtaataaactcagtacctcatagttgtaaccacattcactccagacagagttctcagcactcttttagtaaaaataaaccatcagttgacagtgccaccttcagagtttctctacaaataccttgcttgcctccctttctttttttcttcttttaaatcagcttcctcaggttgatctgcctctcattccttaggcatctgtttcctatgtgttctttctmctttttttcattgatacttttgtatttccccagttctacctcccctcccctagactggttggctgtcctggaatttcccttccttctttcaattgcccaaacactwagtgggaggaggcaaactcatatcaaatagcagattgactacatctgtgctggatcatgcagacagttcaagagtcccaagtaacttagcagcttcatcttgccttccagctgcaatcaagaagagccctctcagaactggtcactcagcaaaagccagatggcattagtaaaagatgttgggcaagggtgggagtttgggccagtgatctcttaggttacttttgctgctgagttaataattgtcacattattaaacagcccttggccctgggaagcccaccttctgtgaatacaagtctcagagtagacaatagggcacaaccagccatgttacatgacagactgccaagtgcattcctcttacaactcactgggatggagcgctcctcagagaaaaacaagcccagcaacatttgtattctgaacaggcatctgtctatgtttgtgacctttatgttgtgatgtgtgtgagctgctgtctggaattggaaagaatgaggaaatatgtcacctatggcccctcttgtgaagtgttaaatgcctctgaggcacttcaaaaggcaacagagcggagaggatgagtgattagaagcacatttgggatacatttttagatctaattagaattgtccttttttttttcttttttgcttttgccctgtggttagcacacaccatatgaacgtttgtcgaatgctatgttagtgatgcataatggttaataataacttttggttatatatctttaacaacagttgcttattcacaggtctttgataagaagaaataacaatgtgctggacacacatttctatacaggcaaaagtgactttttatgatagagagggctgtttcttattttctgttttgaaaacagtagtagctatgcacttgaggccaactaatccctctaagaggtgaaccttccttcccccttgcccttgattcccatcaacacacacatacatatgcacacactaccgtgcttcagtcaccatcactggaagtgaactatgtgcaacttttgggtgctttatatatatcatatcatattgtgtctgctttaataaatcatagttattgactacatatcatacaggatgtgtgccttctgtgggtcagaaartaagttcactatttagtccttttcaaaaattccttcccgatctatcttatagacagaaactaagcttttatacacccaagatttggcagattaacatctgcatattaaaatgtcaagagctagttaactttatttgaggcttaaaagttaaaaaatctgattttctaaatgtctggccttcaaaatttgagtggactgtctttctcaagataactaacaattttatgcacttggcagtcaagacctttacaataactgctgcttgggagattgaggggaaaaaagcattaaagtttgtggcccttataatcaagtactttacagtctactgatgggagaaaaggaaaacaaaacaaaacaaaaaaccactgtgagatatagatatgtcttttctttctctagcagataagtacctgaggctcaaggaggttaagcaacttttgcaaattcactttccaatatagtgtcttttcccagggtgactaatgtatatacttgatgagtgaaccagaaaagtaggaaataatatgttacatatgggatgctctattgggtatagtaaaggatgcgttgctgttataaaattatagtcacttagaaaagagatgtttatttttatttttctctcatcagtcttaaggtaagtgaatggcctagggtagttaggtgactgtgttccatatggtcattcaggggcaaatgctgatgaagcaacacagctgtcttcatctaagactagaactcygcttgttgccatttcccagcaggaaggggttgaaagaaaatttatgtagatttttttttctacccagtagttgcatatatattgtattctcacatcctattgacccaaacttagacatatggccacatctgtcagccagaaagggtgggcaatgttatctatagctgtgttgctacgtgcctattgctaaaaaggctaaaaasgaagaaggggaacatggatgctggtgaacacttggccacctctgacacagataattgctaaagtaataagaagagatggaaattaaatgtgctaagctaggagactttctaaagaaagggtttgtcatgctacgctgtgccattcatgtgtttttttgctcatgctgttccttgtgcctggaaattctccccctaattcccctgagcagtggatgcagtggataccctccccagatcccccccaacttccctgagtgttggctaccaaaagctctgagtgcacccagggagctaagtcctcctgcccacaggcaataatggactgacacggggtagacttaaagaaataagaggcacatcaatcaattgaaatgtgtgggaccttacctggactctgaattaaacaaactgtaattttttaaagctacaccttttaaacatgattggctatttgaacactaactagatatttgatgatattgaggaattattgtgaatttttagtgtagtaatgatattgtggtttgtataaatatatttagggataatatgatgcctcagatttgctttaaaataacacaggatgaggataagtggtaggactgcaagggaaacaagactggccatgagctgataactgttgaaggtgggtactgggtatataagggctcaccacaccattctcttgatttgtgtctatttcccataataaaaagtttaaagagagagaaccgatgaaggggagggagagagtcaagcacacaataagagtgacaaacagtgccaaatcagcccacagtattaagttttcacatatttacataaatatcacctggaatgcaatattgaaattaatgtatatcactagaataaaaaaagtaaagatttaataaatttgttttgaaataaaataagttgaaatacgaaaaagacagaaaaggttttgaaagaggttttaaagaaaagtgcaggatattcattggtaaagatgttggtgagaggcttggaagcaaaacttcaggggaaaaagacaacatatggaattgaccacaattgaatttacaagtgaagtggctttacagaggaatcaggggatgtttytgagagaggaaattcattaaattctaacttgaatattttctgtttgcctttaagtcagagcaaaggctttgagtcccagcttcccagtttgtgaccttgagcaattgcttaacttttccaaagcctccaatagtcttcactctaaaataaaagataatcatatgagatattgtatgcagggtatttacaaggagcctggtacttggtgtacctaatgtatgttagttattattattaaattagaggagcaaaaatttctctagcattgactgctcctgacataatcacaccgaagaggggatacacgatgataaaaccttcctgcagtagtggctatagaaatgatgacggggagaagatctggaaaatattccaaagaaggctacagatagatacattttttccattggaattaggcaatggagttaaacagaagttacaatatggttgaaataaatgtatttttttwaaaaaagatttctctttccttaattattaaaaaatatacaattttgtagaaaattttaaacaaagtataaagaaaaaaataaaaatcattcataatcctatcaaagaagcattgttaattttttctatatatcttctttttccacgtgtatacttggaaattaaattttctaaaataattttcaggaaaaacaaattttaattaattgagcttctactaaataggactgaaaagcaaaacctggactagaattctctctcggtgtgtgtgtgtgtgtgtgtgtgtgtgtgtgtgtgtctgtgtgtacatgtgtatgtgctgtgtatacatgtgtatgtggtgtagcgttcccctgattcttaacttattaccagtggacaaccaccgtggaactagagtctagtcattcttaacctttttgggggaatcacagtctcttttttgaatctgatgaaaatcaaggaccgtttttacagaaacgttctcatctgtgcatacatgagacattttgcattgcatagaatttccgagggttcacagatactttgaagcccaaaagtgatccacagaccccagattgagaactcctccrctatgccatgcttaagcttatttctgtgtatcttctttctgaggagcaggcagatgggtcatctttacaatgtgaagttcttggcatttttattttgttttgtttttctgcactacgatggagcaagcaacactggaggcaactggctaaatgcaaactcatgaagcaagaccaaaatggctggatagatagatgctgtttggttttgacaacctagaaataaccttgaagaaatcctatggagaagtcttaaagaggaagattggattttgtagactcaaagaatgtgtcatggtttggcttaatctaagccatttttattcttcttttcttgtgtttgggtctattatctgtctgtagaatttatacagtgagactgctggggaaagtcttatgtctaattatttgctgtgctgtgtggagtgtactgcagacagtcaataaacaatcaatagtaattgtagcctgcctcagagacaggagttagaaacttcaactggcttaggtgcatggtatttttcattaattttcttctgctagtttttttctctaatttaaagcctaaatttaaagattaaatagaaaagctttctttgcttatgagcacaagtaggcactgtttttaaaagaaggaatatataatcccaggtgttttacctctgttaatgagaaagatgtctgtttgcttcagattgaatgagcaaagaagaggacaaggatatttgcatggttaaatgcctatgagcccttccttcagaaagtaatattcccctgatgtcaattacttttatacggacatctggatgtttatcatgagagtgtacagatgtcaactttttcagtattatagctggaaatgtggtgataacttgactttgatttgagtaaacataaaatatctaacatttaaagtcagaagttcacttcaggaaggggtttaaactgacatttattaaaaagaatggttccttggaaaaaacatcagaaccatccctaaagatacagtcactctgataaagtaaacagagtcccagttatgctctgtgtaacaaataacagaacttgaacatgacatttatctgttccttaaacttacagaagctggctctgaagatattgacatacttcccaatggtctggctttttttagtgtggtgagtgtcttcttccttccccaaattcagcagaggagatacaagggtatttgatgagggctgcagaacagtaagttgcttttaaaattcattttccaaaatgcattctgaagaaaagagaggtcaaacaagatcttggaaaacttcctccagcttttctaaatgtagagatgaagactctttgcccattgagatagtgttctttatttccccattgcattgcactaaaatattccaatgcaatctgtgttttgttttgttttttcttttttaattttttttattttttgagacgsagtcttgttctggttgccccggctggagtgcagtggcatgatctcagcttactgcaacctccgcctcccgggttcaagcaattcttttgcctcagcctcccgagtagctgggattacaggcgcccgccaccatgcccggctaatttttgtatttttagtagagatggggtttcgccgtgttggccaggctggtctcaaacacctgacctcaggtgatcgcctgcctcagcctcccaaagtgctggcattacgggagtgagccaccacgcccagcgcaatctgtgttttaaatgtgcactattaagagggatatttgaggtcttactgtggatactcaatactaacattatactattttaaatacagcatctactcatctttctattactattcaacttgaagcaaatattcttgccattattatttattttcaaatattatacyaaccttgcccttttgctttctttcttttttcccctgaatagccaatcataagtggaaagtcattgagtttatttacacccttcattttgccttgattcttgtaagctgaaaaacaatatcctttctgggtatacaatagaaagactttaaaaacaattggcttgtgaatattgttgtgaatattgttgaaactagcttgtaacaatgtccattctaattggaaatccagataaggggacagatgaggaggttctgaccacctacctccctggcttgggcagacataggagttcttggcatcttcataggtccagtttttctggaggaagaagtaaccaactctgacacctgactgtaattattccatttcctctcaacatccattattttcaggctctgagactcaagagggatgtgaaatactgggagatacttagaagggagtcaccacactaataaaatagttgttagacttatgagaaaggtgagagaactcaggttggagtagaatgagaattagaacactcttcaggttcctgatggtttttatgtgaaagacagtgagcagctggttattaccactgaggcaataaagagatactgtgggctttagcagaaacaccagtatatrtatttagtttttaaaataaggttttaaaaggaatgttttatttaattgcctacacagaatgaataaagtgatatttatagtaggactctgggtttgtttaggagcacatgcttgcacatgtgtggcttaggaaaaaccactgggaccactagtctaaaatattcataagtaaagatgcaaacattctgaataaagtagaaggcagttgcattgatttttttatttgtttatttgtgttttttgttgttgttttgcaaggatgtgttcttggagatttttataatctagaattcacctatttcaagatttctctccagcccccatagtaataamtctgaagtaggagggatgaggtctccaaacacataaatctacagccattttagcttgggggcatgttatagttacaaagatcttatagccatatcaatagaactttttctgctttttttctgttaccctcctttgctcatttgactttttttaaaatttagaaacattcccagtttgctgctgtttttcatttacttggcattgtctctaataaaacctagagtgtactctcttctaaataaagaggtcctacattgtggaggttgttcattcttcttcctagcattttagctcatctaacccaacctattttacagttatgggttgagggtcacctcaaaactaatgtcacacttcatgaagaattggatgacatagaataaaatataaaaaatgtaaacaatgtgagtgtgcttaacaccactgaactgtacacttaaaaatggtgaaagtgatgaatgttgtatgtattttatcataattaaaaataaatttttaaaaagagaaaaaatacttaaataaataaggagtgcgaacataaccatgactagttatcaccatctgatagtgcttcctttgcatgtaaatcatgcttttgttttggggacattcataaagaatagggattaactgaagtggcactgccatgtaacaatagcataattccagtttgttctacttaccaggcttgccctccatgaaaatatacaattgtagataatcttttttaattggagagatttcctcttatgtccaattttatacataaagtaagacttttttattgtgtgcctaaatttgtgtaaatatgactgcatcgtattagtaaactgaattaggtagtgcattcacataaaatttaacatcaccaagaaggctttaccttaagaatgtaatgatgaatcaccattttagatagactgataggtaatttattaactgatttaaaagagaaaagacctatatcatctcagtgagtaccaaaaagcatttaataaaattcaatactcattcctaaagttccaagcaaactagaaagataaggaaaattcccacaaaactacagcaaacatcattcttgatggtgaagcattggctgcatttgcattaatgctcagaacaggaagaaaatacccaacaccacaaccatcagtaatctactagagttcttagtaattcagtaaaacgagaaaaagaaatgtgagatagaaaagaaaaagacaaaactgtcattagagaagcagggactggctcaattgcccaggctgatgtgcagtagtgcaatcatagctcactgcagcctgaactcctaaactcctgygctcaagaggtccttccacctcagccttccgagcagctaggactacaagtgctcaccataacactcagctaattttttttttttttttttttttttttgtagagacagagtcttgctatgttgcccaggctggtctcaaactgctggcctcaagcagtcctcccacgtcagcctcccaaagtgctggaattataggcatgagccaccaggcctgacctaaagctgtagtaatttaaaaagtgttatattggcacaggaatagacatgagacattaaaataacaaaacagagagtccctaaatagaccaatatgtaaatgtcagagatctagcacatgataaaggtgatattttgaatcagtgggagaaggatggactgtatgccaggcactgttccaggcactgggatctagcagtgaacaaatttccacagtcagtatgtagatgtcacttttctccaccctcagctctccctggaatcacctagtccaccaaccttctgattactctctgaagagaataaatccctgatcttcttttcagttattttcaggctttcagtattccacctccccgttattattttttctgttatcttttctctgttttttgagtttttgtggctttatgccactactttaaccacaatctctatttatccttcatgtacagttcccatgttagtccataaaaatacttaagcttttgtatttaacatttttcaccgttttggaaagggtctaaaattcccaggactccacagctttgcaccagataagcctggaggaatactaatgatggatctaaaagaagaaaaaccaagggcacgggaattaagaatcagtcgtgggtttgatttggcctcattcaatccacatggcatcagcactttcatagacaacggtaagagccaatgggctaccaacatttagtaacgtgtgatggttcacaaatgactgtgaaaaatagatttggatcatatttmtaggaagagaagaacaattaactcatgagtgatttctgtattcttcattacaaagaacttgttcatttgcctcttcagctggcagtaagttatgctacattttgaaattcctaacaggtaacacctgamagaatgtttagatttcataatcttttcatatacctacgatcatcacatttaaaaaagaactgtatttttgaattaaagtagaaacagattatgcatgaattctgtatatggagtaggaaacactttcttaaaggtcagggagccaatgatcagaaataacaccagacggacagcaataggaaagacagagaatgatctgttaggtcgtctaacagcttatacattcaacctttccttgcctgtggtatttaaatgtcagtgcctgcccagaggtcccrtagttatgtcttgtaaattaactctgttctttcaattctttagatgacacagtttatctctttgttgtaaaccacccagaattcaagaatacagtggaaatttttaaatttgaagaagsagaaaattctctgttgcatctgaaaacagtcaaacatgagcttcttccaaggtacttcctcattttgttccttctctaatttatccccagcatttgcaaacaatccctatggtgggttgtcctgtcatcttttataagygctaatgtatatattagctaatatgtaagagctaaagagcttatatttccttatttataaatgtgtgtgtatagtttccttataaaccagggcaagcatggcatatgaaagttgatgtcactcatactattcactgttctatgcggactcctttgagaaatgatgaagtgcccgactacagggtgatactcttcaggcccatcttgagggtagaaggcaaaccctaacattttttcctgctgtcaccctccatcttagatgactcatcacccagatgagtgtcttgccaaggaagaatggcctgttttttattgggtttgtatgctttgcatgggactttataccaatcgctttcatagggttagtgatggttgcatgctagtaatcccacagaattagagccactcaagttgagagtgagtcattacacttcaagaacataaagctggttgaaaatgtggctaaragagaatcatgtgtacccccacccccagttcagtgtgtattagcctactgcttcttttagtttaaacttgatgaatatttttaatttctaatgaaatttcatttctaatgaaattaaaaatattgcctatctagggcctatctatgcctatctagggcataagcatgtaacttccaatcattccttccaaaaatgcacttgataaaaaaaaataggagcataaataccatccaagcattatggtgctctttcagaaaaatgagacctaccttccctgtagctctatatttttcatttagcaaagaataaagcagctctttcagaaatttttgcatagagtaattggaatttaaatttaataacaccctcacctaactggtcttaaaatgaaattgtttttagcatataaatctctcacctgaagcattgtactatggcaattttatcatccatctctctgcaagtgtttattgagtgcctgttcattctcggcatgtcagctttgtgaagcaggtagaaattgaacagtcaaccttagtttgactaataactaagccagggaaattagaaaaatccaggaactgagtaaatggaagctaggtaaatgttactgactgcctaaccagctcaccagccaatcaggctctctccagctctgtactgtggacagctctgtccttacgtataattgttaaaccctacatttcttgctgtcaaaaaacatgccctgatggcactaagttctttcttctcttatggtaatcctgccataattgctaaatgacctgtgttcagattacctggtaccatacaaaattgttctctggcaacaatattatagtatattgtatatgactatagtygtgatttttagctcrtcttttcctcttaccaaaaatttaaagcacatgttgcataaatcttaygagtacttaatatttaatatggagaccaacaggccttttrtttcctctcacatgctatttttctttttcagtgtgaatgacatcacagctsttggaccggcacatttctatgccacaaatgaccactacttctctgatcctttcttaaagtatttagaaacatacttgaacttacactgggcaaatgttgtttactacagtccaaatgaagttaaagtggtagcagaaggatttgattcagcaaatgggatcaatatttcacctgatgataagtatggccccttatagaatatcttcatttttcttcagttgtggtgctggccaaattctttactttgctttctttgtcaatgtgaaaatagttttcttgacatttatggtatattatacatataatatatagatacactatatatataattatatatgttttgtatatatatttacatatacttagtcacatgtatttatatgcaaatacaataccatatttaagtaaactatataatacagtaatatatatgtatttatatataatatataaagtttggaatacatcattgtcaaatttaattttataaatataaattttaaagtgtgatcatactgatgcatacatattgaagtatcaggtatttccttttaaataaatgtattatttttattggctatayattattccattataaggatgatcttaaactaatttaaccaattctctattgatggatatgtgtataggggtggggagttctacataaaaaatattttatacttcttatttaccatggaattttaaacaagtattttttttaaagaaaaagtccctaggagagtgttttttttttgttttgttttttggagatggagtctcactccgtcgcccaggctggagtgcaatggcatgatctcagctcacctcaacctccgcctcctgggttcaagtgattctcctgcctcagcctcccaagtagctgggattataggcatgcgccaccatgcttggctaattttgtatttttagtagagatgaggtttctccatgttggtcaggctagtcttgaacctccaacctcaggtgatccgcccacctcagcctcccgaagtgctgggattacaggcatatgccaccacacctggctctaagagagtattataacataatggttaaacttgcagattttggactcatacaggcctgggttcaaatcccacccagggcactggctaaatggttctatgagctacttttctgtagaacagacccctagaaatagaactatttgctcaracagtgtgattcttttaaatgttaactttaatagatattgccaaattgtcctccagaattatctcattatttttatatgcacaaccacaacctataagagaagatattaaattcttgatagctttcttatctactgcctcagcacactgaaaaatttaaactactacaaatacaacataaaataaatttggcactccttgacaactaaatgcccttatttttgtaatccaatttctcctcctttcttgttgactatagaaaaagaatgtagaatcatttaatttaaattgtctctaactgacctgatccaacctctgcagccaaatctgtttttcactcttatatttccattatgagagtcaaactttccaatcacccaagctaacaaaaaaataacaataatgaaaagggagaatcagcttttactcctctttcaccattcctatccagcctgtaggcaggtcctgttggttctmcctgtgcctccttcctctacccccaaactcctttccctttgagtgagacctgcctartttaggttgtcatcctctctgactagcatatgagactttcttccaatttgttttctgtctacttggatttttttcactcttgccaattttgtctgtctatctctattagccttgaagggctccccaaagagggaactctgtcttcctcacctttgactccttatgccagtacagtgccaggcacaaagcaaatgctcaggaattgtggaacagaactgaccatttgttgccactttattattctaagatttcagtggaatccaattgcttatcaaatcaaggcagggtaaagggttggactttgtttaacaggccacctccaacctcccttttctactatttccatgctttctatgctttagacaaagaactcattgttttaaacattccttcctcttcttgctcctgtgattctgctcttgtgcttgcttctgcctgggaagtgcctcctccgtcctcatctcaaatctcatctctctttacacagccactgcagatgccccttccttggtgagcctttctgtgtcctcggaagttagctatttctagacctgaactatttctcatgcttattaggtgtttaatgtgtacaaaccagtgagatttgttccaacacactataaactttcaaggagagaggctgtgtcttcttcatgtttatatctgctrcaacactgagttcatggcttttcacacataattgctcaacagagcaggtgccatggaaagtcaattcaatgagtaaaattacctcaaaatagtcygttaattcactcacctttgawgtagacagattattctgcattgatacttatctcttactcttaaaattcgctatgtattaataaatattttattgaatattaaggaatgatcactattttaataagatgttctttaccatatatttctatatgtacatgataattagaagtatcaaattatattgtggaatgtaaaagcttttcttctgaagccaagcatttgttttattgtcatttcagtggcaaatatggacttcatattcaaaatgatgttctatattatttttccttacaagctttttgaaaaacaatttaataattccatgattgttgtagcaccactgaattgattctgaaagcttactttttaaataaaaattgacctttatcaagcattccttgagggcccatgattgattaacttcttggcaggttattaagacttattctttcacactgtattaatgaagctttatattggcatggagctctaaccactgtgtcctttctgcaaaggtatatctatgttgctgacatattggctcatgaaattcatgttttggaaaaacacactaatatgaatttaactcagttgaaggtaaaatatttatttttacatatagacagtaatctattatgctttgcaatgacatagtttttcyataagagtaccacacgtagaacaaaatatggatgccagtgtagctattctgggtttttaaatactccctacaactagagaaagctcctgtttccagcgatcwcaagaactgaccatgattacatgcagcagcaggttgagagtgatattcatcagatttagggcccattccatgaagtattgatggcagtggaagaattccaataagaattttcacaattgaaaatactaatagatgaattctcaaatgaaggtttatgcacagtgtcagttctttcaataataaatgaaggtagaaattgggttccacaccattattattttcttcctactcaacaacacatattttaggttgattaagaatttcctatcttgctttgattgagttccttgagctaactgatcattgtgcatcttttaaaggaaaaggagttcagtttttaagatagatttttacagagaccgattatcaccctaactttcttaatttcagggaagaagaaaagtggctccaaaccagtttttaatacattccttttaagcaatattggtgttagaaggtggaagcagggcgatgtgtaatttcctcacatgcatagaggcaggaaggttacctctaaattatttaatcaagtttctcatgtcatttagatwttgacaatttctcatttggaaggtacttgagctggatacactggtggataatttatctattgatccttcctcgggggacatctgggtaggctgtcatcctaatggccagaagctcttcgtgtatgacccgaacaatcctccctcgtcagaggtttttatattttcagttttttaaacttaattattcaagtccttttgaactaataatacaataaattgtcacagggatgatttgtttagttattttaaagcaataatataataagcttatgtcgtggttttgtaattgcgttaagccaataattggcagaatgttacattgttcaaatactttaagaaaggtaatcttttgatgtattaaattatggtggaaactagtcaaaaggcatttttataaagacatgtgcccttcttgggtggtatactggcaatttttaaaatatctgatttattgtcagctcaccacatgatgtgatatttgttcatgttgaagtagtgtgaaagtaggcacattagtatgaaagtatttctattaaagctgaattgctataataacactaaatcctgtgttggcatggaataactagatggttttaagaaagtactttctttgaagattggagaaagtactttaatttaaacattaaaaagattggtaactgctattttcaacagcatgtccccttaatcagtgtgtcattgtggaaaacagggcttattgatgattgagtgacatgcatgtacggtggtcttatattcatactttgtatcccctgaataggttctccgcatccagaacattctatstgagaagcctacagtgactacagtttatgccaacaatgggtctgttctccaaggaagttctgtagcctcagtgtatgatgggaagctgctcataggcactttataccacagagccttgtattgtgaactctaaattgtacttttggcatgaaagtgcgataacttaacaattaattttctatgaattgctaattctgagggaatttaaccagcaacattgacccagaaatgtatggcatgtgtagttaattttattccagtaaggaacggcccttttagttcttagagcacttttaacaaaaaaggaaaatgaacaggttctttaaaatgccaagcaagggacagaaaagaaagctgctttcgaataaagtgaatacattttgcacaaagtaagcctcacctttgccttccaactgccagaacatggattccactgaaatagagtgaattatatttccttaaaatgtgagtgacctcacttctggcactgtgactactatggctgtttagaactactgwtaacgtattttgatgttttgtacttacatctttgtttaccattaaaaagttggagttatattaaagactaactaaaatcccagttttgtctgtgtttaattctgaaggcatatggctaggagaaatgggaaagcagctgcttccttatggagtttggataggcaagcatggccatattaatttctcttgtggaaagctgaaagtgaatggactcttaatttgaaacaacaacaacaaaaatcaatgaaatattgcaactcaaattcccagttcctaaggaggtttccatcagctctcttccttaatgggagtccactttagagacaaagaggaaataagggttgggacaggaaggtcttgccacctcctcattgaacagaactgtgaactaaagccaggagaatgaagtcagtcrtccgtgaccacatggttaagcagcagcaatgctaggawcagggccgcgtgcccagctcacagagggagagtttttctgctcactgtacctcctataaaatcatcataagccctagagagagactttcatgtgtttctttccattgtaatttatcaaaccactttacttcacttctcatactttttccctatcatcatcatgaaaatatttgtcagttaattacaatatgccaaacaatgcaatgaaagtattacattcgttatcttatttaatcctaattgcagcctggagtaagtattgatattatatcactgttaacatttcacagatattcagtctatttctgatgccagagcctgtaccgctaaccactacatgatgctactgccatagaacgaactagtattttattactgtttttcctgatgtatacagtttcttcatgttttgtagatatgtttgagttctgcttttagatgaatcatttaatggattttaaatttaaatttcagtagtattcttaaatttggcctgtatccatttggcctgtgttgttatttatatatttaagtagtttgctacatattgtattggatttatttcatgctaaaataattattttcttttttgtttacattgtccatgggaaaatgctaagtcacagatgaatacagcaagattaaatattgcagacctagggatccaaatgaagaactagatgttttagattttatgagattatatcagactatctaaaaagctacatttataaaaagtactggaatacagtaggcataaaacaaacttggtttctattgcatttattacaaattttagaacaaaaccatgtcctttgcagcaacatggatgcagctagaggtcatcctaagcaaattaatgcaggaacagaaaaccaaatattgcatgtcctcacttataagtgggagctaaacattgaatacacatagacaaaaatgggaacaacagacactggggaccactagacagaagggagaatgaggctatgggctgaaaaactaactgttgggtactatgctcatcacttgggtgacaggaccatccatatcccaaacctcagcatcatgcagtatacccaggtaacaactctacacctgtactctttcactaccccctcaaaaaacactggggagtacaatttgctggatcatatggtagaagtatgtttaattttgaaggaaactgccaaattattccaagtggctatactgctttgcatttgcaccaagcagtgaatgagagctcctattactccacatcctggccagcatttggtggtgtcagtattttggattatactattatgaagtggtatctcattttgatttccaattacctgatgacataaaatgttgaacattatgcttgtttgctatctgtatgtcttctctgataaggtgcctgtttataccattggcccattttaaaaatcttccttttgttgttgttttgttttcttattaagttttaagagtgctttgaatatttggaataacaatcttttgttaggtatgtctcttgcaaatattttctcccagtctgttgcttgtcttctcattctcttgacagtgtgttctgcagaggatatttatttttaaaaacaaaatcagggcacctctataagataatatagccacttcaaatgatactacagaatattagcatagacatgtactcacagtgtattttgaataaagcatgcaagtattttaaaaaaatttatttggacaaaagtatatgtaagttaataagcacatgtatggccagccacggtggctcactcctgtaatcccagcactttgggaggttgaggtgggcggatcacctgaggtcgggagtttgagaccagcttgaccaacatggagaaaccccgtctctactaaaaatacaaaaattagccgggcgtggtggtgcatgcctgtaatcccagctactcgggaggctgaggtaggagaatcctttgaacccggaaggcagaggtaggttgcggtgagccaaggtaacaccactgcactccagcatgggcaacaagagcaaaactctgtctcaaacaacaacaacaacaacagcaaaaaaaaaaaaaaaaaaaaaaaaagcacatatattatttatcttagaaataaaaaaaatgaataatctctgatttttggcttctctggaccatgaggaattctatcaaactcagtatattgtgcacttatttatggtgtcttctctctgatcttatactgagctgaacaattgaaaacaactgaaactgtaattgggatatgacaccatgaggtgaatataggtcttacaggtgtgtatgtgttaattctttttactccaagattccgtttagtgacaataattgtttttttacttttacaaaacctcagctcttttataacaaatgtgaacatgaatacttaatacaaggagtaagaaagattaaatataagctataatacagtatttttttcatgttgcatatggattaatccttaattgcaactcatataaagctgattcttttctctggactttgatttgctcagtttgagtcctatcttggagtcacagccaacctaggctagtgaatatctactctactcagcaaagcaatgaaaaagtaacagcttaaaagtaacccaccgccacaccagccacttctacctttctgtggctacttgtagttttcattactcacactgttttccagggaaggatttctgggtgtgagagaaggagctgggtgggagaatcccagtagcattctcttttagctttctgcccctgcttttcagcacttttcttctactgtgttttaattttcattctctttttatgagtttaagtacactttgagatatttaaggagatctgtatttatttttctgtgaactttttttttccttcaaggatgctggcctttttctatgaatttctagttcttcatgtgtaaaggagggaattatttttccagttcataactaaatcatccattatgcaattcttgacagggattgaaaacatcaggaaatgatgttttccattagaagagaaagcagtacagatattttcaaacttttaaaatggaacctggttgtcccatcataggcagtattgagtgcagaagacattactcagacctttcttaagaaagggctaatataaaaaatacatttattacatgaattgattcaaggcctgaaaatgatgattaggataaacatgacttttgtcactccactttgaagaaaactctccagatttctcctacaatataaaatggaaaccacagctttaaatggactctctgaggctgggaacagtggctgacacttgtaatcccagcattttgggaggctgaggcaggaggatcacttcagcccaggagttcatgaccagtccgggctacatagcaagacccccatctctatgttaaaaaaaaaaaaactttaaaaaaaattactacagctttatatataagatatatgktggcacctgctgtagtcccaggtacatgagaggctgaggtgggaggatcacatgagcctgggaagtagaggctgcagtgagccatgatcacaccactgcactcaagcctggccagcagagtgagaccatttctctaaaaattgtttaaaaatgaattccctgtttttctattcatattgcttctgtttcttggtccccatatccataaatacagccctctttagcagattctccaagcctagacacctttcatttctccctctccctcaccacccctttgctcatatccaaacaattgccagtccctccacctaaacatttctcaaatccatacaattctaagaactttgagaaacaatctcctcaccttctccaatcaccctcacatatctcacccagaaaggcatctaactatctcctagcctccaggaagggtaagtgctccacctgctccataatccactctcatcattgtgtagcaatgtttctaaaacacctgccaaaacatgttacttccagtggcttcccaatgccccttagaatataattcaggtttcttaacttggcctacaatctgccttcctctccagattcaattctcaccatcttcttcccaaatctttaagctcagtgattctcaaagcatggtccctgggccagcagcatcagcatcacctgcaaacttgttagagatgcaaattctcaagccccaccccaaatctaacaaatctcaaactctgggtctaggactcagcaatctctcttttaaggagccctccaggtgattcttaggcctgctgaagtttgagaaccactgctgtatccatactggactatttctgttccaattcccctacttgcggataccccgacctctttctgtgaacctcaccaccctttctccacttaattaactccttctccttgtcatacaatctgacaagttcatgtaatatgttgaatctaccttgagatgtgttccaaactagagtcgctgaggggctaccagatattgatgaaaaatcccctgaagacagttaaagtggaagataaatctggaaagaaccttcctggcaaagtgtggcccctcaaggatccccccattcacttggtgcttacatagtgaaatgtgagcctgctggaaccctggtgctcatcctgctaaatacactcagcgcagatgattcctagcacaccacaggttgcacctgaagtcctgagtgggggaaccttccccatggtgagttgcaggaagtcaccaaacaaggtatcagactttcactacctgacttcattattaagtgcatcttcagaatgaaattgagaattttatttaaattcagatatacctaaatatttaatacttaaataagtataaatttaaaataataaattttctaaataatagaagtcatttcttaaaataatacaaatatctggtcctctagcatttctctcttctgagcagcactagactcattaatgccatgtagtcgtacccaggttttaaacagtggtttctatggcttaggacaatgtttcctaatgttctaaaatccatatcctctttttaaaaaacagctttattgcaatataatcataatctcttttgatttgttgctctttttctctatcgccacctctttttcttggcaagattcactgatagaaacaatctttttaaattaaaaatgtagcgattgtaaacatgatcaagatataaagtttgaaaattttaaacattacagagggtcgtacagtaaaagcaaagtctccttccatactcactgacctccccactctccacgaccccaatcttctgctctcaaagtaactactcttcagtttatgtctagattgtttatatatatacacacacacacacacacacacacacacatatgtggataatatgtaattcccctaattttataccttagaattataccacatgtatattctgcatcccccttaatggcattttgattatcaatggtgtgggactccctagatctatatatagtattgtgttacttactgtttaaacgtatagcattgaatttggtctacattagctctttgaaagccccactatacatataaggaaagaagggtccagaggtggtgataagtgatttcaaaagattaaagggccaactacaaatggaattggatcttgaatttaggccttttgaatttatctgtcctgctctttcaaagtcaacaaaccccttttacaatactgatgtacctgtggcctcttgaccaagtcaatttggcctattgccaagagcag

SEQ ID NO: 17568 - DNA, 22242 bp, Homo sapiens
gctaggttcacagatggggaaaaatgatattatattacatacaaactttcagcataataatgacaacaatgacatcaatactagccagcatttactgagcttttactgtgcttcaaaaacactgctaagtcttttatacacttaatcttctcatttaatcctcaccacaaccctaaggaaaagtactatttccatttttcggataaggaagttgaatttcataaaggttaaatattcagtcactgtaacacagaaggaatctaaccggggctgaataactctcctttaacataattacaagttaagtcagtctgctcagatcaccaaagcagaaaatcacactacagcaagaagaaatcaaaggtatgaaaaggaaagctatcagaatcaaagcatctggaacaatgacctaaatataatagctaaaaccataaaactcttaggagaaaatgtagaaataaatcttcgtgaccttggatttggcagttgattcttagatgtgacaccaaacgcatgagcaaccaaggaaaaaaatagataaattggacttcatcaaaattagaaacctttgtgcctcaaaagacattatcaagaaagtgaaagacaacccacagaaatttgcaaaatgtttgcaaatcacatatctgataaaggtttgatatccagaatatataaggaactcctacaactcaaaaaaaagacaaataacccaattaaaactataagcaaatgacttgaatagacctttctccaaggatatacaatgcacaacaaccatgtgaaaagatgtgcagcattatccattagtcactagggaaatacaaatgaaaacaaccatgagataccacttcgtgcctacttagatggccatgatcattttaaaaattaaaaataagataaaaaataacaaatgttattttgaatacagaggatacagagaaattgaaatcctagtacattgctggtgggaatgcaaaagggtatagccactatagaaaccagtttagtggctcctcaaaaagttaaacctagaattaccatatgacccagcaattctactcccaggtgtatacgcaaagtaactgaaaacaaaaattcaaacaggtatttgtacaccaatgatcattgcacaattgtgcagagcagccaaaagctgaaaactacctaagtgcccatggatagatgaatgaataaacaaaatatgctatatccatacaatggaatattatgtagccattaaaaaagagtgaaattctgataaatgctactacaacatgagtaaatcttgaaaacattgtgctaagtgaaataatccatacacaaaaggacaactattgtatgttgacatttataggatgtacctggaatagtcagattgatagagacagagcagagtagagattactagtctggagggagaggggagaagagagctattcgttaatggatacagagtttctctttgggatggcaaaatagctctcgaaatggatattggtgataattatataacgttgtaaatgtacttaatgaaactcaattgtacacttaaaatggttaaagtggtaaattttatatgatgtatattttaccagttaagaaaacatagtttccttccttaaaaataagtcactcataacctatggaccagatcactctcattagctccagacccaatttccagctgaaaccttgaacccgatgtccaggatgtccatgatgtctttactttcccacgaccacatctgtttccctcacaaaatcaactcctagtttcttttcctataagccatgtttccatattaacagcttgaccacccaccaagtctattaggctcagatcatccttgattttcttctcattcctgcagccaatcatctccccagttttggttttgttttgttttgtttttatcaatcctaccttctacatacgtcttggatttccttcctctttttcatcactatggtcacaatcttagtttagggactcatcttccccctgtctcacctggattattgtcataactttttgcttggtctatctgcctctccagtatccctctagagggcatcatctcatcttccacaatctgtctttacaaccaccagtagcattttcttacagcatttcaaatctcatcatgctgctttcttcctttaaaacattccctgatgcccttgggataaagtccaaactccctggcacacgaggctcgctctcaacaacttgacccccacctgcttttccaaccactcaccatcccggaccacagccacattgactgctcgctctactgtatccatgctcttttcccatgtcttcttcctggaatgcccttttccaagggaactcctatttaccctccaaaatccagccaaaatgccacctcttgtatggattactcctcagttcccacaagaaggattaactgttcccttctctttggtagctttgcatattataagcgagtgtcattttgttttaaaagtatttacctcccgatattgccaccctagagcacgagcttctaaaggctggaactgggacttgattccactgggtcttttttcctaattacaatttagatgaacaagagatttctttctccttattcaagagtgaatattgaaggaagtcactaaaattaatttaaagtgtttgtaatttctaatgctctttgaattgctaaaagtaaacagaaatgtaaaatacaaaatctagaaaataccttttttaagactttatttttttaaagcagttttaagttcacagcaaaattgaaaggaaagtacggagatgtcccatatacctcctgcccccacacatgcatagcctcccccattatcaacatccctcaccagagaggtacatttgtttctgtgtgtgtgtgtattttttttgttttgttttgtttttttgagacagagtctcactgtattgcccaggctagagtgcagtggcgtgatctcggctcactccaatctccacctcctgggttcaggtgattctcctgcctcagcctcctgagcagctgggattacacgcacctgccacaacacctggatgatttttgtacttttagtagagacagggtttcaccatgttggccagactggcctcaaactcctgacctcaggtgatccgcctgccccggcctcccaaagtgcagggattacaggcgtgagccaccgtgcccagcctatatttgttacaattgatgaacctacactgacacatcataatcacccaaagtccattgcatttgtgttcactcttgatgttgtacattctatgtgtttggacaaatgcaaaatgacatgaatccaccattacagtattgtacagagtagatgcactgccccagaaattctctgtgctttgcctattcatcctgcctatcccacgtccagcccacacaactactgatatttttacctatttttgccttttccagaatgttacatagttcgaatcatacactaagtagccccgcagattgcttctttcacttaataacatgcatttaagattcttccatgtttattcatggtttcacagctcatttctttttagcactgaataatatttcattgcctggatgtcccgcagtacatgtattcattcacctactgaacgacatcttggttgtttccaagtttgggcaattatggataaagctactataaacatctatatgtatgtttttgtgtaaacatttatttttatctcctttaggtaaacaccaaggagcaccattgctgaatcatattgtaaaagtatgtttcattttgaaagaaaccatcaaactgtcttccaaggtggctgtaccatttttcatttccactaaaacatcctgcaattgccactgtcagcgttctggattttggcctttctaattggtaagtagtggtatctcattactgttttgatttgcatttccccaatgacatatgatgtgaagaatattttcatatgcttattcactatctgtatatcttttttggtaagatgactgttaaggtttttggcccatctttaaaatcagattgtttgtgtttttattgttgagttttaaaagatacttgtatattttggataacagtcctttattggatatgtctttttttttttttttttttttttgagagagagagagagtctccctctgtcacccaggctggagtgcagtggagtgatctcagctcactgcaacctctgcctctgaggttcaagcagttctcgtgcctcagcctcctgagtagctaggactacaggcacgcatcaccatgtttggctaattgttgtatttttattagaaacagggttttgccatgtttcccaggcttgtctcaaactcctgacctcaggcaatccactggcctcagctttccaaagtcctaggattacaggcgtgagccaccgcgcctggccatggatgtgtctttgcattcattttcacccaatttgtggcttgtgtgctcattcacttgaggaaatgccttttgattttaattcaatgcaaatattaccaaaaacgtgatataattccatttttagcttattcaagtaaagttcataaatattcattattctacaaatatttatggtgcaccttatcacatgtcaaactctgactaaggataccaattactctagttaaactgtgaccgtacagaatcaagacatctctgtaaagagagcaaatttaattaactgatctgaaaattttacctttgctggctcacagtgctcaattaccatgtaattgaagtgatatgtgattaattaaattttttagctccagcatatttggagtgtttcccatgatgtattagagtcaaaagccatggtgttctcccaagtaatgtataatataataaaagagacagacctattacaaaatgaataggcagtgcagtgggatagaaaaagcactgagctactatctgtgtgagctgggagaagtataataagttaaattatcatcttggcctcactttcatttttggtaagaatggagtcattgggctagaatctgtaggtaatggattcttactgctatacgtagaataaccattttgtgtactaaggaccaatgcagccctacctgtagctgggcagcagccagagtcagagtgattggaagaaaaaaattggatctccaagttgaaggtctagccttggaagaatctgttactataaaatgagaagcagaataagtaagccagatgaagagttaaacccgtgcttgtagatttttgttggcttggtatttttttgtgtttaattcaagaagaattagaggcagtgttccccattaagaaaagacataaactgattaaaaggagacccaaagaagggaattatcactgctctgctaagggacgtggaaggtgaggggacacagcacagttgtatatagagtggccactaatccagccacacagcagcatttccatctgcctcctgccatctttcccctgtatggagaaccacaggattttggtgatgttctatttcttgactttggtgacggttacagtatttgcttaattattatttcattatttacatgttttgtgcacttttccaaaccttttaattgttaagaatatatggtaccatgtatttaagaatacatggtaccatataataagaatatatatttaagaatatatattattctttaagaatatatggtaccataatgtcctgaatgatacctatgagagcagtcatttgactttggcaaaaaaatgaggtttctcatggagtcaatttatgcagcagacagaaaaaaaaatcctttgaaagacaaatacattgtgtgcttcctgccaataacgatgtaatacttcctcgttttagttaatgaaaaataacacatactttcaaagttctgtagactctaaaaagaaagaaaacactcaaatgagtcacctatttccacattcgaggctgagaagctatataaatttctgcagtcactagcagaaaacaccaaatcaaccataggtccaagaacaattgtctctggacggcagctatgcgactcaccgtgctgtgkgctgtgtgcctgctgcctggcagcctggccctgccgctgcctcaggaggcgggaggcatgagtgagctacagtgggaacaggctcaggtatgtcacagcccacttacttagggttccattcttttgccatctgcattaagaaatgtgtttttcaattatttcccttcccatgttagcattgcagtggaattttctttggggtggttcttcggattataaaagcaatatatgttttcatcaagtagccattaaaagcaggtttcagaatctgctcaaatcgggcttgagttccaaccctccactcactatgtagatagactcaggaagktcatcaaacttctctaagcttcaggtttccaatttggaagttggagataagaatggtatcaaccaaatgagggtgttgtgaagcattcaacacaatacctgaaacattgtttaaattaagttcttatttttatttattataacttgagattctttttctatagtatacagaatattgcctcttaagatacaacctgtaaatatactgtttgtgtatttacaatactgtttgtaatggagatatctgaagtcagaaaacatgggtagaaattacaactctccaacaagtcaatgacaatagacaaggcattaacatctgactttgttttctcatgtgtccagtagaaaaaataatattatgtgttttatacctcatggggtattctagtaagtaaatgaggtgataacaaaaccaactagcatgtatgtaacaattgtagattataaagtacttatatagacattgtgtcatttaatccttagttctataaaaagaggaaaccaaagttaaactgattagtgtacttattagtggtagagatagaaatcaaggacaagtgcttctggttcaaaaatcatgttccttgcaatatgcttcttaataagcagtctaataaatataagcagtctactaattattatttggttaactaatgggatgattacttataactattatttgtaaatttaggccttaagcataagaaaagtcaatttttaattcacattaacttagacttttaaaaagttccagttataataagttagattgaaccacataaagttactagtatttaacttttaaaatctccaaaacagtagttttatatggttccacctaatgaattctccagaaagagtactctgcgtttagtttctttacttagagtgaaggttggcagaaacttagtcttcacttggagggatgttagctaggtttaacaaaaaaacaggaaaagtcatctcaacaaagcagagagatttcttccagagggtgtcttggtaaagtctgtagctctagaagggattaaatgggttatttgtttttaaataaaggatcagttatcaattgtcatggatgaacaataagtatttgttgtatttaatgagacaattgttggtaacaggaaaaaaagacacaatattaataagatttcttacataaattgcatattcctgggcggtcctaagacaggtaaccattaccatctactccaaataaactgcaaattagtgagccaatgtttaaatcattttaacaacaatattatcaggcatcatataaccctacacatgtttctaatgtatagaagtcagaacacttgagttcaaatactggttccttcagttactcacaaggtgatcttgtgcaatttatttcacttctctgagctgtgtttcttcatgtataaaatagggataacaatgccatacttgtttcatagagtggttatgaggtttacataaaataaatatgtaagtgcctggctctaataagtgcttaaaaatgttcctgtgaggttgctattgttgttagttcattcacttttgttgttgttgtatttgtgctgctggattcctatcctcatattcagatactgagaaactttagagaaattcccaggaatccaaccttgcatggaataaacctgggagtcctactgtatactgcaatctcccaaagtgggtttgactagagatttaacagcagaaagaagggctgggaatggaatgagcagaaagagggaaaagaggacctaggagtcaggaaagtcaagtccagttctgctactaatttaaggtgtgaacctgggcacataaatcatttagttgctataagctttggttccttcaccggattattaaattgaactatttaataatttcctaatatcttttcccagagctaaaattttaagaccctttaacttttagctggaaccgcatctcagctggactttagatagggctggttgacctcagatctcccccacagggtctatgataacacagagaatgtcccagtcgtacccctgaggacagactggtacatgcttcctgattgctcttacacacttctaggctttataaagtgtayagtgtaattctccccaaaacatttaaatggattttttaaaaattgagggattcttttcttttgctcacgaaatggcacgccagtgcttcattagcaatattaaattttctcctcactaatgcacacttatttttctctgtgactatgtaattattctgtcttcaaatcattatttgaattcacaggaaccaaaggcaagagatatataggcttctaagataaaagaatataataaacaagaactatagattaattactctcttttcaataggactatctcaagagattttatctctatgactcagaaacaaaaaatgccaacagtttagaagccaaactcaaggagatgcaaaaattctttggcctacctataactggaatgttaaactcccrcgtcatagaaataatgcagaagcccagatgtggagtgccagatgttgcagaatactcactatttccaaatagcccaaaatggacttccaaagtggtcacctacaggttagttttgctctggctcattttggcaaaaacaataaagcctgtttcctaggggtcaaacattgttttcttgtttgctactaggatcgtatcatatactcgagacttaccgcatattacagtggatcgattagtgtcaaaggctttaaacatgtggggcaaagagatccccctgcatttcaggaaagttgtatggggaactgctgacatcatgattggctttgcgcgaggaggtaagaaagattcctgtaggctaatcctgtgtcctgttttgtttgttcatggtttatatcagtgctcttttcttatgaagattaaaatcctttaatgagatatgattggtagatagatagttaatagatagatttagcaatattattataatttttataatctggtaatatagagccactttttatagcagcagttggcaaactatgatgcatgagccaaatccagcccaccttctgtttttgtaaataaagttttactggaacacagtcaggctccttcatttccctattacctatgactgtttgggctcaggctgcaactgtgacagagatcacaaagcttaaacacttgttatctgaccctttacagaaaaagtttgccaacccctgttttgtaacgtgaattattatttatatatacagtcatgcactgcttaacaatgggaatacactctgagaatgagaactttggcaatcttgtcactgtgctaacatcatagaatacacttacacaaacccaggtgatacagcccactatccacctaggctacatagtatagcctattgctcctaggctgtaaatctatacagcatgttactatactgaatacggtaggcaactgtaacacagtggcaagtatttgtgtgtctaaacgtatttaaacattgaaaaggtaatgtattgagctatgacattatcacaactactatatcactaggctataggaatttttcagctccattataatcttataggaccattgtatatgtgatctgtttactgaaagatcattatgtagcacatgactatatgtttacaatatatctacctaacatcgatattaaatcaacagaaagagtcgcagcttccaaaggcctcaagagtcccctgagaagtggtatatgacctgttgctaatgcctttcatgtggcaaggaagtaggaaatggaaactttcatattaaagaacwtaaaaatatataacacagcagggtgtggtggctcacgcctgtaatcccagcacttcgggaggccaaggcaggtggatcatctgcggtcaggagttcaagaccagcctggccaatagggtgaaaccccatctctactaaaacaaaaattagctgagcatggtgacgcatgcctgtaattccagctgcttgggaggctgaagcatgagaatcgcttgaacctgggaggcagaggttgcaatgagccaaggtcacaccactgtattccagcctgggcaacagagcaagactatgtctcaaaagaaaaaaaaaatatatatatatatatattttttttttttacgtgggtttttctatatgtaaaacccatttttttagtatatgtgttatatatgtgtgtgtgtgtatatatgtatatataaaacccatatacataaattgttcttaattgctagtgtttcatggtgcaaatttagagaaaaatgttgcccatttcagtctgttctatgtggaatggtccggctactgtagctgaaatttgaacttcaacccacaatattgacaacaccgaagaaaatgttatgggaaagcactaatcatggcactacaagttttttaagagctagataaactggactggcctcatatcacctcgaagataaccagctctgcatcacacattaaaggactataaaaagccattttaagagatcttgagcatggctctctaagagactatttactatgcccacgaagaataagctaggtttttaagaaaaaaaaaaaaaaaaacctatgaaatggtgcacaaattacttgccaaatgtggtattcatattcattctccctcccaccaccctttggccgagcaaagtggtcaaatttamcaaaagcttaaatgcaaccttaagttagatataactgcattttaagtcctgtatccagtaagctttcaatatatggtgattatcaktgatgagcaatggttctgtgaaaggaaaagtgtctgggccaagaaagcacccaaactaccctgtgartgcaaccgacagcacataacaatgtcagctacttgcactgggctgccttttttttttttttaatttattttttgagatggagtttcactgttgtcacccaggctggagtgcagtggcgcgatctcagctcactgcaacttccgcctcctgagttcaagcaattctccagcctcagcctcccaagtagctgggattactacttggtggcatgtgccaccatgtccaaatttttgtatttttagtagagacggggtttcaccatgttagccagacaggtctcaaactcctgacctcaggtgatccgcccacctcggcctcgcaaagtgagccaccatgcctggcctggactgggctgctttttctagcctcaataatcgtataaactgaaaaataaaatgactggagaaaaaaaaaatcagtcactaagaacaatcactccattttctttcagctcatggggactcctacccatttgatgggccaggaaacacgctggctcatgcctttgcgcctgggacaggtctcggaggagatgctcacttcgatgaggatgaacgctggacggatggtagcagtctaggtatagcatctcatgtctcttctactccacatccgttttaaaatcctggacttacactaagttaaataattatattaatttataataagtattgagcccttgctaagtgccaaacactgtactatatgcctgaaatgcattatttcatgtaatatactcataatgctacacacagaagatggacactcaggctatggagtcaagcaccactgatccaatttgctgtacgtctaccaattactctgtgtcattgggcaagttattgaatttctctgagcctcagtttcctcctctgtggaatggaaatataaatagttcccacatcaaggagtctttaaattaaatgagataatgcttatacagtgcttggaatgtattaataattaattaaattatagctctttcttcatatttccaaaaaatacatgccccaaatggaaaagaaagagaagtagaaactatgatatttgagaagtatatgcaattctggaattattcactattttccagaaagaaccaactccatgatttagtatatcatatttatcattttacatagtaggatattataggcacatgagagaactaatggagaagagctctggcataaataatcccaattagagacaatttttttaaggctaccaactggccctaaaagggaaatttgtacttgtgtttggcaaaaggaattcaccatagcttgctgtcttgctgtgaaaatctatgttaaattgtgatgctgcctcccatttgcatctggcatattcttttcattcttctttcttcccacttaaggtaggttaaaggcagcttccttcaattcaatgcaacgccaccagagctcaggccactcctcaaacgcacgggctcacaccttccacatacttgcaaagcctttcaatgagtatgagggagaacaaaggatatatgtaatacaagttaatgaatcaaaatcaaaaacaaagcccagcattgcctagagaccctgcctttcaatcttcgctttctcaaagccaccattctctcttctgatatccaaagtcactaacatttattgaatggccgtgacttcccaaatattgagaaactctagctatcatgacaaatctagagggcagaaattactgtctctgtttaacagatgagaaactgagactcagcaacatcaattaatctgtccagagttgtccagctagtaagtagtggagctacatttcaaacctaggtcttagtgcttttaaaacctttgctttccactgcagagtattgctgcctgaatgaaagaagcaaataaaaaaaattacacatttttaataagcagaagtagtgatgagattaaagcactcctattctgattaaccttctaacccctytccacttttgaaagcctagaaacaaataagtaagctaccgtgggctaaaacttgggtatttttctttagtttttttaaattatgatatcwtatatataatattacataatgtatgtagctatttttatcattactgtttgtcacttcttcggttgtagggattaacttcctgtatgctgcaactcatgaacttggccattctttgggtatgggacattcctctgatcctaatgcagtgatgtatccaacctatggaaatggagatcyccaaaattttaaactttcccaggatgatattaaaggcattcagaaactatatggtaatatttattatttcaaataagaggatttcycattttctttttagagtggggtaggaaaagaaaggctgggaaatgggtatttacctggaaaaccacactggaactcatatcaaaaagcctattgaggggaggaattggggaccttagatacttaaaatataactaggctgtaatatactatgaagatgttgattgtgagtttcagtaacatagtatcatgtggtaaaattatgcaaatgatattgtccagattttcttcaagctgccacccactgctcttcctctctcagtttaaatagtttaggagagtgtcccctgtaggggtggactgaagggacaaaacacctttcttcatagctgcccactcctaaggattcaatcctagataattataagtgaccctgctcttcctgtttgcacgtacatgtagagaaagcggttaaccacggacagaaactgcttatcattcctggtcttgatacttatgtatatcccttgccccagtctatgcttttttggtttaatcaagttccaaattcagtttttttaagtgcactgatttggatttactgtattgagtcagccaaaagtagtatttgagaaagaaatcaaaggacaagaataaaaagctctgtctctggataaagataaggaaagtaagattcaaagaggctaagtggactgtccaaggtcatgtgactgtcgagtgcttgagccatgattccaagtgagggctatgtgacttcatactttttctacgacatattcctgcctatcactacccagtaagctttttatcctagtaagaataaaagaatacagaatgacatctttaaatcagcagatataactaaacctagccagtaaaaatatcaggatgaagagaatacactgcaaaaagatcacttaagattcttcaaatgatcacgtgagcaatgaaagtgcttccacataatagaggactgtcctcaggggagaaatattccagtaagacactggatttaagatatcagttcaacctagcatttgctataaatcagcatgtcccaaactgtattctcagaacactagtcctacagggtgattcccagaaaaggaggctatggagaaataagttcaagaaacactacctactgtatttcaggtgtatagactattagagagtatggagtattgaacaaatgtttaactcagtgtttcctaaattataatcctttttatgggtctcaatgagtcccataaactagcacttcagagaacacactttggaaaatgctgtgtaactattcccaaaagttacgacgtaaagaamcactgctgtccaaaagattcacaaaatgctgactattgttcgtaaagttatcatgaacaaaactgaaaatactatcctccccttacataaaactgtggaactcatggaatattctatagcagtctataaatattttagaaccctaagaaaaatacaaagagactaaagaaggtctgaggcatgctgattaaatttaacaggaagaaaagagactagtgcattaaaaccttaagtattagacaaaagggcatctctggtcagagttggaaacaagtmacttctggacaaatggaaatagaatttaattatgtgggctgtatatgtagggagttaatctaaaaagtaatatgagcagaaaacatagattccaaagaaagtgattaagatacaagattcctaatgctatactcagaatgataaaaataatagctggctgggcgcggtggctcacgcctttacccagcacttcgggaggccaaggtggttggggatcgcttgaggccaggagctcgagacctggacaacatggtaaaaccccatgtctactaaaaatacaaaaattagccgggcgtgaaggtgcatgtctgtagtcccagcaactcaggaggctgaagcatgagaattgccggaacccaggaggcagaggttgcagtgagtcaagatcacaccgctgcaatccagcctgggcaacagagtgagactccatctcaaaaaataaataaataatagctaacatgcattgagtacttgcagtatcccaagacttcacatggattaactcatttaattcaagaattcaatgagacattattatccacattttacagatttgtaatctgatgctaagagaggttaagtagtaaactacctaaggtcacacatctagtaaactggtagaaacaagatgcaaaggtacmtgagccctgggcccacactccagtcaatcctgccttcttagcctctggaggttgttcttcagaatctttgtcccagggacaagaaatggtctgagtgaataatagattatactttctgtgacatttcctttgcctgtataatcttaggatggtttttatgcattttctacatatcagaatgttctttttttttctctcaataggaaagagaagtaattcaagaaagaaatagaaacttcaggcagaacatccattcattcattcattggattgtatatcattgttgcacaatcagaattgataagcactgttcytccactccatttagcaattatgtcacccttttttattgcagttggtttttgaatgtctttcactccttttaaggataaactcctttatggtgtgactgtgtcttattcatctatacttgcagtgggtagatgtcaataaatgttacatacacaaataaataaaatgtttattccatggtaaatttatttatagtttggagcactctttctgtgaagacatactatacaatgaaacgaaagactaagacaaaaaaagaatcccaccacactattttgaggtcttccgcagcacctcacccttccacccaagagggaaggtgggagctccacctctttattgttcattagtgtggcccaaagttacactaatttccccttacctttgtggcccgtgctctcacactgagtcctctggaaagtccaattcttcccacaaatgtctgagaatttccaacaacttaagacttaccacctcacggtcacttccagctccaagttcctacctgcccctcacctcctgattttcctgcaacctctcctgctgcagccactctctaggttcccttcccttttccccatgccaacgcagatgttggtctcaccctgttctctttaactttctacagaccagtgctacaggctttaatgagaatgtagatgttgctggagatttgcataaatagtggaattttctactgtgcaagggtcatgaaattgaacaaaactaaaattggatattatggatattatccccatccttcaaatcctttttttttttttttggaggcagtgtcattgttacccaggctggtgtacagtggcacgcgatctcggctcactgcaaccaccgcctcgtgggttcaagcgattctcctgcctcagcctcccaagtagctgggattataggcacatgccaccatccctggctaatttttgtatttttagtagagatggggtttcaccctattggccaggctggtcttgaactcctgacctcaagtgatccaccagcctcagcctcccaaagtgctaggattgcaggtgtgagccaccgcacccagcccaaatcctttacttatccccgatcaggaatttctcattggccacctgcttctgcaggctgcagcctcttgccacctgtctcccaactcctcttgtctttaaaccccactccttctcacttccccagaaactcattttcctgatgtccttcagctcaggtcctccctttccacacgtagaaacccactgtgtttctctgggtgaagcactctctatgcaaggtttaaccttttagcagaacacggagctggcaagggctttgctgtttcagccttctctttcttcctccttctccacactcccaacacccatgaatggctttctctatagggagatgaacaattgaaatttactttcttactgataaaaattatccttcccacacataccctaaaagcagatcaatatcccgaaattcggaactatcctgcagccttaggaagccattccaagaatagatcaaatgagaggagaatccacaatccaggcaaaaaattaagtatatgtgaacaagcgttcaaagacccttttaaaacataaggaaatatataaatatgatgctagaatgaaaaggaagttatgtcattaaattcaagttcttcattttgtagaagacaaaacagagattaaatgatttccctaaggttcacagtaagcaaaagtggtgatttaagcattttgttgtttgtttagctctttgtattttgattttagacagcaggaggcagtatctaccttgcagctaaagtggatatctattgttcttacctgcccagcatcccatcaccctacttctggggacaagaaactgcctcttccctttgtgtacaatcttcatgagatgtcacataggttgcctcaagctgcctgggctgagagaagagtacaggacccaagcttggcctatcagacactctcccaaaaacactggaggggttataggtggattcatcctggccatggggctctggagacactgcctagtgaatcctgcacccagacagattccctgaagctgccctgggccctgtccttctcatagcttaggtgtagggcttctcttccagatttacaactgaccgcactgccttccagtacattttgtctattgcttaagttatccatagttagttcatttctgtggtttgcaaattctggcacagtagcttagttggctttcctagggtatctgcacacacgggctccgttctgtatttcaccacatattatccttcaatcttgacaatgaagtaagctctaacagagcatagaagtaaataaaatgttctttttctgatcaaatagcataaaactaactggtaaacaaaaatttttcctagcaaataaggacccatttttttaattgtggtaaaatacatgtaacataaaatttgccatctcaaccattaagtgtacagttcagtattgttaagtatattcacattgttgcacaagagaaaaagtccttaacctcagcactatttgcatttttgactatataattctttgttgtgtcctatgtattaagaatactaggccagacatagtggctcatgcctatgatcccagcattgtgggaggctaaggtgagcagattgtgtgagcccagatattaaagaccagcctgggcaacatagcaaaaccctatctctacaaaaaatttgacaattagccaggcgtggttgtacgtacctgggctcccagctacttggaaggctgaggtgggagggttgcttgagcccaggaggtcagggctgcagtgaggcatgactgtaccactgcactccagcctgggcaacagagcacgaccctgtctcaaaagaaaaaaaaagaatgcttacagttaaccctggcctctatgcactgatgccaatagaatatcctcagttctctcaaccaaaaaagtcttcaaacagtaccaaatatcctctaagaggaaaaatagcccccagttgagaaccactgagctaaagagaataaactatttcattgtattatacttagtatcccttctaccattttcacccaggaccctatcatactctaattctgtaccatcccatgagaaaggaaaaccagtaaaagattaaggtgacattgcctgtttttgacacttatttgaggaaaagattgtcatattttaagaaataaaaaacacctgaattccagctgggcacgtggctaacgcctgtaatcacaacactttgggaggctaagacaggtggatcatttgaggtcaggagttcaagaccagcctggccaacatggcaaaaccccctttctactaaagatacaaaaattagccaggtgtgatggcaggcacctgtaatctcagctacttgggagactaaggcatgaggatcacttgagcccaggaggcagaggttacaatgaactgagatcacgccactgcactccagcctaggtgatagagcgacaccctgtcttaaaagaaaaaaatctgtattccaaagccagggtactatgtatttatagaagtccataagacttgggtgtattttgtaaattacttgttatttttctggttttaaagtcaataaactccagtttaagaaagaggtcttagcacatgaatttgtcttccctcccttcaaagatttcttttaagcagtagtgaaggaataaaacagagcaggaggaggtctgcaatggacaagggatttcaattaatttctgtaagatctaatacagctaatagacaaaacataccagcctcagcctaggatgtacaaagaggcctacagtgaaaatgggagttaaaattgtccaactcctcagaggctttgaaatctcagttagaaggtttaatgaaggcagggtgaaaaatggtattaggcgattaactgtgtatgagtacatgtgtataagacaattaacttcatttcatccctttaacaaaaatggcagagagccagatgttcacttccaggcaaaatatcaaagggttctttgctaaacaagttttttaaaaaaattgagagagaacaggacatttaaattgggttctgtgcctctgaacaaaataaccatattttggctttgaggctgggaatagggaaggctccatccatctgctcatcctaacttaaatgtacgagtgaacaagaacatccatggacaccaggctcctagtcagctttcttgttgcattgttctgtggtggacaggtctaggcaaatctacccacaaaggctgaggaagctgtggggctgaagaaagaggctgacaaatccagtttctcagaaagaaacatttaatagtgacttacaaacagaagccttatcttgggcagccataagacgagagggtggattcctgcaccattacccgcagaaccagtactcacatgccatagggaaagggtatacatgcttcagaagggacaggtaggacaaccatagcacagtaacgtcaaggttgttttgaccagaaatttatggtaagtaccttctcttacacaaggaacaataaataagccggaaatcttggaagccttcacagaactggggttaatgacmagataacatggtggattaacatccaagatggaattgctttagtctccacaccccttatttaaatgagattgggaacaaaataacaactcattgaaaaaggtggtgataccaaaaaaattcaccccagaaaaaacagaaataatttacagaatagaagaggtatgagaaaaaaaaaataggacattctcacagaaatttgggacgacattacacacataaaaaacagtaaccagccaggggcggtggctcacgtctgcaatctcagctctttgggaggccaaggtgggcagatcgcttgaggtcaggagttcgagaccagcatggccaacatgatgaaacccgtctctcctaaaaatataaaagttagccaggcgtggtggcaggtgcctgtaatcccagctacttgggaaactgagggaggagaatcgcttggacccaggaggaagaggttgcagtgagccgagatcgtgtcactgcactccagcttgggagacagagtgagactccatctcaaaaacaaaacaaaacaaaacaaaacaaaagtaatactaagattatattaaaaattatcagagaataagctgaaacttttgaaaattgaatttatgattgtcaagagagaagtataatgtaaaagagttggaagataaagaaagccactcagaatgaagagctgaaagacaaaaaaatggaaaataggacagaaaaaggaagaagaaaagatcaattcaggaggtccaatacccaactctgtcagctttgaaatatgtcaacttaactaagctaaactttatttcccagaattcctttctctatgtttcttgttagggctggccacaagaaaaatctacatggaatttggaccatggaagtaaagtaatacttgctctaccaaggttgatatgagtctggtgctgttgcagctcatgcacaatttcgtggttctgctcattcacattgtgagcacaaaacactgcaggcccagggctccagctcccacattatctcttccttcaacttctccaactcctgagttaggcctgagtgtggatccacacaataatactagtatcttctatggggcacacacagaagcaaggttagagacctagcaacagggagaagccatcacaagcacctgtgatagaaggagaaaagttccagcttgttactcatttcacaggtcccaggtgtcctgctctccccactttacttctatcttttaactgctaacacctgtcctgtaacttcaagttcagcaccagatgcagaagaaacagccaaatcaagatcgttttaccagctcccacaacggtatgagtataaatccctataagtcccttattttacatcattcttagtggttctgctcctctcattgaaccttgtctgctacaacagccaataagatttccaaaaatgaagaatagacaaaataaagaatagacaaaataaagaaaagaaaattatcaaagaaataattggacattttccagtcttgagaagggtgaatggtttggagaaaaacgaatcttcaaacgaaagagccaacatcacgttaaaattttagaacaccaagaataa

SEQ ID NO: 17569 - DNA, 14528 bp, Homo sapiens
gcgggatgtggattgttccatggaggggtgggagacgccgccgggtggtcgagggagcgagcacatggtggcctgaggcgttcccctcccccagtctgcttcgcttctaagtgttgtgcaatctccccctttgctagctcggcttgggctcattgtgcgcgaggccgccaccgcccgcggcctcccacatccgggcaacgcgaggggggggcttcggctggagggagtgggggagggcgcgggcgggatgacgtggggggaaggggatgtcctaccctccgatctgggaggtgaagggcgggacttccagcgcgctggtgctgcggtgggaggtgcacgcgcttgggctttaagcggctgggtcgggcccacgtggacccggcggcaagcaccacctctgggcaccgtgagcgcggcggcacgcctgccggcctgtcttcagaaagggtcacccccttatgtcgggggtggcctggcctgagccgctgcctgcatggggcaaatgcctcagttttatagaaactcctcctttgggtattttttgggagctggtgggagttggatctgggacagcaggttgatggcatcatgcaggccactcctgacagagcccggctgtcaggatttctgagtgcttcggtcgggcaggggacaaaacttatgctttaaaccaacagatccagagacaatggccccgatgggatggagcccgaaggcgtcatcgaggtgagactggagaaatggaattctgtcctcccccattacaactttcagccgtatagagttagagtggcctcttgattgatttcccagatcatctagaagcagctggtttccctaaagggaggagggttgtaagctctgaggcttttgttagtaggcaccagattctgtttgctcggagactacagctcagctccaccttttccatgactcaagctttaatttctttgcatcccctagagtaactggaatgagattgttgacagctttgatgacatgaacctctcggagtcccttctccgtggcatctacgcctatggttttgagaagccctctgccatccagcagcgagccattctaccttgtatcaagggtgagacctctcagtcccagaagacattgtggactgtccctgacctgggtagagtggcatctggttggtgatgcccatctcatatcagccagggacaaagcaactccttgttcatcccagcttggcttttgatccgtgcccatgcctggttcatgccttggacacataggtttcctttaaagaggtggtattgtagccagcttatatttgcatctacagccatgtttctagtccagcttggtgtgcaatactagatgagttaataactggtccttgtttctgatctggttcccattgtgtaactgtgttgattgggaaggtagtttgtgagccatgaaatgcttggttcattggttgcttattgacctcattaacctaggacttgaatatcccaaagggtatgctctttaccacattcaactcctaatttatttgtttaggttatgatgtgattgctcaagcccaatctgggactgggaaaacggccacatttgccatatcgattctgcagcagattgaattagatctaaaagccacccaggccttggtcctagcacccactcgagaattggctcagcaggtaagagtggcttctattccctccttcagggctgatttagggatgatgagtataatccaaggaccagagaagtcttctctgatcaccaccttgggaggaagacatgggtgccctaacactctcgagacctgctgggttaattaaaagctatttcttacccaaacgtaaccattgcttcctccacccatttcctgagtcaaatgggaaagctgttgggtgaagcctggctggctgggcaagtttgactgtgttctgaataagcaccttcactatgggctaagagatcccttggtgtgggggtgatcttacagtagtcagagcagatggacagtccttttcacccttgcttaatagccagagctgtttcatgcctggggcacacacaattctaatgctggactttttcctgggtcatgctgcaacactgatgtcagagcatgtttttaaatgttctgtggcaggggcagtgattattctgggtgtggataatgtaagaagttacagcagagctccattctaaggcacttggctctcagttttctcagagtgaacatgcctcgtagcttgggtcctatggcaggagtgcaataggacatggatatgcatcacctgttctataaaactggttgctggctgggygcggtggctcaactcgtataatcccaacactttgggaggccaaggcaggcagatctcttgagatcaggagttggagaccagcctggccaacatagtgaaaccccgcttctactaaaaatacaaaaattagccaggcatggtggcgtgtgccttttatcccagctactcgggaagctcaggcaggagaatttaacccaggaggtggaggttgcagtgagctgagattgtgccattgcactccagcctgggcaacgagcaaagctctgtctcaaaaaaagaaaaaaaaaatggttgctgcgtgatgaggcagttggtcaaattagttttcagaaggttaagggttctaaatatctagagtaaagaaactgaattaattatctgagcggcctcattgtgaatcactgtacactcaggaaccagactgagttgaaatcctgtctttgccacctattgacagcacgatcttaagtggattttagcctctgcctgtttctcagctgaatgtgagtttaataatagtgcatgccccaaagttgttggttaggaatcaatacatgaaaaacatttaagaatggtgccgggcacagtggtaactgacatatgagcacctgcctctctctgctcagatacagaaggtggtcatggcactaggagactacatgggcgcctcctgtcacgcctgtatcgggggcaccaacgtgcgtgctgaggtgcagaaactgcagatggaagctccccacatcatcgtgggtacccctggccgtgtgtttgatatgcttaaccggagatacctgtgtgagtaattcggttctccaatcccctgggtcactttgctcttgtgcacgctttccagtctttcagcgtaagccagagtcattcccaaggatgctggtttctctctgggggaagagctgctctgtgatggagcccatgcgtgtcatctgagcctctggcttccctgccagtgcagccctggcagtgtcctacttcccagggctgttgtctgcctggcgggaaggtcctgggcaaaggatcagtctttgtactctgagagcagactacttggctcctctctgttttttatcagcgaagttggatatatctctcccacatttccctaatcatatgctatatattggctttttttttcttctctagcccccaaatacatcaagatgtttgtactggatgaagctgacgaaatgttaagccgtggattcaaggaccagatctatgacatattccaaaagctcaacagcaacacccaggtgagggcagtcttgcttgaatagctaatgattcttgaaaaatagtaagtgccaggggaaccatatactggattcttgagcctttttatgcatctgcttcagttttaggtgtggctagggaagggagcaggcctcaggaaggaaccagcactctaagactggcctttttttccactaggtagttttgctgtcagccacaatgccttctgatgtgcttgaggtgaccaagaagttcatgagggaccccattcggattcttgtcaagaaggaagagttgaccctggagggtatccgccagttctacatcaacgtggaacgagaggtggggcccagtgcaggaggcgggcctggtagtgagttgttgggtatagcccctgactgatttttgtcccccaacctccaggagtggaagctggacacactatgtgacttgtatgaaaccctgaccatcacccaggcagtcatcttcatcaacacccggaggaaggtggactggctcaccgagaagatgcatgctcgagatttcactgtatccgccatggtgtgtttgcccgctgccagcctgttgtgggtctgcccgtcagaagtgtcctacttgaagccagggttcctggaacccaggtgcctacctggtctgctgcatatttgttttctcttccagcatggagatatggaccaaaaggaacgagacgtgattatgagggagtttcgttctggctctagcagagttttgattaccactgacctgctggtgagtagagggaactgatagcaaaggcagaagggaggatccaaggtgattccctctccaaggggacatcagtgcctctcaggaaagtagcagcttggaatagaatctggcatgcctaaggcctttggggaactgggatgcttatttcctctgccttccttggctgcccacatggatgcctaagtgtcttccctccgggatagagtgtcctccgtgcacatgctgaagagttgtctttcttgacgtaggccagaggcattgatgtgcagcaggtttctttagtcatcaactatgaccttcccaccaacagggaaaactatatccacaggtaagcgtagatctggaacactcccctaccccttcacacctggccctccctgggcttaaagctcctgatattcctcatccccttccttgttttccagaatcggtcgaggtggacggtttggccgtaaaggtgtggctattaacatggtgacagaagaagacaagaggactcttcgagacattgagaccttctacaacacctccattgaggaaatgcccctcaatgttgctgacctcatctgaggggctgtcctgccacccagccccagccagggctcaatctctgggggctgaggagcagcaggaggggggagggaagggagccaagggatggacatcttgtcattttttttctttgaataaatgtcactttttgaggcaaaagaaggaaccgtgaacattttagacacccttttctttggggtaggctcttgccccaggcgccggctcttctcccaaaaaaaaaaaaaaaacactaatccatttccctaacctagtaacctccagatcccagaggctctcctcacctcagctgagctcctttgaaagtgattcaagggactatgtcactcagcctcatttgctggaccaaatctggagggagaacccctaaaacycctaagtgaggttgcccagggggttgtccccaggtggggggaagcaggggagagaaaatggtagccatttttacattgttttgtatagtatttattgattcaggaaacaaacacaaaattctgaataaaatgacttggaaactgcctgtttgggcttctcatttcttacctccccttccctctcccacctgctactgggtgcatctctgctccccccttccccagcagatggttacctttgggctgttgctttcttgtcaccatctgagttctcagacgctggaaagccatgttctcggctctgtgaatgacaatgctgactggagtgctgcccctctgtaaagggctgggtgtggatggtcacaagcccctcacatgcctcagccaagaggaagtagtacaggggtcagcccagaggtccaggggaaaggagtggaaaccgatttccccaccaagggaggggcctgtacctcagctgttcccatagctacttgccacaactgccaagcaagtttcgctgagtttgacacatggatccctgtggatcaactgccctaggactccgtttgcacccatgtgacactgttgactttgccctgacgaagcagggccaacagtcccctaacttaattacaaaaactaatgactaagagagaggtggctagagctgaggcccctgagtcaggctgtgggtgggatcatctccagtacaggaagtgagactttcatttcctcctttccaagagagggctgagggagcagggttgagcaactggtgcagacagcctagctggactttgggtgaggcggttcagccatgaggctggctgtgcttttctcgggggccctgctggggctactggcaggtaaggaggaaggaggctgaggggagggggcccctgggagggagcctgccctgggttgctaaccatctcctctctgccaaaagcccargggacagggaatgactgtcctcacaaaaaatcagctactttgctgccatccttcacggtgacacccacggttacagagagcactggaacaaccagccacaggactaccaagagccacaaaaccaccactcacaggacaaccaccacaggcaccaccagccacggacccacgactgccactcacaaccccaccaccaccagccatggaaacgtcacagttcatccaacaagcaatagcactgccaccagccagggaccctcaactgccactcacagtcctgccaccactagtcatggaaatgccacggttcatccaacaagcaacagcactgccaccagcccaggattcaccagttctgcccacccagaaccacctccaccctctrcgagtcctagcccaacctccaaggagaccrttggagactacacgtggaccaatggttcccayccctgtgtccacctccaagcccagattcagattcgagtcatgtayacaacccagggtggaggagaggtaaagctaaaactggsggatgagaggggagggaggcaggactggatataggctcagagggaagaaggaagaggggacagggaaccttggccggcatcgcatgcagtcttgtgaccttccagtctttaacttccgcaggcctggggcatctctgtactgaaccccaacaaaaccaaggtccagggaagctgtgagggtgcccatccccacctgcttctctcattcccctatggacacctcagctttggattcatgcaggtatagccatgwcctcagtctcacccctcactcagcctcccggcgcccctcccctcccaatcccacacgctactccttcctctgtggagagggataccacctgcgccttcctcttcgccccacaggacctccagcagaaggttgtctacctgagctacatggcggtggagtacaatgtgtccttcccccacgcagcamgtaagtaacctccttccctttctcattgctaccactagacgccagggttcctgaaaggactaagctggggccagggaggtggataggatctgacccttcctcactcctccagagtggacattctcggctcagaatgcatcccttcgagatctccaagcacccctggggcagagcttcagttgcagcaactcgascatcattctttcaccagctgtccacctcgacctgctctccctgaggctccaggctgctcagctgccccacacaggggtctttgggcaaagtaagacctacctactccttccctcctagaatcctcccactgcactgaaaaccccttccccaggcccataagccactcatctctcttcttaaccccccaaatctcgctctcccagcttgtcatggctacagggcagctttctttccatcctctacaagactctgccagtttcccccttttatcactgctgagtcactgcggtgagctcctcaccaatctcctactccccagcatccccccattccctcctcccacctttatcccaaccagcacgtcactgcaaatacctacctgccctatccttccgccaggtttctcctgccccagtgaccggtccatcttgctgcctctcatcatcggcctgatccttcttggcctcctcgccctggtgcttattgctttctgcatcatccggagacgcccatccgcctaccaggccctctgagcatttgcttcaaaccccagggcactgagggggttggggtgtggtgggggggtacccttatttcctcgacacgcmrctggctcaaagacaatgttattttccttccctttcttgaagaacaaaaagaaagccgggcatgacggctcatgcctgtaatcccagcactttgggaggctgaggcaggtggatcactggaggtcaggagtttgagaccagcctggccaacatggtgaaaccctgtctctactaaaaatacaattagccaggtgtggcggcgtaatcccagctggcctgtaatcccrgctacttgggaggctgaggcagaactgcttgaacccaggaggtggaggttgcagtgagccgtcatcgcgccactragccaagatcgcgccactgcactccagcctgggcgacagagccagactgtctcaaataaataaatatgagataatgcagtcgggagaagggagggagagaattttattaaatgtgacgaactgccccccccccccccccagcaggagagcagcaaaatttatgcaaatctttgacggggttttccttgtcctgccaggattaaaagccatgagtttcttgtcacatgcctttctatgccttccatggctgggtctcagggagccggaagcagctgctgaggagggatgaaaatgtcagtgtgtgacgatgcctcatgggttcaccccccaaagcctggcacagctggtgttgggtctgccgtgcctcccttccttcctcctcttggggccactggctgctccagttccccatccgtggcaagccggtagagccattcatccccgcagccttcttcctgaccctcgtacagtttcaaatgcagcagacagccaaagcaatgagtggggggctgtggaacttcattcccaaaggcagcgccagtggctcctgagcaatgagaatgtcctgtcctgtccaccatattcaaggccagcagaagagcccgattaaaccctcgcagcacctggcatgctcctatcccacctgcaaggggttgaatcaagaaggagcagtgggtactctgacctccactgggggctcctgggaacagcatgccccccacacggggccacctgccaagcctaacttcatgcccccagtacttgagatgaggagtgtcactctcaggacagccaaggtccagattctagaaaggacctcccagatggccacagcctgcaccagcagtgagcgccagtcccacccattacagctggctacggcgcaatccctgggagccaggatgagcagcaccccccagccgtaggagccccaggaggcttccggcctccaaggcccagagactgccccacaagggcagccctcacctggcagggccccagcagccccacctctgcctgcagacatccgtgtgaccttgtagactttggaggggggccgccaaagggctgatccacagcggaatgacgcacgggtgggcaccgtgggttggcgtcccggcggtcggtaacgaagcacaacgcccccaccaggtagtccaaggtgccctttcccaagcagcgctgcagggtccactcggcctcgccgaagtctctgcccagcacgtggtgcgccctcgggccagcggggagggggcgaatcccgggactgcctcgccaggcctcggctccccggagactcttgggggtctgggccccaagggtgattcaggtgctgcccttccccgacctgggctcgcctcccccacctcctcctctgcttcactgtcccgggcccagcagttgccggcgcactcatgctccgaggcctgagccaaccggaggcgagacaagcacagggccctgcgcgcaacccggcacctaaggaggcctgcccggtgcagactctcctgctcccaccggcgcccttccctctagagacgctgagagaacgggagctagtagcgcccccacccaacgccacctcggagactccggctccttctctctcaacttcgaacaatacaaagtgtgctaggagaagacaagatggcgcccagcaggaggagcggagaaaggcaggggtgtaaatctggcttccaaactggaagcgtcaacaaaggcgtgggaggtctaaccgcgcaggcgtgcagcttcggcaagctttacaattccaacagcgcgtccaaaacgtggtccctgactgagacttattttacgccactagagtgagggtgggtagcgtcagaaagagcggggcacggggcgggccagcttcgccgcgggaaaagaacgggaggcggagtgtccgcagcgcgcacgcgcaacgaaagtcaatggcggtctggagagactggcggaagctagctttgcaatayggcggccgaggcggacggaccgcttaaacggctgctcgtgccgattcttttacctgagaaatgctacgaccaacttttcgttcagtgggacttgcttcacggtgagttttattcagcatccgatccaagtcctactcgagtgaccgtgggcccttagtccaagccttgatcggcgactaagtgacggcagtgactgccgccatgccgagctggacggaagtcacttctgagaagggcggaagtgtctcgggctccttagagggaggacaccatattagtgccagtggggaagtcaccgggtggaattacttctttgtggagtttgtgctgtagcgacaatgaaaaacgaagagtcaacttttataaaacaaaataaaaattaagtcaaatcatgccaacctttattagatcgctagcagggttaaacttaattcaaagcccctgatgaatcgggccttcattgcacccccaaaggctccgccaccctgattgctttctttccagcctccaggtttgctcatagtctgatttcggaataatttgcctcccttcctttttctgattgcgagacagctccacaagggtcaccgtcagaccgtttggggagcgtcagtctgcccctgtcagttcatggtacctctcttgagctcgtggggcactttgttttagccgcattcatgacccgtgagagtcagactcccactagaccaagttccttgaggggaaggcttcaaggctagagaagttgtggatggccagggcataaaagcaagccttgaaagggtaaggtttagtccctgagtaggggccagggacagtcagagtgttcaagaaagagtggtatggggcgggcacggtggctcacgcctgtaatcccagcactttgggaggccgaagcgggtggatcacctgaggtcaggcgttcgagaccagcctggccaatagggcgaaaccccgcctctactaaaaatacaaaaaattagccgggcgttgtggcaggcgcctgtaatcccagctactcgggaggctgaggcaggagaatcgcttaaacccgggagacagaggttacagtgagccgagatcgtgccattgcactccagcctgggcaacaagagtgaaactccgtctcaaaattaaaataagaaaaaaaaaatggtatgaagacttgtctttggagagagaagacatgtgaaatggggcacccattggcccagagaagggaaataaaggatcagagagctcttgggcatttctcagctttatatggggaagcaatggagagccgtggaggtcaagccaagtttgggtgttaatttatagggaatggaagattggatgtggggggtggtaggcatcggagaaaagctgttttggaaagtaacagtctggggcccggtgcggtagctcgagcttataatcccagcactttaaggaggctgaggcaggtggatcatctgaggtcaggagttcgagaccagcctggccaacatggtgaaaccctgtctctactaaaaacacaaaaattaaccgggcatggtggtgtgtgcctgtaattctagctacttgggaggctgagacaagagaattgcttgaacccaagaggcagaggctgcagtgggctgagattgggccactgcactccagcctgggtgacagagcaagactctgtctccaaaaaaaaaaaaaagtgtggtggtttggagcaggaaggaccaggactttctcactgccctccgcctctcctccccccaagacaatgcaagaccctggtgtgggtaagggggctcggggagagcccacaggagcttcaagccctggcctgggtttcagacatctcctgtctgcttacccttttttctctcctcagtcccctgcctcaagattctcctcagcaaaggcctggggctgggcattgtggctggctcacttctaggtatgtctcttatctttctttccagctgttgggttggggtggaggtgctgagaggccatcaactgtgtgggtgttcgttctatagctgttgtgttgcatcccaaagaatggagagtcctcagtcctacttttctcatctttcccctagtaaagctgccccaggtgtttaaaatcctgggagccaagagtgctgaagrgtygagtctccagtctgtaatgctggagctagtggcattgactgggaccatggtctacagcatcactaacaacttcccattcaggtgaggggcccacccttccaccccaagggtaatacccacaactctaatggggattaaggtgaaggaggttacaaggcagcaaagtggccgggcccagtggcttgcacctgtaaccccagcactttgggaggccgaggcgggtggatcacctgaggtcaggagttcgaactggccaacatggtgaaaccccgtctctactaaaaatacaaaattagctgggtgtggtgatgggcacctgtaatcccagctacttgggaggctgaggcaggagaatcacttgaacctgggaggcagaggttgcagtgagccaagattgcgccactgcactccagcctgggcaacaagagcgaaactcagtcttaaaaaaaaaaaaaagggacaaggggctaggaaagttttaagcccttttagaaacctaatcatcaccagtggaggtgatcttgagaaggggtgagcatcccgagaatggccacgattcagaatgagccagtcccgtgtgggggctgtagagaagcgtgatcagagcatagtgtccctggatggatgggctatggaggctttccctgcctctttctaggcccgcctttcttcctcccaactcttgactctgcagctcttggggtgaagccttattcctgatgctccagacgatcaccatctgcttcctggtcatgcactacagaggacagactgtgaaaggtgctggggacttacccaagagcaggctgtgtggttcctgggaaccctgctgggaactcaggtctgggaaagccaaatgatgtggagagattgacaaggactcctgtctccccacccctaggtgtcgctttcctcgcttgctacggcctggtcctgctggtgcttctctcacctctgacgcccttgactgtagtcaccctgctccaggcctccaatgtgcctgctgtggtggtggggagggtgggtaccaggagcaagggacaagatgttgtgggggcagggtsggggggaagagtagaagatcaaagtgtgggggtgttgtacttgggggagcatgggaagagctcaggtgacagagccaaaggtctcaactcctcccctagcttctccaggcagccaccaactaccacaacgggcacacaggccagctctcagccatcacagtcttcctgctgtttgggggctccctggcccgaatcttcacttccattcaggtgagtgcaacatcttccttctagaaggcactaaaacctcgtcttacttctcccagctaagggccaaagctgccccgtgaggaacctttgtccataagggaacctttcttgagctatgctgaagggtaaccctggctctgtctcttgcaaccaggaaaccggagatcccctgatggctgggacctttgtggtctcctctctctgcaacggcctcatcgccgcccagctgctcttctactggaatgcaaagcctccccacaagcagaaaaaggcgcagtagagccagctactggagtcattccgtttccactcattcacccaacctcagggttctccccatctgagccagcctgctggtgtgacttactcatcctccattcctctgcacttgcagactttctgagccagggttttcttttagtggaaacaaatggttgatggatccagatccttagaaaaggagaggatgggggtagagtctcccaagccaaaattttgacatttgagtgctttcgtaagccctgtacatgtactattaattcagtcattcagccaagcctcctcctctagcagcaatttccagctgtttaacactatcctgggcaaatgttttaccctgtcctccagcctccctgcttcccttctggccctggaagactgagtctggacggcagagtggagggactgggaggctgtggctgcctccctccctcagcccggctgggactgtctcccggaccccagtgctggggtgggggaagggggacggagaatgactcaggcagggccccagggtggggtgaggaggttcctgctctggcaggtctaggcggaaggga

SEQ ID NO: 17570 - DNA, 14527 bp, Homo sapiens
ttctccacatcttcacccacacttgctatttttggcttttattttattttttaaaataacattctaatgggtgttaagtggtcagaaatggttcttttaggagtagagatagaggccagggggatggctcacacctgtaatcccagcactttgggaggcctaggtgggcggatcacttggggtcaggagtttgagatcagcctggccaacatggtgaaactccatctctattaaaaatacaaaaattcgctgggtgtggtggtgtgcactcccagctacttgggaggctgagggaagagaatcgcttgaacccgggaggcggtagttgcagtgagccgagatcacaccactgtatggcctggtgacagagcaaggctctgtctcaaaaaaaaaaaaaaaaaaaaaagagtagagatagaaaagcattgaaaacacagcctcagctcagctcagtctgccatggtgggaagccattaattcttcactcttgaaaccttttcgtccttggtgtggcagaggctgcaagtctcctctgcaactttattcttcccttctttctcagttataaaatccctgattttagaaatatctttattgagatataattcacataccataacattcactacaattgaatggtttttagtatattcacagatttgtacaactatcaccacaaactaagtttagaacttttttcatcatcccacaaagaaaccccacacccattagcagttattcactatttctccccaatcaacctcccctcccctcaatagccctaggcagccaccagtctactttctgtctctacctatttgtcttttctggacattttatacaaatgagattttacaacatgtagtcttttgtgactggcttttttcccctagcataatgttttccaggttcatctgtggtgtagcaggtatcagtacttcaaccctttttattgccaaataatattccactatatggataggtaacattttgtttatccattcatcaattgatggacatttgggttgtttccattttcttgactgttatgaataatgttgccatgaacattaatgcacaagtttttgtgcagatgtgtattttcatgtgtcttggttttatacctaggagtagaattgctgagtcataggagaactcctccatgtttaaccattaatgaactgccgaactgttttccaaagaaattgcaccattgtacaatcccaccagcaatgtatgagggtagaatccctgatttttaactgatcattgagctcaggcccattcaaaacaaagatgacatttcctaaccttccttacaagtagttctgaccagtgagatgggagaagaagttaggttttgtccttaaaagaaaggagagtggctgggtgcagtggctcacgcctgtaatcccagcactttgggaggccgaggtgggcggatcacctgaggccgggagttcaagactagcctgaccaacatggagaaacctcgtctctactaaaaatacaaaatragctgggcgtcgtggcgcatgcctgtaatcccagctactcaggaggctgaggcaggagaatcgcttgaacctgggaggtggaggttgtgatgagccgagattgtgccatcgcactctagcctgggcaagaagagcgaaactccatctcaaaaaaaaaaagaaagaaaggagagtacattctacactctcctctcctccaccctgccccctttccagtggctggatgtggacatggtggtaagctatcttagatcatgtggacaagggaaacacatagggatattagaacctccagacagaaggaacttaggaccctggacagctttgtggagcagtgctcccataccagcgtgaagttttgtatgggagaaaacatacatttccagcttttgtaagccactgttattttgggtctctctcagagcagccaaatatataatttaactaatatattttctttctgtgattcttctttattttgattatacttctacttctctgcccctcttttaggtgggaggtgctgctccaagcactaactcagaatatagaccctctccctcttgtaatagtgccagcttggagttctttgcttccactgtaggggaaggaaggaaaaaatatggagaactcacatccactcttcattgtcctcaaacagaagtaacccattttgttctgctcacagcccattggccagaactaactgtatggccccaatctaattgcaaaggagtctgggaagtacagcacagcacatggatctttggaaagcgttaattttctctgccaaaggcttcttttgttgttgttgttgtttgaaatggagtcccgctccgtcacccgggctggagtgcagtggccctatctcagctcactgcaacctccacctcccaggttcaagcactcctccagccttggcctcccaagtagctaggattacaggcgtgtgccatcatacctggctattttttttgtatttttagtagagacagggttttaccgtgttggccaggctggtctcaaactcttggcttcaagtgatccgcctgcttcggtctcccaaagtgttgggattacaggcgtgagccactgtacccggccaatactggtgttttctgacctcagcgtttttcttttctcctgccatgtactctccctagagatttcatctactcccaagtcttccactgctcctatctgctgatgactcccaaaactcagtctccagccgagacttctctcctgggcttgagacatatgtatccaactgccagaacatctccagtggacagcctttgggcacaaggccacactagcttgtgggtacaagtaatcacccaaagtcaatttcagtggctctccactcccacattttttcaacccctggaaatgttcccttcccaaatactctgagtctctcttctcttttgatgactgtggttttgtgactggatggtagctcctgttgctttttttcctttcaaatgaattttctcttaggaggcttcttagccattaagcaaatagacctcaactgggcttgccctatgcctatctgaaacccagcttaggttcgagttaggactcctgttaatctgagctctcacttcctgtcccaacctgcttattttttttggtgaaagaaaatatcatccccctagttgctcagaaacctgggaatcattgggattttttcctctccttcaccttcctcatccaatcagtcaccaagtgctatcaactctgctgccttagtagccctcaatatatacttacctatcaaccatcactgctatgccatacttcaggccttcatttctcacttggattattaaaatatccctaaatagttcctctgccttctctctggccaccctcctgagtgatctctccatcatgtacctttcagtgactgcttgcacaagcccctttgtgacttggtcatagtctgctctcttgaaccaccagagccaagcacctgggttctgattctggttgcaactcttactgcgtgatgatggacaggccacttgatctcctcaaacctcagttcctaaatcaaatgaatgattgaattcagtcacttaactttgtatgtagtaggtaggcactgtgcaaaacatactagtggatatagagatgaataagaaaaagcccctgcactcaaagagctctcggattcatcaacaaattattgtgcagttagatagtaagtgctataatccaggaatatacagtgttgtgtgaataatgtggaatcagtttatctccagagcagaaaaaggtgaaggccgaagaaggcattcagagtgatactggagctgtgtagcaggggctactactgttccctcaaatcctttcttctcttcttcctgagtaatagagtcctttttcagctaggcatacagccatccaaaataaaaactatatttcccagcctccttttcagctaagtgtagccatgtgactaagttgtggccaatgggatgtcagtacaagtggtaatggcaatatctgggatgtgtctttaaaaggaaggaacatgtccttctccttttcctccttcctgttccctgggaggtgaacttggtagctggaggtgaagcagctggaacttggatatgagcgtcttgttgatgataatagtgcaacaagataaaagcagcccgagctggcctacatttacatgagaaggaaataagactccattttgtttaagctattctcttgcatatatatatacacatatatatcagctaagtgtagccatgtgactaacttgtggccaatgggatgtcagtatgagtggtaagagcagtatcttgtatatatatatgtgtatatatacacacacacatatatatacatatatgtatgcaagaatataaaatatacatgtgtgtgtgtatatatatacacacatatatatgtcccttgcagccaagtctaattctaactaatacaaactaactctaaaaaatgaatatatattcaccaggggataggctatttcaagcagagggaagcctgtataaaggctcagggaatgctgtggttttatgtggcagcagatgagactggaaatgagtcaggatgagccacagtggaggatgaattaaatgggcaggagtgtggtagaaagacctgttggaggctatgaatgcaatcaaggtgacagacaactggtgcaatgatggtagtggaaatggaggagaggggattgattcaagatgcatttaggaccaagaatcgggagcttgtgaacgtgtgtatgagtactgtagacggagtgggtgtgtcatcagagaagatctgagcatttgggcttgctctcctcagaggccctgcgagtggagttcagcttttcctcatggggcaaatcttactttcgctccagttcctggggctcagagtccctggcccagatgcctcttgccatctcatcttcaccctgcctggcttcccttgcttgttccaggattgtttcataaagagggatgtggttggtctttaaccctatgaatgctggctgaggatgcctgcggaacctgtagtgaagctttcaggggctgctcgggttctggctggtaggtgaacactgtccatcttgccggctgggacacagtgactctgggtagttgtgtaagagaggggcccttggcagacaaacaggttcttctctgttggtgggccagccagcaggtcagtgggaaggttaaaggtcatggggtttgggagaaactgggtgaggagttcagccccatcccccgtaaagctcctgggaagcacttctctactggggcagcccctgataccagggcactcattaaccctctgggtgccagggaaagggcaggaggtgagtgctgggaggcagctgaggtcaacttcttttgaacttccacgtggtatttactcagagcaattggtgccagaggctcagggccctggagtataaagcagaatgtctgctctctgtgcccagacgtgagcaggtgagcagctggggcagagggatgggggtcacagtcctaagggagggcattgcaggtggcctcaggggagagcctggggtggcccctaagacgtcctcttggaacattttggcagagttgcctcttcgccctcattatggctcagtttttccaccatgaaatgggagggagggagacaggtgggcaggggagaggtggtagaagtggcctagagaactgttcctggggtctgggacctttgcgaaggggttagagcaccacgctccctgctatgtgactgaggtagcaagagcacgccctcttcccatgtctgaggaagacaccctagcctccttgactcacctaggtcagtcctcttgagccccaacagctctgtgctccccagcccaaggaaggggtaacaggatttcgggcagttgcccctgcagaggccccctgggcaagtcccctgcgccatgtcccttcgtctccttcttcccctaaccaggcctccctccacctgtcttctcagagcagrtaatggcaagcatggctgccgtgctcacctgggctctggctcttctttcaggtgggtctccgaccctgacttcaacgtgggggtgtgggtggaggctggccagagkgccctgtccaccctgggggaggagagcccaggccctgattacctagtccctctccacagcgttttsggccacccaggcacggaaaggcttctgggactacttcagccagaccagcggggamaaaggcagggtggagcagatmcatcagcagaagatggctcgcgagcccgcgtgagtgcccaggggaaggggtgtaggcgaagggaggagacagctgggccatgccatgatgacctgcctctgctgcctcaacctctgtggccgctgctgggacagaggaaaggagcggtgctagctctgtctgcagatcccggccatcctgggctctttagcgccctctgcctgcagcccccgccttgacaactccgtagctgttgcccccttgctcactgaggcgcgggacctgggatcaatcgggaggacgcccgctgcagtccccagaatcaaaggatgatgtggcgcatctatgtttctttggagagtgttgtaggtctggatttgtatggscaatgtgtttgtgcttcgtgcgtgagttgttactggccagggctaggacaagagccctcgaccctggggccaacgccctgcgtccttggttcccccagaggatcagtgcgcgatgacttggggacaaaggagatgatggrggctagcagtctgacggcctggatatctgtccccttctccaggaccctgaaagacagccttgagcaagacctcaacaatatgaacaagttcctggaaaagctgaggcctctgagtgggagcgaggctcctcggctcccacaggacccggtgggcatgcggcggcagctgcaggaggagttggaggaggtgaaggctcgcctccagccctacatggcagaggcgcacgagctggtgggctggaatttggagggcttgcggcagcaactgaagccctacacgatggatctgatggagcaggtggccctgcgcgtgcaggagctgcaggagcagttgcgcrtggtgggggaagacaccaaggcccagttgctggggggcgtggacgaggcttgggctttgctgcagggactgcagagccgcgtggtgcaccacacckgccgcttcaaagagctcttccacccatacgccgagagcctggtgagcggcatcgggcgccacgtgcaggagctgcaccgcagtgtggctccgcacgcccccgccagccccgcgcgcctcagtcgctgcgtgcaggtgctctcccggaagctcacgctcaaggccaaggccctgcacgcacgcatccagcagaacctggaccagctgcgcgaagagctcagcagagcctttgcaggcactgggactgaggaaggggccggcccggacccccagatgctctccgaggaggtgcgccagcgacttcaggctttccgccaggacayctacctgcagatagctgccttcactcgcgccatcgaccaggagactgaggaggtccagcagcagctggcgccacctccaccaggccacagtgccttcgccccagagtttcaacaaacagacagtrgcaaggttctgagcaagctgcaggcccgtctggatgacctgtgggaagacatcactcacagccttcatgaccagggccacagccatctgggggacccctgaggatctacctgcccaggcccattcccagctycttgtctggggagccttggctctgagcmtctagcatggttcagtccttgaaagtggcctgttgggtggagggtggaaggtcctgtgcaggacagggaggccaccaaaggggctgctgtctcctgcayatccagcctcctgygactccccaatctggatgcattacattcaccaggctttgcaaacccagcctcccagtgctcatttgggaatgctcatgagttactccattcaagggtgagggagtagggagggagaggcaccatgcatgtgggtgattatctgcaagcctgtttgccgtgatgctggaagcctgtgccactacatcctggagtttggctctagtcacttctggctgcctggyggccactgctacagctggtccacagagaggagcacttgtctccccagggctgccatggcagctatcaggggaatagaagggagaaagagaatatcatggggagaacatgtgatggtgtgtgaatatccctgctggctctgatgctggtgggtacgaaaggtgtgggctgtgataggagagggcagagcccatgtttcctgacatagctctacacctaaataagggactgaaccctcccaactgtgggagctccttaaaccctctggggagcatactgtgtgctctccccatctccagcccctccctctgggttcccaagttgaagcctagacttctggctcaaatgaaatagatgtttatgatagaagtttgcctggcgtgactctcatttggaccatgtctgaaagcagtggcctcaccactatccccaaagcacacccatcacccactccattcccttgctgctctttctcatccacccactcccagtccaggtctgtcaaagggggtctggctgggctctgcttcagggatcctggctagacaacggctgtctgtcacacctggcaggagggcctgggttacgggcccttcctctgcacctgcactgttcactagcctgctcccccacaggacactgtgcatggaatgcaggctgtgtctggaagagctgtggccctggtggacctaagattcctgaggtgggctgcctcctttgttcctgctgttctagagtttgaatggcctctttttatgccggactctcttctggggactcccctcactcaggggcaccaatgctccctatagatcccctgggaactgaaactggggtgtggtggaggacgtggaaagggtaaacacagctccttgtctttggacttccctgtccggccccctttcctcccagctcagcctactgtccccgggttctcagcacctgcctgctccccaaccccatagcacagaccccacacatatgtaggctcatcatgcctgcaggctggtcttccctgacaccgtggattttgacaatgttggcaacagaactgggttgtggacccagcacctggagagaggaagtgctagaaaggtagaaataataaaaggtgtttttgttgttgttaggaaactggaaaagcataggtcaagggctatgatggggatgaggaggtaggagtgaaaatgagggctgtgtacttgaggctgggattggggaaggtagtgatgaggacagaatagggagtgggaagaacagaaagggacagagggattcagggattgtgagagaggggaagaggctgagccacccggaggggcgacctagcacgcaagcagtatgtggcccaacactggaaccaagcagcccggctccgggcgcaccttctcagggattcctcagggacaagtccagccccttgtcgtcaaggctcttgtagaccgacgtagggaccaatagaaccccgtgcggtggagctattgtgaaggagcaaaaaagtgccctggttctaagaggacgtcttaggggaagtgacggctgagttgaggtggatccggctggcgatgtaaggttcgagccatataaacccgggaaccgggagcccttgacgacattgttccccgagtgcccggagtctgcggctttttttggggtggtggcagctggcggaagtgacgggagaggggtggggccgcgagagcggcggaagtaggaagccgaggtctgaattgcgcgtggtggccatggcggccagcggggctgtggaaccagggcccccgggggctgccgtcgccccgtcgcccgccccggccccgccgcctgcccctgatcacctgttccggcccatcagcgccgaggacgaggagcagcagcccaccgagatcgagtcgctatgcatgaactgttactgcaatgtgaggcgggggcgcggccgcgagcggcgggtgggtagggcttgtgccgggacgagccgggggtcagacccagccaggtgggcccggccggggaccccgaggagcgcccggagatagtagggcggggaaagggagtttcattgatttttttccttagctactttctacttcaccagggcatgacgcgcctcctgctcaccaagattcccttcttcagagaaataatagtgagctccttttcctgcgagcactgtggctggaacaacacggagatccagtcggcaggcaggatccaggaccagggagtgcgctacactttgtctgtcagggctctggaggtgagaggacctcagagcaggtacctcagtattctagagagagattcggtactggggtcagagctctggtccaggcggtcggatcttaaataaatccccctatgtctcctagccttagtttcttttgtaaaatggtactggtgttgtcatcagctcaagtgagataagatttgtgaaaatgctttgtaaatgttgtctgagggtatgaaatgagcagtagttgttatgaatagtattctcaccatttggacagcctggctcacaccacctgtactattcgaaaggagcagtctggaccctgtggagtggcgagagggagagacagctgggctgcggtctgatggaaggggacggtctggttattacttgaggagaagctgttctgcagtctctttgtactgaacgtattcttttcttcccaggacatgaacagagaagtggtgaagactgactctgctgccacaaggattcctgagctagattttgaaattcctgcctttagccagaaaggaggtaagtttaagatcagagtatttgggctgttcgcatgtagctagaatcttaccctctttcttgcaaaaccccctggtgccaggtctagtggtttgtgtatgggttctaccatgtaatcattgtaatcttcattagttaatcatgagtggaaagcttaggtaaaacagctcgagatggtagaaagtaatggtaataccatagtgtgtttattgtagaattttagcatcactattatcagacatgaatggaaccttgcacctggccttctcattttacagatgaggaaattaagacccagagagttcaagtgaattgcccagggtcatacagggacttgatagcagagctgaggctaagtcacacttgtcttttgttcttgttcacaagctctgaccactgttgaaggattgatcacccgtgctatctctggcctggagcaggaccagcctgcacgaagggtaagctggggttttctgattgtagcagctcaaggaataattgcttatatagagtgtcccatgtgtctgaagagtctctgactaagtgttggaaacttgctgggtaagcatatggtggtgctggagctgctagaatgttgcatatgttataattattgtcttttccacttccctccctcagtatatattcaggcctcatcagacaatataacattacctctgaagagcctttcctaatccccttgggttatctgtgtttcctgagtattccactgcatcttatatttattatgacagaagtaatatattatagctgcatctttagttatttgtctccttaattggttggggagtcccatgagaggactgatatatatactattatatctctaacgtggcatgagtgcctgggctaaatggttgaatgagtgagaaaaatgaggctcacctgtcaccacccgtcaacttcaggcttgtttgctacatctcattgtgaagcctgagtcactctgtttccactcacactgagataggtggtgacttcctaatggaagtaacatgggcatgacaaggggcagggcataaggtacaccaccagggctgatgctttactctctgttcatggcaggcaaacaaagatgctacagctgaaagaattgatgagttcattgtcaaactgaaggagctaaagcaagtagcctcccctttcactctggtgagtattgagaggctggagttgcccttgattaggggaggagggaccattaagactgctgggattttccactgtgatgcctgcgtggtctgatagtaggtgatgtaggattgtttatgattttcttttgcagtgactctctcttctcccatttgttagatcattgatgatccctcagggaacagttttgtggaaaacccacatgctcctcagaaagatgatgccctggtgatcacacactacaaccggacccgacagcaggaagagatgctggggcttcaagtaagtggactgaaggatccagaagaatgctctggaattatcgcgcactctggattgcttggagtcagtggaacttattttgctgctgctgctctgtgtgccctatctcagcttgtttgtgcttctcatcttgcttatgtccaggacttgggtaaacttcacagaaaggatggcagtggctgtgatcctatcttaagtcctgttcttcctttggttggggctttactttgtggtttctctaactgatgaggtggcacctgacataactgatgaggtggcacctgagcatttctcccactccagggcagggtgttggggacactgaggtatacctgccaacttgcgacctgcatctttgctattttaggaagaagcaccagcagagaagccagaagaggaagatctcagaaatgaagtgagtcacattggctactggtgaggaaggagcagagttgtgggctgagactgatgctgttcagcatctgtcttccttgtcaccaacatagatgaccactagcataccaactgagtgtctttagcctgaacatcccatctgggagggctcaccctttgtcctcatgttgtgttccaggtgctccagttcagcacaaactgcccagaatgcaatgcccccgctcagaccaacatgaagctagtacgtatcttttgccaagcagttgggttgctcttcatctgactcaggcatgaagattataatcaggctgggagcatccctttcaaggaaaacacatgctttatacccagtgataaggaagatattatctttgattagactgtgtaccttgggttttgtgttcaaagagaaaattaggccatggtcactaggctgtgtgtgtgtgacctgagccatgccttcaaatgtgtgaacagggattgccatgggttgggaacttgccctcttctggaggactctgtgggctgcctcttgtgaatatttcctgcagttctgggaccagcatatgtttgtgtggggtttggctttgtttttccccagatggtggtcttgttcgcctggaagtagatttccttaactccgttttccagaaatccctcactttaaggaggttatcatcatggctaccaactgcgagaactgtgggcatcggaccaatgaggtgggtgggcgccattatttgggaagaagactagcttaagggtaacccccttttaactatcattcttcctaagtacttcagtactcgggggcagggggtgtagagtagcttgggtctttttcttaggtctagtgcagggtgatgagcccttgaaggaatgggaattagcctagagaagaaaagttagagattctataacttgtttaagacatattaaaggttgatgatatggaagagagaagtcttttgacccactcctcagaggtgtggaagttcagggaggcagactttgacttcacaatgaagaactcaatagagctgtctgaaaatagaatgagctgccttagagaattataaattcccttcccctgagtgtatctgagtataagctaattaaattctttaaccagaatattataaaggagacccacacattggatgcagtggatgaaaggactgcaataaatgcttaaaagtctctttcaaccccaaaagtcttttttttttttttttttaaggtaaattcagagtttattggcaatttgggataagttttggcacgttaccagggttgggcactgttcctggccagctcttggtgtttttggtttgggcgactgctgtttagaaggctctttctttggtagctattaatggccctaactgattggatgtccaagcctacactccaggtctcctgggtaccaagtgaggctcaggtcttctctctgttgctcctgactgttatcgatgcaggtgaaatctggaggagcagtagaacccttgggcaccaggatcaccctccacatcacagatgcctcagatatgaccagagacctcctcaaggtaacagtctgcttgggaaagtcactgttgtcctcataagttagataaactgtctctatctaggggaagttgtcttttagaaataatgttcagggacatgaggtatctcctacttccctggctttgaggacccctgagcagagggagttaatctaagattggaa

SEQ ID NO: 17571 - DNA, 13083 bp, Homo sapiens
ttagaagtagtggcatactgtatgttgtcttttatgtctgacttcttccacctatgtcatgcttttgaggctcattcatatggcacatgtaccaattttgtattcctttttattgcttaatagtaatttattgtatggatatactatattttgtctgtctagtcatcatctgatggacattaagttgtttgcatttttagcaattatgaataatgcttctataaatattcactttcaagtctttgtgtggacatatgtttcttctagggtagacatttaggggagaaattgctagatcatatggtaaatttatgtttaacttttaaacaaacttcccattttccataatggcagtactgcgatagtactttgaagctgcctactgcatctcctttaagaatatagaagtattgtgctaggtgctggcatataaagatgaacaagtcagtttctgcccataagcattatacagtctaatagccaaaataattatagatataattacaaagttgaggaaatgaagtcgcttccttttctgtctaactagtagagtctactggggttttacataattaagattgtctgaaaccaaaacagagaaagctaaaggcttcttcctttcagacacgtattaagtacttgatatatttctgacagaaatcagagctaaagatggccttctgccagaagttgagttcagctgcatgaaacagaaaatcccacataatgagagcttaaagaaataaaggattatttttctgtgatacaacttgaaacctaaaggtaagcaattcagggctgggactacctctctctaaagtcatctgagattcagaagtctttcaggtttgggctccacattcacaggatcaggcccttgtcttcacacttataaaatgagggatagagctccagcctttacatcatcattccaggcagtaaaaaggagaaacagtcaagagcagaagagtttgtgcctgttgaagtttgctggctgggttacttgaattgcctccctggaacttccatagaagacttcccttacatcactgtcaagtattggatcatgtagctacctggtcttcaagggaggctggcacattagtattgcagctggacatgctcttgccccagtaaagcaggagtccattggtgaggaagaagagaataggtattgtgtggacaacccacagccctgacttctaggagtaagtaatcacgcaagggaaagagtatgccaaagaagcctggtgcacaggaggtcttctgtagtccttaatttggaccctattcccctaaagctgaacttgtgacagagacttgggagcatgtaatttatttgagaggtgatcctgggaaacaggtctgagggcttagagagaatgagatggatacggagcaaaagccaattataagacacattatcaagcagttgcagtaggtgatggaggttcaggggatatctgggaagcatacacagcatctgccattgtccacctgcaggatgggggagctgaagaatgtatctattgcctctggccctcattagttgagcgttgcccctggggkcatttactcccccctcatttccaggttgaactttgtcagatgaggaatgccacacacacacacaccagggaagactctggggcagaatgtgttcgtcacccttaaagtggcaccctggcagtgtaagttgaatctgagctcccacggaactgggggagctgtccagcaaacggctgttgaaatcagaggtaagctgggtgcagggacacaggcatcagcagcatctgcccctcatgaaaagttcatatttataataaaatctaatcgttgtgttctaacatgactgctggccaaactgtcccccttttcgtggcatggatgtgacctctaattatgcaatattctgcatgtcatttttaaaacagctttgttgagatagcgtcaatataccatacaattcacctaaagtggacaattcaatggatttttagtgtattttagtattttcactaatgactaatcatattgagtcttttttcatgtgcttgttggacatgtgatatcttcctcggtgaaatgtctattcaaatcctttgcttccaatcattaaattgggcaatatgtctttttgttataatattaaattgtaaatgttctctatgtattccagatacatgtcccttatcagatatctgatttgtaattactttctcccattctttgtgttgtcttctcatttttgtggcatcttttaaaacacaaaagttgttaattttgaggaagtccaatttacttttttttttttttttttgagacagtgtctcgttcgctctgttgcccaggctggagtgcagtggtgcaatctcagctcactacaacctctgatacctgggttcaagcaattctcttgtctcagccactcgagtagctgggattataggcgtgcaccaccacacctggctaatttttgtattattagtagaggagacagggttttgccatgttggccaggctggtcttaaactcctgacctcaggtgatccacctgcctcagcctcccaaagtgctaggattacaggcatgagccaccatgcctggcccactttttttttctcttgttgcttgtgcttttgagagtggggaaggagtactgaaccctgtcagcttgtcagcaaggagaaagggtggtaaattagtgtatgaaatttaagaaaagctgtaaaaaatagttgacatttaagctggatcttgaagaataaggagggtataccagtcacaaaattgaggaagagcttttcaggcaaagagaccacctgggttcattatctcctagaataagaatctccttgttacatttattataactgattcaaaacagacacccccacatatgccaacaacatacggtaaacactgacagagactgtcatgtcctacaattgttattaataaagccaattcattcatgcaagattcagttaaaacgtaatgctgcatctgtgcaactcccccaggaaagtgggaagtagtgtttggagaagaccaaataaacactcatgagtgatgatgatacctctgaggacacagattttaagtactaggtcccagctgctctctttgaaggatgcacacgaccagagaatgaaagcaggaaaaggtggtcagtgctcagcacgtgccaagcacagagcaggaaaagacctagtagataatgaatggtccctgccttatagtctagctttacatgtatgactcatgcccttgaaaccacagactggatgtgaccctgagggtaagagaagttcccaaaaggattaagaatgtgtttttttccaacctagaagaatggtggcttggcatcagaaattaagtcgttctgttgaaaataaacagaagtggaaatgtatattcagggcaacttaaactcatgctcttgacaaaatatttttttaaaaaaagcaaataaacaaaagtatttctcatgcccctcagttcatagacagaaactcataccaacaggctttttttttattttagtaagaactgccaaatggtgaaactattcacaaacactagaaatgcatgagagtgtcctcccgatattcttacctgaattttgcatctttttatctcttgtcaatctagctgggaaaacgatattaaaatctcattttgactggcatttccccaacttcctagatggcttcacatcttttcatgtttattaaccatttgcatcttctcttcagtaaattattatttatatcctttgcccaattttcttaggggtaatttatctttttctaattaatgtgaaagtagtctttgtatgtaagagatagtaactttacctatagcaaatattttcattctgtttttcttttaacttagttcagggtgtttttccatactaaattttggattgctcatcttgcttaagatctttccaccccaaggatcctaagttttcttctatttccatatgcatatttttaatatttctcacacctacacacacatacatagttacatggagagatggatcattaattcacctagaatgtgctgtgtgtgtgtgtgtgtgtgtgtgtgtgtgtgtgtagggatgagaagactcagtgttttctgagttcatatgatctacatggggaatcagatctaacatggaccaagtgttaaaccatacttccaagaacaacactacattagtaggccacctgctaacttctgcctttcacattttccagcttaaaacatctccatcctccccattatgtaagaaagaagtacargtgtttctgactgctccctctcccatgatcccataacccatcagttctgaagctgcattatccaaccttctgaatctctctgaccaccctccaagtcttccaagtccccatggccactcccttgctccaggccaccatcatctcaccctgggtctttgcaacaccctctgccccggactccctggcctacatgctcagtctgtctaattcattctccaccctgcaaccaggaatatttctaaaatgcagaccccatctcattcctgccctacctatgtttcttccacagtccccattgctgtcaaggtactgtccaaattctcacatctggctgaggctgtccttcaggattcaggcacctctcaactttttaagaaactgtgcagcctcatttctcagattgtgtctcctatttccatgctctgaccagagcagactactttcagcactttcaaaagcccaagattctttttcagtggagctcaactgtgactatgccccagctcacctgtcaaaaattgcaaacacacttgttcaggtcttacacctgggtgattctgactccgcgggtcaaatgggatctccacatccacaatctgtgatgacttctatggccagggtgctctctgcctccaggctgcagacgtgtgattccctctgcctggagtcctcttctacctcctccagctccagcccccaccccaccacccaccccaaactggatatgacctcttcctccttgaagtcaaagcataggtgctccttcctccaggaactttgacagtccgggttagggctcttcctctttgcatccctggtttcctggactttcctgattcaagcatttattgattcctcttcttccaccccagactctgagttcggggaagcctgagatagtggctgttgtcttgctcaccactgtatttcctgcactcagcagagacctgacacatagtaggcgctcaataaatgtttgctaaacaacaacaacaaatgaatgaactaacaaataaacaaacaaatgaacagatgagtggatgcctgtggcagtttccatgacaaacacaaagggctaagccaagccagcaagcagacagccgtgcggcctgcagagggcactagtctgcttcttaatctccctgcagaatcctcagggccaggtacctgctgtcagtcagagaggtgcccgatgctcagtggtcattctgctgcgctgaagattaagtaggagttgtttgcccttggccaatatgaaaaacctgagtgttctcccttcacttctagcgacaagtaacacatcccctgtcttgccatgaaaagagctktaactgtagcagccggtggcaggttttctgttcccaggtggggaagtgaggagagacaaacagaggggtgagagggagacagaaggaagacagctggtaagagaccctatggtgtattttttctatgtaaacaagataaaaactgctcctcctggaacagcaaagttctccctatgtctccaagctacaaacttgcatgctagctactaactagctactctccctctctctctctcttcccccttcgctctttctctctgtgtgtatgtctctctctctctctgtctcttcctccaccctctctcactatctgtctctctaccctccccatccttttattctagaggagaataaactctaaggccagattgaatgagcatccaaaagamgtatctggagggagattttgtctttcctgtgagcagcagcagcttcctacggaccctgctggagccccagctcggatcagcccttctgacagcaatgaatgcttcgtgctgcctgccctctgttcagccaacactgcctaatggctcggagcacctccaagcccctttcttcagcaaccagagcagcagcgccttctgtgagcaggtcttcatcaagcccgagrttttcctgtctctgggcatcgtcagtckgctggaaaacatcctggttatcctggccgtggtcaggaacggcaacctgcactccccgatgtacttctttctctgcagcctggcggtggccgacatgctggtaagtgtgtccaatgccctggagaccatcatgatcgccatcgtccacagcgactacctgaccttcgaggaccagtttatccagcacatggacaacatcttcgactccatgatctgcatctccctggtggcctccatctgcaacctcctggccatcgccgtcgacaggtacgtcaccawcttttacgcgctccgctaccacagcatcatgaccgtgaggaaggccctcaccttgatcgtggccatctgggtctgctgcggcgtctgtggcgtggtgttcatcgtctactcggagagcaaaatggtcattgtgtgcctcatcaccatgttcttcgccatgatgctcctcatgggcaccctctacgtgcacatgttcytctttgcgcggctgcacgtcaagmgcatagcagcactgccacctgccgacggggtggccccacagcaacactcatgcatgaagggggcagtcaccatcaccattctcctgggcgtgttcatcttctgctgggcccccttcttcctccacctggtcctcatcatcacctgccccaccaacccctactgcatctgctacactgcccacttcaacacctacctggtcctcatcatgtgcaactccgtcatcgacccactcatctacgctttccggagcctggaattgcgcaacacctttagggagattctctgtggctgcaacggcatgaacttgggataggatgcagggccatggaaatgatcatcagtcgggtcacttttgactttccatccacgtgaggtgtttagaaagaaaaatatatatacttagaaaatataaaaatgtgttaacagccatgattgtacttgtcgtttgtttttaagtttacaaagccttttaaaggggaaaattggtgaacaacagattctctgaaaggattccaagatgggtaagtcacaaactctgatttcccaaatagtcactgggagaaatcagcgaaggcttctctgcatgctctctgcactcatttccaaacacccagggtgtgcgacgcctgtctgctcatctgctccacacccacgtcttcatgctccaggccagaccagactgaaggattctcatgaacaataagggtggttcagatctcttgcaagcaaacctgttacagctacgacctcctgctgccagctacacggagagatagctttgcacttataactccgtaggagactgagttctactctattattctatttacagttagacaattgtctctttgtgaaaggagcaatgctatgccgttttccccttttcttacccccatatcccttcagttgtccccacccccaaaggtagcatgaggatgtaacccacttctatttttctgttgttgtgttggtgtgtgttgttgttttgtttttatggattaaatctaagacaaccttcaaaactctaacgaaagagagaaagtgctttggacaatcagaatatacttgtgtacgtgtattttgataccttgctattttaaggtatagattaatctttttaaaataacttctttttttctatcatttacttttagcctttaaaacaagaaaggaaatcatgggttggggtacatgtatatacgtgtgtgtgtgtgtgtgtgtgtgtgtgtgtgtatcacaagaaattgctttactgtagcttaagatagtttgagaaaccgtagaaccactgtgtgactttcttgggagcccttgtttttgcttatagtaattgcatctctatcacaggacttcttcaatattatctatgaaagagaaagtttttttgttcttttccctttttgcttggcattgtgttaaagttgagtgaccctgttatcaatgtctatatcctatcaagtacaggaattcattcctgggagcaaagggtgagactggctgactagtgctcgcattgtcagatccttttctgcccaagataacttcaatttgtgctttctggctgtccccatatctccccctgtcacaaattcttatattaagctgtgtcttggggtgcaattgtgtgtttatcttgcactagcatatactggggttctttaatacttgaagattttctgctaatataagcaaaaccattcctttcttgctttggttatgatgtttggaaataataaaaagcttttatggctgctaaacgtgtgttacattgaaatacaccctggaatcattctggtgactcctgcacacggccatggtatgtttcactgcaattcagtgatgactttgtaagtggcataaacagctccattgatcacagtgctagtcttttctagggcaatgccttttagccaaactacaaaactctcccatttagtttccaaaaataccaggtttgtggttcccgggccactgtcgttctccattattttaatcaagacactaaattacaggactttccatggccgctcagtgggtaaatgtagagaatggggaatctaattacttgaaagtgatatgaatagctatagggattatgtcttttttctatgtaaacaagataaaaataacttacttttcactcttatatcagttttcacactatttcattttatcccattagcaaacctctaaaataggtgagtcattttacaaatgaagaaatttagccttggaggggtgatatggttgtccaggagcacccacctagttagggtcatggtatattctgcatcctggggctgatgtccttttgcaccaatatgctgctgccagcaggttttcatcatcaaaactagtccccctctcctccctgtatgttttagcttgcaggggcacttccaaactggaaggcccacgagcatcacctgggatcctgtgcaagtgcagaatctgattcggcaggtccaaggtagggactaagagtctgcatttctaactccgacaagctcctcggggacgtggctgctggttgggggtccccatcttaaagagcaagggcatagaggattttcaaatgagtattatgcgaagtaaaagtactcttctgcctagaatgctgaccccacgccagggactgtgctaagcacttcacaggcatttgctccttgtgataaccctaccaggtagataccatggttatcctgattttgcagatgagctatgtgaaactcggagaggttaaggagcttgtctataggaactcggccagcaagtagagatagggagattcaggctggccagcccccacccccaaatccaaccagtgtcctagcccctctcatgatgacacaggaacctttgaactgggacccaatgacttgggagccacgtgtcgccatgcagagagaacttgatgcatgtttctaccacacacaggtccagatgttcccagcagagtttccagagagatgtcataaaaatcaaaaggcacaattaattctttaacttgctataaattttccaaagtctgtgagtagccctggggagtgcatcaaagaggtaagttactaaagcatccgtttccctagtgaacaaccctgaacgctggggtgccactgtctcctccgcgaccactttctcagattctcaagtgggaactcaccagatgttttaagcggcaggacagtcatgtttgaaaatgcttaattgttggaagtaaaagcacaccatgattttagctcatctgttaattcatttatcgattttcacccccatccccaaggcagaatccctgcagtacttgattctctgagtcctgagaagttgttgcctgttgtccttatttaagatgaacttttgaatttaattttgaaatctttctatagaggctgggtgctaaaacatacgctagcctctctggctgaaaacattttttaattcacgctcacctccactaaaatccattctccacatagcagctagtgcaattatttaaaaatataaatcagattatattacacttctgctcaaaactcttcagtgtctcccattaccttttgaataaaagcccagttccttacccagccctgctaaactctagtcatctgatctcttctgctaactctccagcctccccttacaccatgcctctgccccgccccaaaccagactcgcatttgccatatgctcctctctgccccagggcctttgcaaccactgttccccctgcctcgggtctctacctcagatcttcctggcacatgctccttcttatcagcctccagcccaaatcctcagagatgccttccctgactgcgctctctaaaggaggacctcagtcactcacaccatcactgttttatcacagctcttattactattttatattttcttgttaatttatttgattaattctcatcaatctctctcaccagaaagtagtgcctaggagataaaaatagtcaataaaaatatgtgactttattaacacatttaaatatgagctcaaatctaaccaaagagaatatagcacactggagattctcaaattttggtgactgtcagcaccatgtgaagtttgagaaagacagcctgttccctgaatctcatgatccaatagatcagaggtcatctccagatatctgaaaattttaaaatccacaggtgattttccgagtttggtatacacggtgtatgatgtacaccaaactcagaaaaccaccaaaaccaacaagttctgattattatccttaaagaataacaaaaatcaacacctcaggagcttacatgtctgccctatcaccccttcctgtcatcctttcaggtcggggtgtcacctaccttaaattaatgttggatcatccaaaaaccaaggcaaatctagaaacttggaagaaccagataacgaaatgcagaatacaagataaacccttcaatcagagaactcaacctttcatatctaagagcatttatttaggagccaaatcaacaaaaataataacaaaagacatgatatggtgtttattatgtggctgatactttactaagcacctaggtatattaacttatttaatcctcgccaaaaccccgtaaggcaggcacttttacctcttgtcctatagataaggaatctgtggatcacagacgtgaatcatcttgactgtcttgaccgatactactcagcagggatgaggcagagctgagatgattggaaaatgaccactaacgctacaggcttaaagaagcacttacacattgaatccacttttctttaatcatcagagatgtggataaaaaccaacacacaaggacacccaaggcggtagtgccagcaagggaaaaaaaggctttggaggaggagccaggcagcgctgggtgtgcatccttaggcaagtctcttgacctctgggcacctcattggcttatctgcaaggtgggagctccacctacttacatggcagcaagcagctgtgatgattcagtgaagtataacaatgtccaaaaataattagcacgtgaacttcacgtcccctttccccttcgcttgctggactctagacatttctgaagttgcctgcagttttcctgcccctcgtctctgaggttcctgaaaacagcagttattaatgaggggaaggagaggagaaggtgaaagtttagcctaatgtttctacaagtacaaagtgaattccacgggaggcatacaagatggtttgtgatgagtacacatatcaacacgtgcccacttttttttcacagaataactttccaagtaaacaacaatttgaatattttaaagtgtattaacataatatgtatgtctgaatgtatattatattgtttataaaactcatgatttttaaaatagtattgctaaacatgagacttgagtggtacctgcaaagaaagaagtgagttgactaggataaaattaaataaagccggcgatgtggctcacacctgtaatcccagcaccttggaaggctgaggtgggtggattacctgaggccaggagttcgagaccagcctagccaacatggtgaaaccccgtctctactaaaaaacacaaaaacttgctgggtatggtggagcacgcctgtaatctcagcaccttgggaggctgaggtgggtggattacttgaggccaggagttcgagaccagcctagccaacatggtgaaaccctgtctctactaaaaaatacaaaaattagctgggcacggtggagcatgcytgtaatctcagctactcaggagactgaggcacaagaatcacttgaacccaggaggcagaggttgcagtgagtcaagatcgcaccactgcactccagcctgggcaatagagcaagactgtctccaaaggaaaaaaaaaattaaattaatgggatacaggcattttaaaattcagaataggaatgtttgaaaaattgaagtttgagaaaacctatgctcaaaataaaaccattagaggagagggggagtaaggcccagaaataaggcaggagaggagaggaagtcaagaataccactgagactgggccaagaaagaagctgccatccatgtgatgggtccacagagaaggatagatcgagtcaggattctcaagcagtttggctgtgcaattggcaygtattctctgaccccttggcattctctggagagaatgcactaaatattttcactgcatttcacctgagtttctcagcctcaacatcactgacatttggaagcagctcattctctgttgtaggaggctgtcctgtgctgttagcatgtttagtagcatctccggcctctacccatgagatgccag

SEQ ID NO: 17572 - DNA, 39320 bp, Homo sapiens
  misc_feature (1)...(39320): n = A,T,C or G, or insertion/deletion polymorphism (see Tables 1-2)
gcttcagtcacactgaagaactgcagttctccttgcaacttcatgcctctctgctcctgagcctgcttctcctgctggaaatgccatttcccctttctctgttttgctatctgcaggtgaacactgtccctaggaacctttcctaaatcgtattttaattttgctcctgagtagctcttgtgtataccttgtgatactcagtggtgatcaaaccacacatgtagcaatcatcttttctttgtctgttttattcttgaatttcaagtagattaaggacaaagttcccatctttagagtttcatccttattacctagagagtgaaagttcacaaaaagcatttattaactgaatgaaaattaacatttgaagtgtggaatttgcttcaaaatgtgccaacctttagttttcagattttgtaaatataataaatacaaagtaacctaagctgaaccaattacatctgtgtagcccagtctatacaccatgtatttttctttttcctttgggattcatttctgtaggtgagtaatcctctagaccctaaactcagtgggggaccctcaccatccgtgtgcggcactgaacctgctgtcacactatgcatctaagtagaggactggttctccccatgctgggctgggaggggaaatcctcacttagggaccaccaaccatgcagtgtcatttggcttcacttcctcttccaggccgaaccctaaactctctgtaattcactgtaataataattcactttttgttatcaaccagttgctgcttcttatgtatcaggtaaagctaagatactatcccataggtctttcaaatgccaacaacttgtatttccaggtgaaactacacttgaaaactacactccacaagacaattttgtgaatgttatgtgaatgataatacttttaaatttactctgcctaaaatgtaagtgttgtggataaaattatagaaggtatcatttttcttctaaaagtaagaatgtaacttgaagtctataaatgtcactaagactctggaggtattttcatgtccttcacgattttgttccactctgaaatatttattccatccttccacttccctgccttgctttatggctatatcagtaatttttaatgtattgtcctgtagggtttctgagatcctacaggaatgaggtaggaggactactcaatattgtttctaccaggagttgtgtgacttggacaagttactttacctctggggtcagttccctactatggaaaataagttcttctacatgggggtgtgaagattcaatgagtaagtttagcacatagtaagtgcccaataaatattatcttactgtattcagcattaccattatcatagacggatgttaagtcttcagggacaagggaaacaacctatatcgtccatgggtcatttctgtctttgtttcttctcactccttttcttttctttcatttgcatttctcattttctgtgttattccttcatgttcccaataaccttcctgttacctgtttgcttcctgcattctgtgtagcatcctacgtattcacccattctccatcttctccttcatgcagcagaccatgtgtcaacatatgcggagtttgtgcagacgcacagamcctctggggagtatatgtttgaatttgatgaggaggagcagttctacgtgaacctggatgagaaggagatggtctggcctctaccagagtttattcacacctttgactttggtgctcagaggggtattgctggcatcgtcatggcaaggaagcacttgaacacccrgatcaatggtccaaacagacttgggccacaaatggcactgcctatagctgcctgttcctctcagaggggtattgctggcatcgtcatggcaaggaagcacttgaacacccggatcaatggtccaaacagacttgggccacaaatggcactgcctatagctgcctgttcctctagagtccagctggagggatgggagggcctctctgccacacatagaactagaggccatgatgcccactcatgaatgagccccttccctgagagcgagaaatcttgggtccacacagctgggttcttaggacagcagaggaggaggcattttcttcttactcaagagaaaggctgggctgagggggccaggtcaggagcacgagaagctgtgaccctgtccaggagccctaggggagcaggaggatgggcctgggagaggtggcccctaatctggtgaatataggacttggggtggtggaacctttaagaatcagccaatggcagtaggctccttgggttctatccccttttggagcccccaccgaggtaagcgtctttcccaaggagcctgtggatctgggccagcccaacaccctcgtctgccatgttgacaagttcttcccaccagtgctgaacatcacgtggctgygcaatggggagccagtcattgagggtattgcagagaccatcttcctgcccagcaagaaactcagattacacaggttccactatctgaccctcgttcccatggccgaggacacctgtgacctccagggggagcactggggcctgcaccagcctctcctcaggcactggggtatggagcgccctccctctgccctcacggccttggcaccacctttatttcctgggcccatcgcccctcagcacctgccttcctcaatcccatgttttatggtcactttatccaaatttcaccatctcatggtttcgaatacccaacacctcccacatccaaggccagcccctgctctctgtaccttataactctgtcttcccttggtgccccagaggtccatgaactaatccaggtgcctgagaccatggagatgctggtctgtgccctcggcctgctggtgggcctggcgggggtccttaatggcaccattgtctcaaagaccaagcgatctgacagcatccccgggtccaggggctcctatgagtcatcctataggtgtattagggacagagtggaaaagacgaggtaacaagttaggggtgaagagtgggaaagagaaacacttcaccaggggctctttgagcattactnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgcactgcatccttccttagaaatcccagagtttcataaacacctgcatatgtcagagtgagacacatctgataccttctttctgtgactccagggacattcctcatctcctgacaccctcagttccctaggagcacatatcctgttcctgtaatgtgggtgcagatacctcagcttctgatcctgacaagtgttagtccagagattgttcactccactcggggtactgccctaacctgtaacatgagtacaggagacaagcaggaaagagaatgactctgactggatatggtttgtaatttgtaatgttaactgctcagtgactctgagggtaggatttatgtgctctgggtctgaggatttcataatgatctcgatttgaagactttctgctattctcatgacctccttccatcgttgaatccctggattgaaatcatattaattttatgctgcataggtttctcacaagtttcctgtgaagccaaaagggaaaataagacagataaagggtccttatttactatatactgtcttccttagcttattatgtgacagctgaaattactacgcaaaaacaagtcagcagcattttcctttatagtttttgaggaaatgaggctgatcagggataaagatgttttaaaaagaaaaaatgattgtgtcctattccctaggttaagaagattatgagaaacatgattggttgtccttgtgtgtggcttctctttcctgactccctgactcagtccagcctctctgcagactccagctgtatttacttatatctgtgccagtgacgcccaagtctgtgccttcagccccacctctcctgaaattggaggaagccggtcccccgatggaagatattatttgcaaggggagatgggcaagaggagcacagtagctttcgggaattgaccagggacaggtgcccagggacacacaaggcccagaagatgcttgtaagaagccagggagactgaaggcatcaactggatgtataagagagctgctgtgcactgattgtgtgtatcaggagtgaagaatccatcctctacacgaaaaagaaagcttacaacaaacatgtcctctaccttgaccaaaaggtgtcaatatgagacgcaaaacacataacaatgttggattgttaagaaaaaaaaaaagaccagtgtttgaaaaagagtgctacatgtattgctttgctctttccccagtggggagtcatttctgtctgtatgaaaattaagacaggaggcctaggctggtggatgaatgcagacttagacgacaaatgacgtctattggatgcattcaaaagtccaagccgtatttggttaaggagtatttgtgatggcacacaaagaaaatggttaaagtgtattagattatatttatgattttaaattctgatgttcatttaacttcttaatggtaatgataaaacatgctctcagtaaggtatatgttgaattagtgctgtgggaatatgggtcctatcaggcagatttgcagtctgctcaccattgaatagttaagaatagtggtctgagacataaatggatgagggcactaaacttgatttgggggcagctcactgaaatacagtcaattcagaagagtgtcatgtgtaacaggccccattatacaatagttaacatatccccattttcatggttctcttctttcctatgtttaaaccaaaatgaacttctttattaactcctactgtctactaaaaccctcagagaaaagtgatgagagatgatttggtgcatatttttaaaggaaaacaaacastyatgttgggttttgattatttgtggtgctaagaagaagggaacatggttggaggcccagtgagagaaacagtgctttgaatcaaagagcagaaygatagaaactgacttcagagcaacttcttggcagcagtatccwmttkggaagytgarggtctgtcctggarccagrtgytaacraaacacagcaaatgcttttcctaaggcacawtagtcttttcrgtgagstcaggaaccctgtgggggtaaaagacaagttatcccaggttgccagcctccttcctgtaagtccaggagagaaaaattatggtgagaggatgcgtctcaggctgataaataacagagttgatctctgcttccttcagcaatggagccaagcaatgctctttccccacttgcctgaaggctgacattgaaagaggggttcatgcctgagattcccttcctggaggagcctcagtgttacaatgcacagaaaggactcatatcctcctgcaacccaccccacaaggaaatcaaagcaggaatattacctgtttatgcagatcctcgttgaactgaaatgaaagacgaaaggttatataatcagccattgaaaccacctcagataattagagaaacatttccatcccaccaaattccattgcccatcactcaatggacgctccgcaggagcctgagtacttgggacctcatgcatctggctgcattaagatcccagcctgggatccchctctcgcyataggtcatgtttgttccccgaytatctgatwtcagtggcctctagagctttctgacatttcttttctgtcwracccctcatcgtggaataagtgtgaatatgccaggggaaggtaagtcccgctcaccctgcaggctttctcacctttcttgctcctcctgtgcatgaagatgcccactccacagatgatgagccccagcacgaagcccccagctcccgtcaatgtcttactccgggcagaatcagactgtgcctctgggaaggacagacccaggtttagtgtcacctccaccagctgcatccctactcatgtcctgtctgagattctggagcctgatgcagcatatcgggatgaggacagtgcagcggaaaaagcttgctaagaggaaattcagaaagagccaccctcatatctggaacaggggtgtgacctcaacaaggtggcaaatgctgattctggaagttgcctctcaaaatgcctgagaagaggctaaaatgctgaaggaagagaactgttcctatgtgtgaggtcagttcctaagtgtgagggtttcgagaccagtcagtgtccctagattctctgacaagggggagaactatgaatcttcaggaacccctaagccaaggnnnnnnnnnnnnnnnnnnnnattaacaaatgtaatgagaaatgacattcattgagttgcttactatgttctaggcactattctaagtgcttctcatgtgttcacttatttacatctggaggttggttcttatttatttcatgttacagagcrggaatcagacaccgggagaggtgaagaccacacagcttcaaagtgcaaagcttggatttaaacccaggctttgggcctgcagtggctgcagtcttgtccagtatttagattatttcatctgcagtcactatctgtcttcctacattttacacagccttaattttcttctgcccgcagagtgatgttcagaacttccaatgctatgttaaacatttccagcaacgaaggacatcctatcttttgcacaatctcaaaggcaatccacctcatttctttgaaatatatatgctatagatttttggttcactacctttaacatgtcatgaaattgattaaattctgtctatgtcttgagctgaattcagtttaaattaatatgaattttgcrgagtccactaatgtgttaaccacattatatattttctgacactgaagaatcattgcattcctagaataaatctaaaattggtcaaaacgtattgtttttrtaatgtactgttggattcagtgacatggctaaaattagtccacaatcctgttctcytgtactattcttagctggctctggaaatayaaatgaaccaacctcataaaatgatctcaaaaattctgttccattctatgttctagaatcacacgtgtaagaggcatgatctgctcctggaaatgtgggaggacrccctcatctgcaataagatcaggacagggccctttggaaggcgattctttgcttcccatgacaatttctttgatattctctactctattttagttttctatttcttcctgtagttttgacctttatatctttctagaaacgtatcckttttatctaaattttcaaatttatatgtatagagttggtcgtaagattttgcattttaaaatgtgtataaatgtcatttacccttttcgttctgaatctcctgtattttccttaggagtcttgccagaggtctcattaaagttttcattgcctcaaaatttgattttrtcttctctatttttatatttcattgaattcagcttttgtccttattatttacatgtattttctttttgctgtttttctgcttttccatcctcttaattcacataattagctcatttgtttacagtcattttactctaacaaaattgtttaacartctgacattctatgcagcattttgaatgaacttatttcatctttctataaagactaaacatctattatgttttcagttatttcctcttcctccactatttccctgactttctagacgtctaattattaagatgtcagatgtctgtttctatccttcatttctcttcacttgtcctttacattttctattgtttactcgatcatattgtccttgggacagtttctcagtttggctttttgtttattaattacacttcagttgcaaaagtcctatttcttrtctcatttattatgtttcttattccaatctttatcaaagctcaatatttgtgcttgattcagtggcttcttgcttttgcttcaaattcccaaattctcctttacttctctatttaagccctttytattgtgaactaggggacatttggaagaaacacacaaaccaatagaatgtaygttgaatggttatcaccgcaagcacccatgtaactagtacccgggtgaagaaatagactgttgccagcatccctgtgcccctccttaggccaggaggtagtgtgtaagcttttcaggagccaaaggctgctgatatccataatgcctagcattgctcctggtacacagtaggtcctccataaatatctcttgtagaagtattttattatttatttagtgtgtacttcttaaatgttttccaccttcaagtattcccacttatttgaagttagttgcagccatatgatttacattggaaaatgaaatgcgagaagtgtgttctttctaggagggatcattaaaagccagtgaataaattcttaggttcccttcattctgctggggaggttctgggagcagatgtgcaggagaaagmctgtcagcctgrcttcctgagtacgatgatragcagagcttcctgsatgacttactttggacgtgtarcatgagccaaacctggatatctgggtatttgttagtttagcacagctgatcctattcttactgtgtaaaagaaattgaagagaaggtgctcaatgagacttcagagaagctgagagacaagagaactaggaggatgtttcatcccataagccaagtgcacaggaatttcagggacagtttacaatgcaacatgctcaaaaggcatcaactatgrtaagtgttcactggcctggtagcaagtggttattaaaacccctttaaagagcatcttcacacccaatgcccaactcccacctccttccactttcaccatcccctggctcggcctcactgctacttgacaaatggggacaaagagagggtgagatgatttcttcttagggtaccccttgataaccatctgaggcagygttgtctgttgggtggaccaccttctcgttagggaactgtgaggggtagaaaatgaagggaccaggtggaaagggatggaggatacaacactcagctgggagtcctaagcccgccgggttttttcttctgcaggtatcaatttttctgagtcagaggttgagtcacccacttcacatctcctttaaagctccagttccaactttcctttgaatctctgctcttcaactccaatgactgatgtacctcaagactcctctacctcctggctgcctttgatcctgctgcacatagcactcagcaaagggcctgactcttagaaaacactctatmaatattgaaaatttgaagtctagtgacaaggtggtcccagtttggatggtctctcagctcytgtctcctctgggacctgtctctgcactgcatccttccttagaaatcccagagtttcataaacacctgcatatgtcagagtgagacacatctgataccttctttctgtgactccagggacwttcctcatctcctgacaccctcagttccctaggagcacatatcctgttcctgtaatgtgggtgcagatacctcagcttctgatcctgacaagsmttagtccagagattgttcactccactcggggtactgccctaacctgtaacatgagtacaggagacaagcaggaaagagaatgactctgactggatatggtttgtaatttgtaatgttaactgctcagtgactctgagggtaggatttatgtgctctgggtctgaggatttcataatgatctcgatttgaagactttctgctattctcatgacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccgctcaccctgcaggcttttctcacctttcttgctcctcctgtgcatgaagatgcccactccacagatgatgagccccagcacgaagcccccagctcccgtcaatgtcttactccgggcagaatcagactgtgcctctgggaaggacagacccaggtttagtgtcacctccaccagctgcatccctactcatgtcctgtctgagattctggagcctgatgcagmatatcgggatgaggacagtgcagcggaaaaagcttgctaagaggaaattcagaaagagccaccctcatatctggaacaggggtgtgacctcaacaaggtggcaaatgctgattctggaagttgcctctcaaaatgcctgagaagaggctaaaatgctgaaggaagagaactgttcctatgtgtgaggtcagttcctaagtgtgagggtttcgagaccagtcagtgtccctagattctctgacaagggggagaactatgaatcttcaggaaccccyaagccaaggtcaggaagtctccattkccctggcttcaaactatgctcaggagctggtatagaagaaagatggggtttggacatggccccagggtatagatgcagaagataagatgagtggaccccagagccagagagtcccctgctcttcagaggtggggtctagabggtcatcagagactcactccactccacggtgacaggactrtccakgctggtgtgctccacttggcagrtgtagacrtctccctgctggggggtcatttccagcatcwccaggatctggaaggtccagtctccattacggatcaggttggtggacacgaccccagctgtttcctcctgtccattcaggaascatcggacttgaatgctgyctgggtagaaatcygtcacgtggyagacaagcaggttgtggtgctgcargggcyccttcttggagggggaaacrttcaccytaggctggactaggagcgtggaagaaaaataatgaaatagaatttgagattgtccttctttccttccttccttccttccttccttccttccttccttccttccttccttttttttgagacataatctcgctctttctttctttcattctttctttttgttgagatggagtgtcactctgttgccaagtctggaatgcagtggcgcaatattggctcactgcaacctccacctccgggcttcaaccaattctccttcctcagcctcccgaatagctgggattataggtgcctgccacttcacctggctaatttttgtattattagtagagacaaggtttctccatgttggtcagsctggttctctaggagcacttgaccaacgcctgacctcaagtgatccacccgctcggcctctcaaagggctgggattacgggcctgagccactgcatctgcccagattattatttcttaggcatgttcactatgtaattgattcctagatgttgaaaataggaataatgtgattaggctagtgggtaagggtagcattgaaaagatagaaatagaccttcaagtagagcatgcatgatcttgaataaaataatagttagtaagtatatagcggaatggcagggagacagagtttgcactctgtagcacatttaggagaaattttaaccaaaagtaatttgggcaaagaatatttgatcaactgtgaaattacctaccttttcaaagttctatcttgatacaaaggaagcaaaatttactcaaataatatcttgaaattaagatatacagacaatggcattatggtggcctgtgaatctaataacttcatgaaaatacaaagaaaatgaagagagctttacatgtcttattctgtaaaaaacctatgtatttttttacctcacctacaaaaactcaaaatcttcatatttacagaatatcctgagctcctacatgcttgagtagtagaaatcccgtcctttttcaagttcctcctctgtgctgcgtcttcaggtcccatgaaggtctcacagatgaccaggtgttgcctccctctgcatctttgcatttgtgccccagcttgtcctgttgttctcaggtgaatttccacactgccactggcaacttttcttttggatctctgccaccagtacctttttcctcctcagaaagcagaaaaggccaggcatggtggtcatgcctataatcttagcactttgggaggttgaggcatgaggatcacttgagcccagggttttgagaccggcctgggcaacatagtgagaacccatctctaaaaagaaaaataaattagccagacatggtggtacgtgtatctgtagttctagctacatgggaggctgaggcaggaggatcacttgagcccaggaggttgaggctgcagtgagccatgatggtgccacagcactccagcctgggagacaaagtgagaacctgtctcaaaaacaaacacaaacacaaaacaaaaaacaaacacagaaaagggtcaagtgctcctagagaacagttcattcagggagatccactagagaacagctctttcagaggactaccctagagaacagctcatcaagaggaatgtctcaaattagtcttctaggtccctaatcactcagttctttcctttctacttcctggagaacacaaataccctaacatggcgctgggccaggtaaaagtacagtcttgaactgacacacaacccttactccctattgtatttttgccttgttttcagactgatccacattgtcagcctcttccctcaatgtgagtttatttcaggggcacctgtgtctcactacttcattacctcggttaactcaatgtccattacactattcaacttatgtctaaatctcagttgtgaattacctacaatttcttccccatagagcttctgggaaccatgaaatcagggggaatacttgggtatctgttttaaggtcccagaacattccaygagaggcatcttgctcaatattctttgacaggagcaggtcagcctggagccacatcagygacctccagggkgcgctggagttaaggcytgatacccaatggcctcatttctgacccagttcaaatacatttcaccaaggcaaggattcctgtttgttctagttgccttctctaatgcccagaaaacatttgctcaattacttctagatttgggtggacatccaccctggaattgtcactacttctttcctcccccttccacctctcccttgcctctgtgttttccctgttctaactcatgccttgattgcaatttccctgacaaataatagcagtttcctacctcatctccctgcctctggtccctcctctagccagcacccttagtagtcttctgaagacacatctccaaccttctctttttcatttttcaaaaatcttcagtgttctgacaatacttatctggctacatgggaacctctagggagctgattacaagcagagatccccagacctccccacccagggaatctgagtctgggggcactgagtctggagatctgtgcatcacagaggatctccagaagagtcttcagaggagtgaggttggggacctgcgggcctggaggagaaacccacactccttaggctggcatcagggctgtctgcaatctggcagttgattactgtgaaagaaaatgctgccatgtcactgattggtgcctctacaaagtcttagtaacagtttttgccaattgcgttatttttatttgaacacctctctcaaccaattacctcagcaactttcctaagctcatgtcactcacctcatccccacccagtgtgtccaccttctcactcatagcaggtgaacttcctttcactttccaggaacaagaaaatcaaaggtgtgatctccccagcttcctcctcctcctcccttcatttttttcctctttctagaaaaaaggtccagggctcaatcccacatcctgatactactccctcargtccctcaggttggtgcaccaggctccccaccccacaagttcacaggaggaagccaaagctccaaggccttcctgtcccatccttgagaaatcctcttactgcacacacctcacctctctccatccctttacacccagacttcctgaaggaaaaagaygaatgaactsagacactgccctgtgmcagccgtggggaacccaagacaagtaaaatccatctcagccccgaggaggatgcgccacactcagcctcatgcaccccctcccattccagctcctgccgctgcggccaacctgctctccccaggtctccctggtttccaaacccactttccatcttctgttttctgaccttcccaagtcactggcaccgctgtccactgtgctgctgaggtcacctcccctcagcttccaagactcttctctgcgggcctctcctcacactgcacttgggttttwttggtctctttcacaggcttttctgtcttggccaaatcacaactgtccagttcccaggatccrgtcctttgctcttccccctgggtccyctctccctggatggtctcatgtatcycagtctcctccccggctgcagacccttctgtctacctgcccatcagaccacccatctgcccctcaagcacctcaaacccagctacctccctgtaggtttcttctctgtgtggcctgctgtgccatctccacctccatctccacaccatacccttgtgcgctgtcctgtggcttccttttttcaccccacatgcagtcagctgccaggcctgatgaagtcccgggggtctctctgctctcgtcctcctcactccatgctcagcccagtccaggtccccgcgctcgctcccctgacaagctccagatgggctccccccatgaatccccaacccaaagtcccctttccgcccggcactaaggtcccttaggccaacccggctgctcctgcgccctgggcacgggcccrcggggctgccctgggaccsccggcccaaagccctcactcacctcggcgctgcagggtcaysgscycghccagctcgtagttgtgtctgcayaycctgtccggcactgcccgcyyctcctccaggakgtccttctggctgttccagtastcckcakcaggccgccccagctccgtcaccgcccggaactcycccacgtcgctgtcgaagcgcrcgwrctcctsccggttgtagatgtatctctccaggaagcgctgtgtcccattaaacgcgtagcattcctgccgtmmctggwamasgtaattctctgcggggagggggcggacatgagcggaggcgccactctcatctaatcctctttctccctctctctctyaatattaasgattcttcccaaatctwcccacycagggctrgattttaaaataggagttttcctagtaycgagttctgtggtcctaagcgggtcgcagagcctctccaggcctgttttctcaccaygcagagagagaatttactgaaaagaatgagctcaggggcactgagtgatcactagggaggggcgagcactgaggggaaggcagtcccttctgctggtggctggaggaggcggagacgtttcacktggggtcactgggagaaaaaacaggggcgggaggagctggggacgtggagggcggagctgctccccctacttaactccctgactgacatttccatcctgatgtcagtcctggttcaaatgccacctcctccaggaagccctcccttccttctytctcttttccatagctaagcgctctctcttctcgaccagtttcttgagaattcctcaacttgctcctgttgttttgcatktaggaratgtagaaatatatttcttaaaactttcttcaactttggtataagaaagactctgtagcctgaaagttaattttcaaacatggctgcagaaagacttggtgtcaaaagatgtggraagtattttacacaatgaaaatcaccacaacaaccagggacctgtgggggtagagtcctttgggtttagaggcattgatgtaattttttttggcagtttttatggttttatttacacacaaaacgtggacatgaactttctactcattttcttagctgtgcaccstggtactggggttggtgactctgatggccggctgggtgactctttccatgatgactttgcagttctggaggaaattttgtgagcgatctcagcacagtaagatttgttgcacatcagcagcactttcagctccttgaggctgtggaccagaaacttctggaagccactgggcagcatgtkttttttgttgttgttgttgctcccataagcaatgttgggcatcaagatctggcccttggaccttctacgaaccctactgttaagacctctgggtttccgccagttatgcttaattttgacatttcagtctgattggtgcctcatgaacttgttggtcctctttttgaggatcttatccttcatgaggagtctgagggaggccatgatgtggaggaagagatggctgccagctgcataggcagcaccgaggaagacagcattgatgtaatttttacatgaacaattttggcagcctttcccacatgctgttcttcctagggagtgccatgagcagtgtctggcaggtgtgtgtctacacagaattatcagtgacacggcacatgtttgtttctgtttgagtrtcttcaggcctgctctgttcttgggcacactggggaaattaaggtgctgtgattgttctgctcatctgtttcatgctccacaaattaacttctccagtttattaacctcacccctwgcagaagttgcacagctggtggcagaggatagtggagatggggtagggctgggctcaagggcaccatggagtccacctttagtctccagtgtcattgctaaggcaagatcccaggtcttgactcagatatcctgacctgcctcttctcctggtgcsttgggcsccagaccctraaattccaggcccagrgccccccagctccttgagtccagattcctcctcctctgccatccatccgcccctgcctgttcarttgccccactctgagtgtggattctcccattttcatttgttagtctttgtttctcctcctcaatcaccagtaagagaacgtttttcattcaagaataagaattttgaattttttctttgcaacatttaatttttttaatttacccagtcttaggtaattttttaagtacatttaacttttgaaatggaattttacctgccaagtagacataagcaatgaggggttttatggtgtaatttgaaaccttcatttttttttgtatataagaaactttatcctgtttgtggaacccttagcaattgagttgcccagagcacggtttgaaaccactgatctgaatgaattcgtctcttattcagaataggatatattaaaaacctctagctccctatgggttgtctcagccaagcttttctcccccagcctctttaagctatagcctggctcctcagccctttggtcttgtgccctgtttgaggttggggatgtgtgtggagttgggggagcatgcagggaattgtggaatcagccctgcccactttacccactcccctatggctccagctctccctccagcarrttttgattgaacattcattctacgcagggagctccagtaatctaccctcagtccctgtcacatggctccactgcctcatctcattccccctacaaacctcaacccagcctttgccygtcctccctttcactgyccagcatcacatgcycccttctgctctctgctcccccacctctgggtttccttggtggctcccaacactgtccctcatcccacatgacagctctgcctatgggatggggrygcygcatccgtcacytcctcctgacactgttcagtgtcaccagtgctgctccagcctcctctctccccagcctcacccctctgcagttcccagggctgagccgtcctgctggttagttctcagcacccttctgtgactayaagttcaagttctcctccccttcctggacaatgaacccaaggtaatagataagaggttttagggcttgaggggctgtattcaggagattccaaccttgctaccctgaaagatgaggaggtgacatgatgtcagtaccttytaggtgtgtcctaggaggggtgtggagaggtctaggaggaagggtgtaagcaggaaargtggaagtcagtggaaaactaaggtacctactttgcagtccttcctctcagagtgttggtgtaaatttggactagaaatgtcctgagagtacaatggttgaactagtttacagtcccaccaacagagtaaaagtgttcctatttctccacatcctctccagcacctgttgtttcctgactttttaatgatcgccattttaactggtgtgagatggtatctcaagacagtgtggcaattcctcaargatctagaactagaaataccatttgacccagccatcccattactggrtatatacccaaaggattataaatcatgctgctataaagacacatgcacacatatgtttatwgcggcactattcacaatagcaaagacttggaaccaacccaactgtccatcagtgatagactggattaagaaaatgcacacatatacaccatggaatactgtgcagycataaaaaaggatgagttcatgtcctttgtagggacatggaggaagctggaaaycatcattcacagcaaactattgcaaggacaaaaaaccaaagaccacatgttctcactcataggtgggaactgaacaatgagaacacatggacacaggaaggggaacatcatacaccggggcctgttgtggggtggggggaggggggagggatagcattaggaaatatacctaatgtaaatgacgagttaatgggtgcagcacaccaacatggcacatgtatacatatgtaacaaacctgcacgttgtgcacatgtaccctagaacttaaagtatatatatatataaaaagaaatatcctgagagtatcctgagagaaaaacaatggatcatagatgccataatattacaccagccacagggaggcagcaggaagaagagatttttcacttggttactgcttccttggctgtctgataacctacactcaatccctgtcatgcacccacacaacctcatctcattcttcctacaagtcgcaacccactctagtaccctaaccaagttctggggaggctgggagaagtacctttaatgagaatgccttcaggggctaaaacctatccccctccctcccttctctccttaattgtccaagggrtgtgggctcctgctccaccctggggaataagaggcattcttcgtgagcactgaatcctcagtgatcctcagagcctggacactccagcttagggctctctgcctgagtcccctccaggctggatgcagayrtgaacacgcccaggagcctgcacttgccaacttctctctstgcaaaccttgtctgtccaaggttatccwggacctcttggtcccattttccccaaagacaagcactgaccactgggcacctctctctgtttactgtacccatgtccttggagagagaataggccagtagggtagcaagctatcctataggggatgaacctctttctctagctgggaagagaggacactgccttagggcaggagcccccgcagcctgtctcagaatttgatcccttaaagataacgtcccctaggaattgttccctgagcyagaccctccaagaatggcagytcggctcttacctggagtggccctgccctggaccacagatgtgagcagcaccatcagtaacgccgtcagagccactgtccggggggccgcagaaacctgcagaaccatcatggagctggaaaaggatggcaaaatgraaagagctgcagtcaggaaaagaaggactcgctaaagggagctcctgtttgaaatattagagaccatgaacccaagtagtcttctgtgaccctgggattggacagagtctgagaaaagaaccaatggacactgagctttgtatgagtcattgctcactaggcagaaagttagtatgaaaggtctgaaaatataaagcctgtgatgcacttaagatgacggaggaaagacagtgatactcattttaaccagtcagataagtcatgatrtttggsgagattatgcgttttctttgctctgaaggtgatctcaaatattctgctggcccatctacagggattatcatttccccaattctgccacacctcacacacccacaggacatggtctgttgtggaaaaagtgctatcttagtgtgtaaaaggtcattcagtggcatgacttagagggattagagtacccatctcagaactcaaatgaggtctgagtctgtctgtcttgcctttgtccaagggtgtgtttaagattagcacccattcatatttactttctcccagaggtctgtgagtcctgcgatgtgcaggagttaccaggttcttccacaggactgtcatcagggtcaggagggctcagtctagggaccttacactgggagcgtggacacaccacctaccctaccatgtaaatatgcagctttaacgacactgcctctcttggacttcgattccttgtcttcaatatggggatgatataacctgccttatagcaaagctcttaagatcaaatgagatcaataggtctgaaattgctttggaaaaataaagtccatagagaatataaattgactggtaaataaggaagaaagtgaaaaaaaatcatcaaagaccccacctccttcaaagcatctgattctaytttgtttagagtgaatatttttacaaactttcaaagaacattacttcttactttagacacttataaatgtgatcctgttggaccaccaattctaatttcaaaaaaaatcaaattggcatcatttctttaaatcaatattaaaatgtaaatagaaggctagcatgtaaaatgcaagagaagaaaataattatgtagtagaaggtgtctagtaggattaaggggccaggagaggattgtggagaaaaactcagtttttttagtaactgcctgggtgggacttttctccttgtcatttacctgccatagataattagacaaatacttcctcgatgtctcaggtaatttatttttacagtagacattaataatacctccctcaggtttaatatgaggtttaaatgaggtaatgcatgcaaagcactaataacagaatctctcatgtcctaatctgttagtaattattatttatgcaaggtaaggctaccacaaataagataaaatattaacgtaatatatgtacttcatcattacattaaatagtaaatgttttgtgaccttctctatgagtatcaaataaatagctcaaaaytgaaatatttaaaatgagactagaaaagtatttcttaaatatggtaaagagaatataaaataaaaaattaacattacctgtaacagaaaaacattagagaaacccttcttaaaaacaagatcaaaatatgggcgcacattgttaccacaggtaatgctgtcctgggtattcttatatgaaaatgaaataacaagactagtaatttaaagataaaaatgttattacactgtttaaataccaggaaaaatcaaatactaagaaatctgaaaaataaaaattatctagaaatttcactaacaaaggtaaccaggaatagataaacaattaaagatcaacttcattcaagttaattaaaacctctaaatagaaattataacacttctgcagaaatgattaaataaaaaggaggtatctcagggaggtggacctgaaagaaagattaattatatattttattagatagcacattcattcttaattatcagcagaatatttttgtaaaatattgacaacataacataaaacatgatttaaaatatagtgaccaaaaaacatcraagatcatctgactgtctgggatgggggtggggctcgggagaaggaacataatggaaaacatttgccgtcagaagaaggtgtracttatctttttacatctctttctctaactctgaaaatgaactgtgaactggagctctcttraccacgctggtacctaaaattctcccatctcttccccagcaccttccagcgtcctctttacccagcaacagagaatgtcagctctatgatttctctgataggtgaatcccagccatgctgattcctctccacccatttscagtgctagaggcccacagtttcagtctcatctgcctccactcggcctcagttcctyatcrctgytcctgtgctcacagtcatcaattatagacccyacarcatgcgcccwgaagacagaatgttccatatcagagctgtgatcttgagagccctctccttggctttcctgctgagtctccgaggagctggggccatcaagggtgagtgstcaggaggacgcargagcgtyggggtgagtgatggggtggttcacatcaattgytgcttcaggratcasagattttaggggctcattgatctatctggtcctcatagtctatgttccctctggccctcataataataacagcaataayagccagaatttatgagackcctgcataktttctttccccatttacatctcacaggaaycttcaatgaagataatattccattcatttagaaattattccttttatttagaaattattttgaaaaaactgaagctcaaaaagatgaataagttttccaaggttacacagcagatcaacgagccaagtttgaagtccagacccagctctgagggtcrtacactgccttccccagattcctgcacacagtgacctactaycagggccctcctatctctctgggatccccagcctctatcttttgtggctgctttacaggaactccgagctatggactctgcattaggagacgaagtgcaaagagtgtttctgtatcctccctctcttctaggaccctagggctcttcctgggtctttgtgggtggtcacaagctttcctctctcaagacagcagggttgcatggtcttgatagccttgtgattcgggttctgagagatycaggactgcaagggaggcctagacttttgatagctgcaaggactcagccagagatggaccgtagtgaatgctcctttttcctgtagctgaaatcagggagaatgacatcaagcctgtgcatgatgctgtcattccaaaatctagtgatggggaaggttagaatccataacgtacaagatgcacactggcttcagacagttttatttaagatgtgtagaataaagaggaggtcaggctgggtagaaccagaagtatctattgccctgttcgcggtcacctgagttatttytaatgttatgttataataaacaccacaataggcttctcttcatagatgcaaatactttttagtattcttggtagaaattcctaatgagctcagctgtctcttcagggcttccctgcccagtctcttaacatttaaacatgtmatttaccttaaaaacataagtgcaaaycaactgataaaaaacaaccttgccttcagtctgcatcctrtcccagagacactttctttgtgtcctcacacgtggagctaagcttctgacttgtctctggtacatccctgaggatcctctcatcttggccatcaggaacctctacagaaggtcaaattcagtgggttcttctcagtgcctctgacttgagttactaataacatttgcactataatccacttctttctgatgaactaccctgtccttatttttctcctgtttacctggatcctccttatcatcttttaaaccacctcttaactatcatgttctctcattataccctgagatctcggcaattctgatttttggcactcttcctggaaaatcttatttaacctgcacctgccactaatgactctcagttctatggcctaaattcctctcctgagaccacccataatccacaaatatctatgtattatttctccttagatgactttcaggtcttctaagtgcaatagccccacagtaaactcagtatcttctcccggtcaggctgtcttccctgagagaagtggcttttgccctgttttctgaatgcctacattgaagccatctgttccccaggaagccttccctgatgtgctgtttggtcgcatcttgtgtatacctacgtatctgcacttatccttctgaacctgctgttgtcctgtcacttgtgtttccttctgtgacttatacgygtctgcagaacaggacgtatgtattatttttatttgggtatttagcatctaacagtgtttgacatatagtagtcttttaatacatatttttgtctgaatggaaatgatattttgaagaaaaataatctgttccatagctggctgatctttggactgcagaacttgtgaaagtgttttttaaaaagcattttaaaaagtacaagggacattcatgtattaagaagatgagtttccaataactgctagaggactttgtgtctttttattttaccctctttttcctgatgagtcctttgagtcctttaaactgaggagcaagctaagtttcctagtgaaatacctataggatttgttttgtttagtttcaaataccactctttgcttggccacttactgtgtcagggagtcattctcagtgaaaaataagacacaggtcataccctctagacacttacaattacagtggcaaggagtcattctcctgtcactgtaagtggccaagcacagactgggtccccacatgtcagggctgaaaactcacagggaaatctgtgagttgggaggtgagagcagaagagtcccgtagttccttctcactctgatgcatttatcattctaaacccagactttcacatacacattcatcrttttctttcatgataatagttgcttttatcctcttatctttgctaattcttacaaactaataaagactaagaaacaaaataaattaaatcctacaggtgttccaaactcagcaataatttctagttggcctctaaaacaaaaatcaaaatataaatgtaagaaaagttyagaatgcttagtacctgtgtgatgaaataatctgtacactaaacccccaagtcatgagtttacctatacaacaaacctgcacatgtactcctgaacataaaataaatgttgaaatatttttaaaaaggaaacaaaagtttggaacaaatgccaaaataactgtactgtacttttgaatttatatgccccaaatgaaaaatattatcaacaaagctatacattctacaktttcatgttcataaactaagacagaaactttaaaactgtcaagagccctaaaatttgaaggatattttcttcttcctctcaattttgtatttttttctaccttttctataataagaaaaagaaaatgtccattcccccacccccatgactctaaaaacaattttacatctgtgtcatagaaaaattaagatcttaatgggagagaaaacctctctactagttccgccagtagccgtatgaccttagcaagttattaatatgtaacttccctgcatttccttacctgtaaaatgtatgatatgtatttgcttcatagggttattgtgacaattcagcgagtgaaatatgtaaagtatttagaaggatgcctggcacaagtaagtgctcaacaaatgttagctgtcattgttactattactattgtgtagggtcaggatgcccagactttcaaagaccaggaagcagcttgacttatcagtgataaacttttcattttgttctttgctcctttctttttataactgctcatctgctctgtattatttcctttatggtgttgctccttcttcttccccatatgtccttcctttgaccycttacyttcttcctttttatattcataagtctttattcattctctagctttsaccacttgcatattcraaytgacattttgtcrtgtttttctctactktctttatgcagcggaccatgtgtcaacttatgccrygtttgtacagacscatagamcaacaggrgagtttakgtttgartttgatgahgatgagmwgttctatgtggatctggayaaraaggagaccgtctggcatctggaggagtttggccrarccttttcctttgaggctcagggcgggctggctaacattgctatatygaacaacaacttgaataccttgatccagcgttccaaccacactcaggccrccaayggtacgccctatctttgcctcttcctctgtagcccaactggaagggatgagagggcctctctgccaccctcagactaggaagcctaagtgccccctgctgtgtgatcctcttccmctagtggccatgggctgatcccactacagcaagggcttgcatcctctcttctcaggagagagaaaggtgagcagagtgaggctggtcagtggtgtgatacccctstctgtgattcasagctgccataaaatctaaggctgaggtagaggaccaccctcccctaagaggtggagcctttgtgattcatcccagaagaggggcctaacctggtgctgtctccttccagatccccctgaggtgaccgtgtttcccaaggagcctgtggagctgggccagcccaacaccctcatctgccacattgacargttcttcccaccagtgctcaaygtcacrtggctgtgcaaygggragcyrgtcactgagggtgtcgctgagagcytcttcctgcccagaacagattacagcttccacaagttccattacctgacctttgtrccctcagcagaggacktctatgactgcagggtggagcactggggcttggaccagccgctcctcaagcactggggtatgcaactgcttttctctccataatctcctggcatcctctattccaaagacctggtgtcctctgcaccagctttccgcactggctgggtctcagtcctctcctcgtcctaacatccaattaactggtccataaccttcaattcccacaaccatcccaggccatcaccaccctcactgcacctcctgaccctatctcttcattcttcccccagaggcccaagagccaatccagatgcctgagacaacggagactgtgctctgtgccctgggcctggtgctgggcctagtsggcatcatcgtgggcaccgtcctcatcataaagtctctgcgttctggccatgacccccgggcccaggggaccctgtgaaatactgtaaaggtgggaatgtaaagaggaggccctaggatttgtagaatgtaaggaagggaggaaaaattcaatctgataagtgttcattgatcttctaatgggttaaaagcattcagccrcataacaacaacaayaccgataactaactgagtagttaatatggtcaggcrctattctgaggatttacatttattaactcactttattctcacamatagtctttgaggtaggtactattattttcacyatttcacatgagagatacttacatctttttacatacacagagactttaagcactttgatcmagttcccacagctatgaagtagtagggctagcttccaatccagaaagtctggatccaagactgtttatccactgtcctattcaccctattttgtgaaggaaaagaccaagttsaaattctccagagtccrttgycwaataayggagycagatctatatttctatacataattacaacacagtgtggtgggwgcctgtaactacttactgtctctacttggactcattccatggcaatgytcacacaaaaaatgccyctccagagatcttacaggtttctatytatcataacactcaccatgctttatatttttatatgttttgggaattctcttagcattagacrgtgaacttccatgcagatgaccacatctaattcattattattattgttattcatgctggacctcaggtacaaaaggttaagaacttctcagttcattatatgatcatcattggtgcctccgagctctctctctctcccttgatttatttggtcccttttatctccagtccttactcccatatctaacctcttacccctacctcataggtaaacattttaatgaatttgatgtttccttttatttgcatagatsctcystaatatgtagtagtgtccagtgtacatgtatttttaattaaccaaaatggcattaaattatagatctaattttgtacatccagtttgtttcttccaaatcttccatagtattttactttatatgtccatgcattagtccattttgcattgctataaaggaatatctgaagttacctaatttacgaagaaaagagctttaaatggctcacagatctgcaggctgtacgcgaaacatggcactagcatctgcttctgttgggggattctggaagcttttactcatggtggaaggcaagtggagccagtgcatcacatggtcatagagggagaaagagacatagaaagaggtgccagcctctttttaacaaccaggtttcatgtgcactaatagagtgagaactcactcattacccggagaggggacaaagccattcatgagggtctcctccatgattcaaatacctcccaccaggccccacctgcaacactggggatcaattttcaacatgagacttggaagtgacaaatatccaaatcatattaatccacatatctacattgctcctgggatacctggatcattcctggttctctactattgcaagcaatgcttgtatctcacatggaactgcatatacatgtgggcctgacctgcatccctggaatgtatgtatcctagaaaggggttgcagggttgytggagatgcagctccttaatttgactaaacactgctcatcttctcatcagaatggctgtactcatctgaacttcctttgtcagtactctaattgtcctgcaactcctaaatggacttcaacactggacattatccagttttctaacttttgccaatttcatgtgcataaagaaatatgctgttttattttgcatttctttaattactaataattggggytataattaggactgattagccacttgggggttccttttctataaattgcctgttcacattcattgtccatttttgtactatgtgcttccatcattttcttattgatttgcaggtgatccttatatagtcctgctagtagtcccttgtcagttttaggcattgcaaatgttttcctctaatctgacttctggcaactgtctccttggtttcctttattgaagagaaatccttaatattttgtaatgaagtccatcaactgtatttttgtttgtgtgtcttttttaaaagaagtcttccctatactgagatatcaaagatactcttaaaacatctcctacagttttaaatttcacatttactactttaattcatctgggattcatctttgtgtttgatggggatcatgttttatttttctttatataatgggccagtgtgttcccacaactactaaatagttcaccttttccccataggttagtagtgtctcctttgctatactgaaagctcccattataggtgggcctgtgtctgagttccatcttgttccactgttctgtttgtctcttcttgtgccagtgtcctagtattttgattactatgacattgtagtgtgtgttagtatccagtaggacaaattcttgtttatttttcttagttcacacacatttataattatatctataatgatttgtaacagagtgaagtgaatgtagaatgtcagatgttaagaggaagaatggaaaagagggctgggactagggtgatgtaggggatgcacytggcttaggtgcaaaatttgggggataccaaaagaactcagtaataaatcatattttaatgaaatatcttgaaaaggcaaaattaatgcaaagatacatgattaacaaaacatccaaagaggagtatttaacaaaaatggagaagcagagaagcagaagaattaggagaatatgctgtcacatgagccaaggaattaaagaattcaggaaggaggaagtactgctgtcagatgttcaacagaggtcattttagaaaatttaccttggtttttgaaatcctttcaaagagcagtatacacaatgtgagcaagtatccttcgttcattgccgtcattgatatggtttggatatttgtcccttccaattctcattccagggttaagcttcttctctgccctcagtaatgtggcccttccccttgtctgtatattttggagacatgaagcatgtgggatggcctcacagtcagctggggtttgagggtgaaattcaatgactttcgtgaactccttggctcctatgtgctcttcacctggaggrccagggcatgtgcagggatgaccaccttctccctgggacctgaacagggcagagaaatgggaagctcgggtgcaaagggagtggggaagatgggtccgggcttacagtactgaacccaggaatgacaataactgtgtgygttgctgcaggtgacaaaatatctgaacagaagaggacttaggagagatytgaactccagctgccctacaaactccrtcwcagcttttcttctcacttcatgtgaaaactacyccagtggctgactgaattgctgacccttcaagctctgtccttatccrttaccthaaagcagtcattccttagtaaagtttccaacaaatagaaattaatgacactttgrtagcactratayggagattatcctttcattgagccttttatcctctgktytyctttgaararcccctcactgtcaccttccygagaatacyctaagaccaataaatacttcagtatttcagagcrgggagactctgagtcattcttactggaagtctaggaccaggtcacatgtgaatactatttcttgaaggtgtggtttcaacctctgttgccgatgtggttactaaaggttctgatcccacttgaacggaaaggtctgaggatattgattcagtcctgggtttttccctaactacaggatagggtggggtagagaaaggatatttgggggaaattttacttggatgaagattttcttggatgtagtttgaagactgcagtgtttgaagtctctgagggaagagatttggtctgtctggatcaagatttcaggcagattaggattccattcacagcccctgagcttccttcccaaggctgtattgtaattatagcaatatttcatggaggatttttctacatgataaactaagagccaagaaataaaatttttaaaatgccctaattcattgcaatttttaccagccatagtcactccatgtgggagaacttaaatcatgattaccagagctttcaaaggtttgagaatagtgatgattatgaagaaaaatatcttatttgagcaaggattttgtttctttatgagtgttcattagatattacgatgaaaaaagcatgaaatggtaaaaattcagataaatataaaaacatgttctctagttttttttaagttaaaaaaggaattgtttaaagtaaaaattatttgggggtttataacatacccagaagtaaaatatgatgacaatggcacaaagaatagaagggagaaatggaagtataatgttgtaagtttcttatacatgttaagtggtgtgttattatttgaaggtagaatgtattaagatgaatattttaagctcctgataactattgaaaaaaaaagaggtatagccaagaggccaatggagaagataaaatagaacactaagcataattaattcaaaataaagaaataaaaaagggaaagtctggtaagacaaaaagaaaacaaactgtaagatggtagagtttaaaacaaccatactaataattgaattaaatgcacatggcctaaatattctaatgaaaagggaaagattgtcagaatgcacaaaaaaatctacaggccaacttcatgctctctacataatgccctctttaaatatgaaggcaaagacaggtaaaaagtaaaagaatgggaaaatacatgtataccgtggaatgctatgcagccataaaaaaatgagttcatgttgtttgtggggacatggatgaagctggaagccatccttcacagcaaactaacacaggaacagaaaaccaaacaccacacgttctcactcgtaagtgggagttcaacaattagaacacatggacacagggaggggaacacctcacaccagggtctgtcagggcatggggagcaaggggagggagagcattaggacacataccgaatgtatgcatggcttaaaacctagatgatgggttgatagatgcagcaaaccacatggcacatgtataactatgtaacaaacctgcacattctgcacatgtatcccagaacttaaagtaaaaaaaaaaaaaacgaaaataatgccaaccatggaagtattggtggctgtgttaatatcagaaatataagactcagaaatattaccaaggagaaagaaggatagttcataatgataaaaggatcattttattatcaacatataacaatcctaaatgtgtttgttcttagaaaatatgtcttaaatcacattataccaaaaatgataaaaataaatcagaaatagacaaattcacaattatattttagtattctagcactcagtaaacaataaaatatttaggaaaaaacttcatgaggacatgatagatttaaataacattatcaatgaaccaacgtgatctaatcaagatctgtagaatattccacccaatagtggcagaatacacattattttcaaatgctcaagaatattccacaggacagactatacactgggtcataaacacatataaataaatgtctaaataaataaatgtctctattgaaatcatacagaatacattctcggaccacaatagcattaaattagaaaccaataacagaaaaataccttgaaagtcccaaatacctagaaattaaaaagtatactgctaaacagcacctggatttaaaaagagtcagaaggaaaattagaaaatattttgaactgagtgaatatgaaagcacactatcaaaattagtatgatacactaattagagaataatttataactttacataattggaaaggagggaaactctaaaatcaaccatctatgttcccatcttaagaagctagaaaaaaaaagtcaaatgaatcccaagattaataagatcagaaataaatgcaataaaatggacaaacaataaagaaaataaacaaagtcaattgctggttttcaataaggctcaatacattcatgaatctctaggtagatggatcaagaaaaagagataagactcaaatccccaatatcagaaatggaagtgggtacgtcacaacaaatcatacagacattaaaagtattatgacagaatgctatgaaaatgccaataaacaaaaatgacaataaatttgacaatttacattgttaaattaaattaaatttggtgtaaagctttctccatatcttaaattcctacatagcaaactaacccaacttaacataactgcgttatgcaaacaaactacagcctaacttaagagtgttgtaataaatagctgagtctcagccaatcacaggctgccaagtgatcatattatgtcccccataaggcaaatgcctcatcacgccatgcccatataaggcaaacactgagctgtaataaattggctggttttgagtatcacttcctgtttttatctataaacactgccttcacatgttgctggacagagctttctgaatctttctgggttctgagggctccccaattcatgaattgttctttgctaaataaactctgttaaattcaacttctctaaaatttttattttaacaacatgaaatagaaacatttcttgaacgattcaaattaccaaaactaaatcaagaagaaatctctgtcaatggaagaaattaagtttgtaattttaaaaatccttctcacagagaaggccaaatggtttccaggtcagatggcttcattgattaatccatagtattctgtcataatactgtcataatacttttaatgtctgtatgattaattctattatacatttaaggaagaaacaatacaaactcaatacaaactctttcaacaaaagagcagaagaaaacacatcccaataatttacaagtccaatatactaacatcaaacaatgacattaaaagaaaaggaaactaaagacacacaaacatagccatgaaaatgtttaacaaaatattttttaaaattgaattcaataatatattaaaaaggatgatataacatgatcataaaagtttatgccaggaatggaaggcatgtttaacatgcaaaaaatcaatgtgattccacatcttaacagaatacaaaagaaaaattatgtaattatgtaaatggatgcagaaaaaggcatttgctcattcatgataaaaagtcctagaaaactaggaataaaaaggaattacctgataaggtgtgtccatgaaaaccaacaactgaaattttcaattttgggtgggggaggggggcgggcattttactttctccataaaactattaaattatctaatgtgaaagtggaattcagtgaagaaatgttccctactgcaaaaatacaaaatgctggacattctgtgaacagtttctatgcattctatataaatgaaactattaactatataatacatttattgaaaaaagaagatggccttctttttttttcctaatggctgttgaatttatttgcttgatcaataatggtcctggcaaaaattgaccaatgctgagacatttgtaatgaaatactaattttaaaagtccatgacaccttgatagaaattagagtttacacaaacaaaaaaggaaccttcgatatttccagcagctacaaggtgaatgtactgagaccgacaggacagcaagaaggcatttgcacatttatatctgacaccagaccacactttcagccaccagaatatcttctctccatattttaaaaaatagtgtctctccctctccctctccccacggtctccctctccctctccctctccctctccccacggtctccctctccctctctttccacagtctccctctgatgccgagccgaagctggacgatactgctgccatcacggctcactgcaacctccctgcctgattctcctgcctcagcttgccgagtgcctgcgattgcaggcgcgcgccgccacacctgactggttttcgtatttttttggtggagatggggattcgctgtattggctgggctggtctccagctcctaaccgagagtgatccgccagcctcggcctcccgaggtgccgggattgcagacagagtctcgttcactcagtgctcaatggtgcccaggctggagtgcagtggcgtgatctcggctcgctacaacctccacctcccagcagcctgccttggcctcccaaagtgccgagactgcagcctctgcccggccgccaccccgtctgggaagtgaagagcgtctccgcctggccgcccatcgtctgggatgtgaggagcccctctgcctggctgcccagtctggaaagtgaggagcgtctctgcccggccgccatcccatctaggaagtgaggagcgcctcttcccggccgccatcacatctgggaagtgaggagcgtctctgcctggccgcccatcgtctgagatgtggggagcacctctgccctgccgccccgtccgggatgtgaggagcgtctctgcccggccgccccgtctgagaagtgaggagaccctctgcctggcaaccgccccgtctgagaagtgaggaacccctccgcccagcagccaccctgtctgggaattgaggagcgtctccgcccggcagtcacctcctccgggagggaggtggggggggtcagccccccgcccggccagccgccccgtccggcaggtgaggggcgcctctgcccggcccgcccctactgggaagtgaggagcccctctgcccggccagccgccccatccgggagggaggtgggggagtcagtcccccgcccggccagccgccccatccgggagggaggtgggggggtcagccccccgcccggccagccaccccatccgggaagtgaggggcgcctctgcccggccgcccctactgggaagtgaagagcccctctgcccagccagccgccccgtccgggagggaggtggggggtcagccccctgccccgccagccgccccgtccgggagggaggtgggggggtcagccccccgcccggccagccaccccatccgggaagtgaggggcgcctctgcccggccgcgcctactgggaagtgaggagcccctctgccccgccaccaccccgtctgggaggtgtacccaacagctcattgagaacgggccgtgatgacaatggcggttttgtagaatagaaacgggggaaaggtggggaaaagattgagaaatcggatggttgccgtgtctgtgtagaaagaggtagacatgggagacttttcattttgttctgtactaagaaaaattcttctgccttgggatcctgttgatcggtgaccttacccccaaccctgtgctctctgaaacatgtgctgtatccactcagggttgaatggattaagggtggtgcaagatgtgctttgttaaacagatgcttgaaggcagcatgctccttaagagtcatcaccactccctaatctcaagtacccagggacacaaacactgcggaaggccgcagggtcctctgcctaggaaaaccagagacctttgttcacttgtttatctgctgaccttccctccactattgtcctgtga

SEQ ID NO: 17573 - DNA, 29686 bp, Homo sapiens
  misc_feature (1)...(29686): n = A,T,C or G, or insertion/deletion polymorphism (see Tables 1-2)
tgattggacagattcccatcacactgtggtgcttctttctgttccattatgaacgttaccactctggtgagacagttttactcacggctcacacatctgtcattctctgtccctttgaaaacccatttcatggtccagtagagcagagtttcatccaatagcactattgacttggtggcttcaaagtgcagtgcccacccctggctgagcttggggcagtaatgtttaacagtctggtagttaaattagaagcaataataacacaatagtcaggtttggttctaacacacgaatgagtcccaaccctctagctgtaactgaaataagtagaaggggaggaatggatttgggattcttctgtaggattcctgatctgttcttctatggccagacagagcaagaaaacccatgggaccacaacacaaccccatgattggaaaaacttgtgttttacagaccacctctcaagactcaatgctgacaggctggaaataaactagaataattaattctaaaatagtcacgaagacaaatcttccctccaattcagtccaaaggtctggattggcttaatgtctagagtgtgtgctatttgactatttctactaaacattaattaaataatccatctagctctggcccccagagctccagggtccccagaagtggaatatcctaactggtatctgtccctttccaagttagcccttgtatgagtgccccgctgagatgaggtagtgggctttcagcattcagtaccctccgatgctccaaccagagcagcttggtttgcggttcacctcaggacaatgcaaactgagctatgcatttactgtaattctaatcagatgattctataattggaagaacaccagtggcattctgtctttggagtcttttccattaagcaattgaacaagggccaggggacctttacttgtcccaaacgcagatcgtgatagagactctgagatctggatactatgttccattctataacaggatcaagttcttaattttttcttggtaagatcataaaatgtgtgtagcagtcatttcacccgtactttcaataaattctgaccaactgctctcctaacaatgaaaaacaaatgaaatgagcaaagtgtttgtgtgtatttgtggtggggagtgtgtgtatgtatgcttgaatatagtgactgaatattttaggtaaatatttccaagtctagattataatcatatatgataattgttgactaaagtaataagaaaaataacctgaatttcttaatctctctagatacctcaattagaaacagaaagaaatattatggacaaatgcattggggaactaatttgcagtaggaactgtgcaaagtattgcgttgctttcggaaatataggaatgaatcagacctcgatcttgactttgaagagctcataatttaaagagggagataaatcatgatcataaaaatcataatctaagatagaaagtgcagggcctgtggcactgggatttagaggaaggaaagtttactccctcctgggaagctctggcttggctttttggaggatacagactttaaagcatgggaaggatttggtccaaggacaaacaaggggaaggaataattgcaggagcaaaggcgagatgtgaagtgagaatgtataactggacagtgttgccttcacaggcagttggggtaaataaaggactctaccagtgacctgagggatcttgttaaaatatagattctgatgcagttggtctggagtggaacctgaaaatttgcatttctaataaactctcagatgatgctgatgctgctggttctcagccccctctaagcaatagggaatcattacaggtcttagacagtacagagttcctgttatgaccttcaaccttggaaatccctttaaggagacattttgaggttgcggacacccacatgatgacgagtacaacagcatttgcttttccttctccagttgtactgatcaaaataaaaacccagttaggggtgaaaatggacaaggggtgaaaaggttaactaaagacctggattctagacaccagataatacacaaaccacaatgtaaatgctgttttggtttcagaaatggtttctcctcctaaattgttaattgaagggcaaaagagagctgatgagtatctatatatttgagagtgatttagaccctctagcttgattgttaatataattttataataagatgataatacttcagtagtaccatggggaaagaacaggaattagaatcaaaagatctgaccttacattctttaacctctctgggcctcagataaactttctcatctataacacaggagaaaaatcccttccccagctacctctcagttcttcataaaaatcaaataagctaatgggtatgaaagtgctttgcagactaagaagtgccttgcaggtgtgatggctaccttttgttattatggatggaggcattagtcttttctctgttcctgggacttgctggcagaatgagttagtgcaaactctgaggagaaactgtgtcagcctcaggggcaaggccccaggtaatatggcatgagagatcctcctgtagagtttgcgtctcctgtcaaagcaggatgcacctgctgcctgtagatcagacatacacttgcatctggttgcgcagcttcctgtgatctctggggaaatgttatcagcagcaatattgccatacagggcatcccctgggagtgactttgggggcaagacttatgtctcatgttctctgctacccactgaaggctattctggccaagcccccagagcaggtaacagtggcaggtaagaatatttgttaggtaagaggaaagtccagagcatgaaggctccaaggtctaagaaaaaaattagcaagacaccaagaagcatttttttagcaggaaaataggtggcattcagagagtgaatagggggacaagaagataactcctgagagccaaacctacaaagtcaatacctggaccagaaagctcacttttcaggagaactctactgcattttacatgtaatagaactgagtgtcacttaaggtaacaggcattagaaatcaccatggaggtcaggttcaatccctgaattgcctgtgaggaaacaggcatttggtaaaaaggggcttgccctgagttaatagaagatcccgggataaatctcagatctcttgattatctttctcttgctgtttgagaagggccatcctttttggccctcctggcctaagtttcttcatttcaaaaatgatgggaaagatcactgtttcccttgtgtgctcttccagctccaatattccatgggtcccagagacccaggcttcagtccaggcctagagcatctccccattcaggccgtgttcacaggaatcatagcctctccctttattctcccctggggaatctgcagtaatgcttaatccccrctcccagactcactttcgcaaggggaaatcaatagattcttcaagtagttggaccacagaatgatgcctgggtctattttgtcaaccaggtggctctggtgaaggaagttgtgtgagtcattgtcggccagaaatgtaaatctggactgaggcttcccttgcagtgaaatttgggtctttagtaacagtgaccttctgtacagcacgttacagttacaaaacactttacatacttcatttgtttatcacaactattcagagacttagtgttattgttatgcccattttacagaggaggaaaatagacatgggcactatggcaatttgcccaaggtgacaggaagtgtgagtggcagagctgggactgacttagtgaagtctttggaccttataatccgtgacctgcataccacatctctttgtatcagggttcctattgcctactcagcctcagtggatagaaacaaaagcaaagaaggtcaacctgcttggggtcatttacatggacatgcatttctggagaagggataattgcagcatcattgtggatattacagtcatggagacaggcctgggaataggcagatatatgggactgacagcctctgtccactgctgtccaccacccactgactctttcaccttctgtttctcagactaaaactcacccttcctgatttaaaaaccagggcttttcttcccattgtgtaaaatatgaagcataatccaaacatgtaaaaaaggatgacaagtactgtaacaaacatccatcgtagtgaagtttcacgctgttagctaaatatttccagttctttccatttctgggaacatggtagaattgcactcctggcccttgagcaaggtaaatccaggtgctagtctgggccacttagctgtgaaaggagacagcgtgtgtcacttccaatctggagcatgtaattgctctctctttccttctggtgcagctgccagcaaggaggtggtgactgctctgtcagccttggtccctgagtggcaacaacaagcagcaccttctgccaacctacaatgtatgaaataaaaaaagaaatctttgctcttttaagccattgagatttggggtttctgttattgcagcaaaacctaacttatactgacccttacattcacattcccaccaccatgattttttgagaatgttaacatttccttatacctggttcagctttttaaagaagcgaaatccaaaaataactgtatcctttgtcgcttgcctccttccagcccttttccttcctccccagaatagctaccgtctcaaagatgtatgcgtctgtcctgtccatgtttggtagatttactccgtaagtatgtgtacaacacaatatatagtattacttcatgttactaaaatttgcatgaataatattgattattctaaaaattgcttttgtattcaacattattattttagatgtatcaatattgatacgttagtttcagttcactcactttaaatttgatataatatcccttcatatgaatgtatcacaatttataaagccttttcctactaatgaacttttaaattacttttttcttttaaaaacaattctcttaaatacaaggctttttatgtaggtatgcaagagcttctcttggttgtatgcaagagcttctcttggttgtataccaagagtggaattgctaagatataaggtctactaaacctcaaatttgatagatattgccaaatttctatccaaaatggctttttttcatttacagtcctatcatcagtgtctacatgttttgtcattgctttatcatgtcaaacatttcatgttgtccgacttttaaaattttagccaatctgatgggtctgaaatggcatctcctaattttttattttgcatttctttgagtatcagtgaagttaagcatctttccatttcttttaggattatttccttttcagagttttccttgttgatatagactgatcatttatttctatgtttttttctccttatggatgtgtagaattttcttcctcctgtgttctgggtactaatccagttacataaattgtaagtgcattttctgcatctgtgacttgcttttaattttgttctttgcccagttatccttctctcgcaagccattggctgcctgcttgtgcacacacttgatttttcagatcatagcaactacatggtaaaaatggcttggaggcgtgttttgaaaaacctaggtgaataaatgttgcttgctctaaatatctgtagtaggatatggaatgtgtttttacaagataatcggtgaaggacctgttttgcttactcaaggatctcatttgctaacacgattgtgtggtgaaagcaaaagaaccaggtgtaagtggaaaaaaccttagtcattaagagttgtttgggctgctcaatggtgagtatcaggggtgactggtttccccctgccatgatgaatcctggcatgatttgcctggctgttttgacattttgtagacctagcatatgtgggagggcacttgaaagacgtctcatactcaagtggtctctcctcttcccatacacaccttacggattcttcacagggtgtgatgatgggaagcctagacacgcttatcagaaggtaggaaaaaatggtgtcttggaagtgcttgtagctttccaatgaggggagtcactttaaagctttgtttatctttctgtgcctcagctaaccccagaggaaaatcttagctcaggacaggaagctcagagcacccaaaaggatgactactgcagtgcaagactatttatgtctgcctcttacatatccctccgtgttctcccccaggaggcctgggctgtgctgcagctccaaggaggcctgcatatatcatcactccctaggaaaccaaggggtatggcagaaaccgagctctgggatcaattatactggtaaaactacaaaggcagggggtgagccagagtgttgtggcttaggaacaacttgctgaaaaaagacttgatgttcccaagtagaaccctgtggccccaggggaggtgacctcggctgtctggtcaaccagccagagtgctaggtctcagaagccaggacacaccttccgttccagttgactcacttgagtggcaaattcttttctccctcacaatcctctcatcttcaaagggaattcattaagccccaccatgccatcggcacttggccaggtgttatactggcccattaggtggacacaggccgtagccccagggagcatgccaaatgaggtggagggtggcagctgtgacctagtgacatcccctgaggtggttttgcagcaccttctataaaccctccagctgtttcaaactatttgtgtggggctttccacacaagctgtgttctctcccgtccccttgctttagttcactcttttccttttgcttggaatgctyttccactctatctgtcaatgcactcaaatgcccactcctggatggagactttcctggcaaccccaggcagaattagccactcccaattctgtgtattctcatagcactctgtatcattaatatagcacatgccaatctgtgctggaatcatctgcttatatgtctgtctccctaatggactctgaattccttgaagatgcattctgcgacttatccatctttgtttcttcagcaagaatttggttggtgcttagtaaatgtgtgctgagttaaatgcagaaagggacacagctcatgattttatctgattttaccttgtggtataactggaagcaggtcacgtctgtctgagttttagtttccttttctgtaaaatgggtggggggaggatacattagaaaatggcctctaagaggttttctggctctactgtctatgattttaaaattctagtctcctattgaaaaaccgagagttcatcataactctttaaagaccaacatgttttcgtttacatgtatcaaagagcctgatgttcccttcccacctctagtctgccacctataaaaaaagttgtgtattgcttagcagtttgcaaattttctgactgaagtttcaagaggtttgtgggattgattgattacargaagcgtgtaaattttatcttccctggggaataaaattgtgggactaattgattcttttaaaggcttgtattttctggtgattttgtcagcctgggtacatgtggaaaggggtcttgtgtagctgcttgtggcatccctgtgtctctcttctcaccacaatgcaggcgtcactgcacgtgccacacctagtagtctgtgtcccatgaggcccatgcttttcctaggctacctctctgccccttgagttacatgtttggaaattcctgcatggatagaactgagtacccctcgccttctgagaacatatttacaaggtgctaataacacctaactatgatcttagaactagtctacatggtgagtcagacggggcttattttcgacccatttttcagwtggaagtaagacacagggaggtgaaatgacttgcatgaggtctcacagctaggaaggtcttctggacctggcttaataaaacccaatgttcttaatttcatcaactcctttaaaaattactttgattgctgctttcttgattggctgctctcaggcctcttggctgatgaaaccagaggcaggtgaattctaccagaaggaaagaaggggttctaacccactactgattttgtgggacaaagtggctgcattcattagtgaagggggaagtcagattagttaaaactgtccatttggtggtttctatcattagcatctcactatgccagtaaatgagctgttgaagcctgaagtaggggctcctcctgaaagctcgagaggattccaaagctgctgggctccgtggaggaacatccaggagcacatggtctccatgttcccttttttaactctacaaaggcagctaagagggagcgcaacttgttactgcacatctctgagtgtcagtttttctatctgtgaaatggggataataaatcctccctagcttacctcagaggatggctgtgagggtcacatattatgatggaggtggcagtgctctagaatctgaaagtgcagggcaaaaatcaggtaatatcatttgctcttgttattatacttttttttttttgggactgagattcactctgttgcccaggctggagtgcaatggcacaatctcagctcactgcaacctccacctcccgggttcgaggaaatctcctgcctcatcctctcaagtaggtgggattacaggcacccaccaccacacctagctaatttttgtatttttggtagagagggtgtttcaccagccaggctggtgttgaactcgtgacctcaggtgatccacccacctcggcctcccaaactgctggttttacaggtgtgagccacggcgcccagccttgttattctactttcataactgtgaatgatcttaatgaagggaagtaagcccagcttgataggtgtttcctaaaagtggcccgaggtgacattatgtgggaatatatggatctatgaagtatgaacgatggcagtttttgccctaacctacccatcagaacactggagaagactcaggtagataatggattcaagggcattgttaaatgataaaaattatcatgatgatgacttttttttttctctaaggttaaggatatctcttaataacttgaaagaaatgtactcaaaccctctctgatgctattttcgtcatggccctacctcatcttgggagtaaagcgttccacttggctgaraagtaggagaggggctgggtcggaactcatctgctcaggttttyttcctcataccattcggatgctctttttgagtcaatggctctagctttttgtaatgatctataagcttctggctcctttggctytaactagtccctgaggatcaattccctttccaaaragggtgggtttttttgttgttgttgctgttgtttaattttctctcttttatctggggaaaaaatagccmctgtcatagrctgtwaaaaaaaaaaaaaaaaaaaaaagctgctttttgggagccttaaaaatatttgaaataaatagggctcaaccttaacttaataatatcaagtgaaaacatacatactttttattaccagagagaagtagaggcagctttcaatatacgggacatgcaatgggatgttacactgcaaataagaagataaaactagaacaatagcgagaaagccaatgtgttatgttstaaggcttggtgtagttactgcaactgagcatgaaatataaactgagcttcctggcaggcaggacaaaaaagtaaacatgatgacgtacataatattctttttctgattgaagtatgtgtcctgattatttgagagacatttttcctaatattaattttgaaaaggaatgtatcactgagtacattanctgagtatattcattagaagagtaatgaatatgtctttagcaagagttttacatctaatgaaaaaaagttcttatatttccatctcattccttgttttgaactgcaagcgcatattaactagtgactaaattttttcacttggatatttcagagtcatcctaaactgaacatattccaaactgcattcattaacttctttctgaaattggttcctctccctgtgtttattatcttggttaaagcatcacacacataagctctccctgtcagaaaatctcaggttgtttagatgacttcaccccaacctccagcccacacccagtgaatcctggagacactgtctcgttgatttattcaaaatccttcctctcctcttcacctccaacacccctgcttcagttctggtccctatcgtctctcatctagcctatttcgatgacttcttaacttgctttcttattgtttcagcttgttctctacactacctctctacaaactcatctataaaaaatgcaaacctagtctttctgaataggctgcccgttgctttcaaggtgaaatctaaactcatggcctggcagatgaagactttcacctgcttggttttcagtctgatctgctgccacacccctgacagattctctgttccagtaacacrggctacttgctycccckgtgcacatcgctgcccctgtggccatgttttgcacaggctactacttctgtccagaactcctgccacctttgcaaacctggtcccctcctattctaggaagctttcctgatccccttccaacagccaccatagtgtggttttccctcctttgtatgccccaatacctgtgtaaatctcagttatacttaccacatggtgctgcaactgtttgcttagtttctgaatyctccaagactaacttttcaaagacaggaacggaacctcartcatcctagatttccagctctatatatgtgcttgacacagttggagcctgataagtatttgttgactaaatgggcagatgaaagatagaataatgctgtacatggagcaataaggttgtctttaggatatgttaactggtgatacagaatcaataggtgttgtgttgatcaacagaacttttcctttaggatatataaaggactgagtggatagacagtgctttagacaaacctctctgaaatcatctctttgtgctggctttgggtgggtgctggatggcagacagtgagtggctatgctgttagcagaagcctcagtggctggcattctgtgtgcccaacctaggcacagytgtatattttattcatcttatgtgtgtttgggtagctaagggcagtgatattgcatgaaggaaagaaagaagcctgaccaggaagtggattataaaggtatctccctgcacagccaggatttccctcaaaaagtattgctttctatcaagtacctggcagagaatcaatggagaatcttttccttgttctgctccatcaagtttcacaccatataaaattttttttgaccaagtcctgcttgtaactgaattaactggggtgcttgtttaaaatgcagacccgcccccaggcacccccgccaacagaccctagccttaaatayggcctcaaagttggttggggaaaatttttgagcatagtccattgcccagctcttcagggataatggtaaagccctagaatgatggtgtctgggctggatcatgtttttaacctccacaagttacttgttgtgaaagtttgtgggcaaaagcagttttggatgctcctaggcccaatgtaatagagctactccacaggccttaggggccattcactttatgtctcgcaagccccrcctgagcctgactgaacttagcagagccatggtatgggcttgtgctctagatagaggactcaagttcctgtgcaaggcttgcctagcacagcatggattagtctagtaataaacttttaagcaagtcatattaataattcaaagccaaataggattttgctgtcctcaaaactcttgcacttgcattctttcctttgatctcacaatagccctggaagcaggcaaaaccagggctcttcccatattgtagacaaagaaactgagattcagaaatggcaggtgacttgtgcaaggtcacacagatgggactgcaactgcctgatctaagattctgactccattttcatgctgtgctggattccactgtgcttgctgatctctcaagtcatcagatttgaaaagaacrttactaaggatgttagaactacattttagggctcagggatgtccataaaaataagaatttccatctctgaattattagagcagacacttgtggctgaatgttacaacttgagtcccatatgtcaagaaggcttgcaaagttcattatagggtcctaagcctccagagaagtttccagtagtatgttgacttgcataaaagggagagacagtggtgggcatcttttcctcactccatggttattgatgtcacattgagagcttgaatgtgccatggtgcaagtatttataccacagaaatcagcaaaacctataattcagggctttctcaccactgtagaaccagttaaacattttccagcttatagctcatggtgactgcacaaattagagtctgaaaattctcctctgtcacctgcgtggcacaggcgttgattttgcctctaaccacaagtcataccccagtgcccatctttaaatgggagactccttttatctgagcttgcaaaatcagattcatgggtttctactaatagtcccttgcatttgtgtagtttgtaacgtgttttcamatccctcatcacttctgaactgggtataatctattgggcagatgtcatctacccttggtaggacagaagggcctggagatctgacaggtaatgtgaccactctcagtgtcataggcctgtaagtggcagccagggacttgaactgggtcttcacctccttgttctgtgctcctttcctttgtactagctaccttcacctaggacacttgcaatgtctggagatgaagccactgtctagggcgcagagaagagttgcctagcagcagtgtaacattggagtgtgacttagccattgacagaaaagaacagacatgctagcttgagagtatccacacttaactgctagtcccactttactgatccaatgcaaggaaagaagtctackttcacttctcctctgtcttccatcttctctttgttttttttwwwwaaaaaaaaataacttttatgggtactttgtgtctttaggtcctgctgagggttctgagcacaacagatatttggagtctcctgaatgatgtagcagtaatgccctgttccgcctgttgcataactcccagcctcatactgcctggtgatggaattattgattgttragcatttcacaacacattttcaaaacatgctgaaggtcaagaatggatgactcataggcagtaacagttccttctgcctcagtccctctacatgatattggtgaggttggtaatgaaagtcattgaagaaattgaggcaaaagttaactctgtccaatcctggccagcaggattattaagtaacttgaaaaaaataattcctgatactctatttatttagtgattgatcttctaaatcagtttgttttgttgttgttgtttgattgattgatttttttgagacagtcttgctttgtcacccaggctggagtgcagtggcatgatctcagctcaccgcaacctctgcctcccggttcaagtgtttctcctgcctcagccccccaagtagctgggactacaggtgtgtgccaccatacccagaaaattttgtatttttagtagagatggagttttgccatgttggccaggctggtcttgaactggcctcaagcaatccacctgcctyagcctcccaaagtgctgggattataggcgtgagccaccatgcctggcttcactttgttttttaataccaagtctcataaatagtataaagtgggagttaagggatttcagtgctgattttgccactaacttgttcaaaagcaccagagagtaccactgaggtactcagctgaggaaaaacacttaaatgatatctagggaactttactgctctgacagtctgtgattgtacattagtactttagacagcagagagataaaccctgattccggtttacagataattactcatctctctgcctgaggccaagaaaagccctctgtggagcagtgtggaagaatgccttagagcacagtagcagagagttccagacccggaggcaaggggatctgggttaactctcaacgttgccaactgtgatttgaatcttctgacagggtgctgggcctgctagcatctcagttttctcacctgtaaaatggagacaataacagtgtgtgagctttttttggtacaaacgttaatgcatgaaaagacctacaacatgtttccgcatgggctagttgaaagttttggaggaaaaaatatcaagctgataatttttaaatttttttttttgttttgaggcagagtcttgctctgtcacccaggctggaggacagttccacgatcttggctcactgcaacccccgcctgctgggttcaagtgaatctcatgcctcagccttcccagtagctgggactacaggtgcgtgctaccatgcccggctaatttttgcatttttagtagagatggggtttcaccattttggccaggctggtctcgaactcctaaccttaggtgattcaccccctcctcggcctcccaaagtgctgggattacaggtgtgagccacctcgcccagccgtaaaattcttaatatgtaagtattttcttcaaaaatgaatctaatttgcataactaaagtttctgaatgctttatctagaataatcatgggactggaagtttcttaatagttcttctctaggtttttgcactttaaataccctgcaggtcttttcattctaatataacataatcacagtaataagaagtgtgacaaagctctagtagttcatggtgcctgtgcctcattcactcgtcagcgaagcctccctcagcatcccctccccacatccatccctgcacactgcaccctctccaagctgctgccagccgtgctgctcccctgcctcctkactggagkgcaagccagtaaaaaaggaagcaaattcggttatgtaaagcacattctgggtaaggaaaggcaagcatgtgtttctgcttgactgaaattggtttttttttttccccaccagtttgtcctcttatcgggatacrtcagaaattagagagaccctggcaatcacagcttccacctcctcattttacaaatgagcaactaggctcagagtacagaagtggctttcccagggtcacacagccagcttgtgacagagtcaggattcaagtaccatctcctgacttctccattgcaccagacgtcgatagaacacagagaacctaaaagaagaaagaaaaaaaaatagagcttttgggaatatrttgggcttctggttttcaaggacaattttatgataagtagcaatgatgcctcaaaagctctggtagctagcttgaatgaacttatgtaataaacatttatcacagaacatgtgtcatcaaacacctgccagttctgagcgttggcaccaaagctgctttcattgtcaaagaaaagagggggaaaggaacttggctgaacaaagctggcagacgtttatactagaaaatttagaggtaatttctagaggaacagaaacacattttcaaagtcttataaaatttatttaaatgtgattgggtgaatttagcagttaaagaagtgaagaacactgaggtccaattggtgcctgaggcttcttccaggacccagkcttttctgtctgccttgggcacagatttctagatgcctgaagatggacaggcccagaggttgcccagagygatgtctgagattactgatctctatctaggcttccatagaaacacatcccaaaacgttcttggttcttattggaatctcatctcatttgcagaacatggccagagtcaaagagacatggaccatgtgtcactcagactgagtccatccatacaaagagaattctctagcctgtattggaagtcaatctacatcagcatgacagggcatgtagccgaatacgtggccacttccctttggctacccacacatttttgaactgcaagatctgttctttatctactcatctaatggttattactgggagagcactggactataaattctgttgcacttgcaggtgtaatgagctctttgaacctcagtttcctcacccatcagatactattcattatctgccttgcggacaacacctagttgttgggaacattgcatgaatggcaggtggaggtgctttgtaaacgctaaagcctgccatgaatgtgaaggagtgttgctactcttctgtgcccaacaatgtgctagcaccaagggagttcaaaagaaatgtgagacatggtccctaccctccaggaacttacaantcattgttgggagaccaagacacatccyctaaaaacagatatrtaacacctcaagtctgtgaagtacttactatttaaatgatgcccagagcctctgaatcccctagaagtacagaggagggggagatcattaatggtgtggagaagttggaggaggtgagaygatgccaggtgataaagtagacagagaagatgaaggtcttttttttgagacagggtctcaccctgttgcccaggctggagtgcagtggcatgatcggcccactgcaacctccacctcctaggttcaagcaattctcgtgcctcgacttcctgacatagctgggactacaggcgcacaccgccacacccggctaatttttgtatttttagtagagacagggtttcaccatgtgggccatkctggtctcgaactcctgacctcaagcaatccacccacctcagcctcccaaagttccgggattacagatgtgagccactgtgccctggcctgaagaaggtctttatgggtacggcatgactgctggagagttttgtcaccgcygcttaaggaagagcttcccaatgttggatatgtctgtaacttcataatttttttttaattttgcgcttttgtgaatttcctcaattggctttcttattggcccccaggatcacacagaacacttcaaactcctcttaygtgttcttgatttcatcatttagctgaagatgcaggccctgtctttctttctgagttttccttagcaccctccttttaaattacctttttcattggttaaatgccatgaaacttcatcaattctagttttagctatcacttgacccaaagacaagagagttgaatcctggaccttaaagaaaaagaaaaaaggaaaaaaagcttgtgggaaccttatttacctcaactggggaaattttttgctcttgcgcaaaggtcaggtcccgtgaaacttgtgaaataggtgtttttatctcttttcttttccaactgatcagatagatatctttccaggaatttggtgtcagaaatcaaattcaatgagtgggaagtttgacaagattcaggatagtcttgccaaatagcacaagagaggaggtaaagttaggtcaggtcaagggggcagcaaaaatgaagtttataacagatatactgtatatttgtcatgggaaagggcttcagtcaatagcaattgatattaataaaacataaaagaaatgacaataaacartcaggataactttgaaacaacttctttttatgtaggtaacattaaagaaaattaaagaaaaggaatcgctttattttataaaataaatgcactactatttgcaaaaaaaaawttacctaaaaatgctgctactgaacaaacaaaactacccaaaattagagaacaaaagcataaaaattgttaacaaataaaaaaactatatttttgaaawgtcttagatgatacacaaaaaatgcagatttgtataaatacaccatcgccctgggatgacctcttatcattgtctaagcaagttgtagtgccacggtgtgtttcagactatgctatagaaaatctttagcactcaccttaaaagtttaaagtagaaagaacaacctttaacaggaycatagaaaatgttccatcagatcaaaacaaacaagcaaacaaactgaagcaggtcatttttctctttttggcactgtgcaggaccatatgcttccagagatgggaatttaaaaatagcctgtcacacagctcacattgtaatgctgggacatgatgcgggtgggaaagattgcctcacacttaataatagtgacacttcacatttacaccaacctctttgcagagtaaccaagagtatttctcagttctttttttcctttaaaaataatatgatcttcttgataccctgtaagtggaacaggagggagtacaattcttcccaccttacagagaaggcgattgaggcctccaaaggtaaagtgactcactcaggattacagagttacccagggatcancactgtgctgttcaaaatacaccaggctgccaactgcagcaatatcctgggcctgtgagaaccgtgggttcataggatgttgcacaaaaaagagagaaatttgcttcccattgcctctgttttgaaatgtactgcctttcatcttgagcatttcataagtttctaattttaaggcaaattgcttataagccatggtgacctatattagctgacatttgaaatcaatctcacaccagtaaatgccttagatttgcatttggtacccccttgccgagtcataataacaatgtaatttctcacatctccataattctttacacttgaaaatggttgtacattcaccatctcatcagatctgtataagcagctataatttaagccaggccagagttatgatgagagggaacagaggctcaggatatgaaaaaaactttctcatttggtaaaagccacagaaactgatgaaacccaggtcttctctctgcatgtgtagggtatwttcctgccagccacacagccttttaggtctaaataaagtgttgagactccactgcaagtgtgtgtgcgctcaggagtgactcttctacccagtttggtgcccagcactcagttcctaattggctgcaaaaccctgaagggggattctagatgtggcgggcaccaggtgaagtcagtagtgagcttcctttttggagggaaggaaaattcttggcataccgatgggtccaggcagacactttggatatgtgtggagcccagtgatgttgtgttactgggtagccttaaaccttattccaaccttgactccttctactctgtgccataaactctctccttccaatacyccccattcctctgctgccttcccctttatcgtacctggcaaaactgcaatcctggtgaaatgtatatcctctaattcctcctttgcttgcatccaaacagtggaatgttgttaagaacattgtaaaccatgctgatcagttcactttaaatttgtgatcacaaacctgaaacggaccgtgccagaggatcctatgatacatttagcaaattcactttttggtttctgggtcaactctttcaaacctttagctccctacttgaatatccactaatatccactatgctctacacatsccatgccctgggattatgaccttcctttttgctatcagaggagagttattgcatttttccttaacccacctgcatctgtgcccacatacactacctccctcttattatagtggaggaagtggcatagtttctaaggccaacccttccatttgtcctctgtatcccatctcctttcctatgcttctctcttgcaacatcaaattctgatgttcctttacatctaacccatcagcatacaaatatgcctttataacaactactaaaaataaaaaaaaacccagctctcccttggccctacatgtccctttaactaccaccccctttctttaatgccttcacaaaaagacctttaaaagtaagatctacatttcctgtctccacttctttagctccctttctctcctcaactctgctctaattttcttcagactctatatcactccacttaaacagcctttatcagagtcaccaatgacctacatatttccaaggtcgaagtgtattcagctaactgaactattgagctgaattggacatggtcaatccttcatacttctttaaacactttcttctctaggctttgtgatcccacactcacctggtttgtccttacctttctgtctccttgtctggctgtttctcctcgacatcagattttggcgtgctctggggttcttatctctattctgtctgtactcttcttggatgaactcattgagtcccctggctttaaaataccatttataygcagaaaacttcaaatctctatctctaactgacttctcccttgagcttcagactccataactctacttgtatatgtaaaaagcacttcacacaaactgtgacccaaaccaaactattgatttagtctttctctaccccgaattccttcccctcaagtcttccctatcacagtaagtgctacctggcctcctagctattcgttcaacgcaaataattgagtcattctaatattctttatttccctgaaaccctatgtgtaatctctcagcaagtcctattgactttacgtctaaaatatatgtcaaattagactatttctcaccatctgcactgctgactatcttattccaagctattatcatgtttttcctgcccacactttttccctctacagtcagctcttcatgcagtagccagactgatctttctaaagccataaattataagtttatctctttgctaaaccctcttaccatgagctataaaaccctacatgatctggtcccaactgcctgttcagcatcatctccctccactctcagcctcatccatgaagttcactggcctttttctccctcaaacttgctcaatactttcagatatgaagaacgttcacttacttttccttctgtttggatgttcttcttctggatctacaatggctgcatcatcttgtcattcaggcctcagttctaatgtcatttctgtagagcaagttcacttgactgatgtaactaaggtatctctctttagaaccaggtaagtatcctaacctctcaccagagaagtgttttcattatgttgaattttagtgaattataaattgaaattgtctcttgtggtttctgargacattatttgctctgtcacttggtggccttttctataaaaccccatatgaggaattcttttaggtctaagtgctagaaaagctttgcttcccttgaggaattgatgatgacacaactgattttgctttgttttatttggctttgccaacacgaagctcagagccaaaattttggctgctttattgcaaatgtgtaagaatatatgacttggttgtctgtctagacagcagtgtctaatagatctttctgcaatcacggcaatattctgtatctgaaatgtccaataagtagccactggacacatgtggtgactaagcacttaaaatgtggcttgtgaacctgaggagctacattttaactatatktaattttaattaatttaaatataaatagatacatgtgccttgtggctgccacattggaaagcacaatcctatatatcctatggtttattgataagatattgtagtttatttttatgtactcttcattattcattattgtatttcctataaattacctcaaacctttgtggctggaggtagaaaaaaaaaagaaaggaacaaagcacaattaaatgaacaattgactttgcagggcatgtcagcaygttcatagggttgaaggaagtggcaagtatacagcaacagtggatcttaaatcctatttctccttgtgagatctatggaatgggcaccagcatcaagttggagattcaagttctagttcttgttttactgttggacatgtgtggctctgagtcaaccagaggtttagtatgttcatatgtgaaatgggacttctgtattggtgacctgaagcctttggcatctgagatgctgatgtacaaccgctgtacccatttctgtgccttccaaagccaagcaggccagcccttggctacctacctaaaataggaggcaatactttgagaaatcatctcattcaagcccatgcttcaagacagagtcaccggtaaactaatttaaaacaaataggaagagtcytaccttccaaatgtcttctggtggaaaataattcatcctacatacttagtaatttggatgtttttaatacagaatgaagtatcataccccttagtatataaaggcacaggactgaaatcagaagacttaggttctagtcccagttcagctactaactatctgtgtgactttgatcaagtcaaagtttcttctttgtttaaatgagaagattggaccaaatgatctttaatttcctgtttagcattagccataaccatagctaatatttattaagtagttggaatgtactgaaatgcattaccttattttgtcctatggccactgagaatattattattcccattttaaagatagaagaaactgagctttagtgtttcccaaagacatagagttggtaaatggtagagtctttatctgaacccccgtggtctggattcgggacccactttcttacctgctttgtcttctctagaattttgtgatttttataggccagaacactcttgttattctgattagacaaagagttgacttaatcctttaaactgaactttcccaaatctgggtttcaaatgggcccaaatagtgtctcttcastctttggagtggccaggaagagctcagcacagccacaattaatgagttggttgctaccgggcaagagtggccttgttctttcacccagtttgctgtacaaataataccatgttctaggtatgctgtatataaaaaaacattgggaagcatgtgaatttagatgtatgtcatgacaagggtttagcttggacttttcacaagtcatatcatacacatttcacaagatcctatcacaaagagaaggtttatcccacaaatctcaggcatcacttcttgaacatggagcacctcaatcattcctgtgtctccaacttgttgatttcagaagctgatcctaagctcatcttcaattgtaaatgattttgctaattgttagaaaagcacattgttagaatagctaattgttaaaacagttggttagaatccatgggagcttcagcaattttgagttcaatcccaagagggaagaggattttcttaaggtcaatgtcagagtttggactaaatccccggtctctttcatgcccaagaaagggccctttttcccttttctgactagtagtcaggtttacttccttgggagatggaacaaatgaaacataactgaaatttcatcttgcctctgcagatgtcaggagcaagggagcaccagtggtagaagaacctgcctcccctggctccatcaaaggccacaggcccatgagaatcacccggcctgctctgagcagcacactcggaggccacagccrcgcacaggaaagtgagaggaagtggaaacgtgcgagcagagggctcaaagcgacgggctcaccaccggaaaaaaaaaataaaaataaacacgctcagaaatagtgtaactgatatgcaaagaagatcaaaacaagggttttaaaatatcttggctgctttagaggagatgggggtggtaattaaagcgaggttgcaaatgcgtgttaggggagtggggcggttaggtggatggttcactgaagcctgccaggacatgggagcctgggagcccaagggtatttcagatgaaaatgtggcacttatatgtggaatgtaaaagaaagttgaactcatagaagcagagaataaaatggttattctcagaggctgccaggtggtgggactggggagatgttggtcaaaggacacattttaataaattcaagagattcattgcccatcacggtgactatagttaacatcaatatattttatattgatataaatatatatatatatatttaattattttgttgggctttttgtttaagttccagggcacatgtgcaggatgcgcaggtttgttacataagtaaatgtgtgccatggtggtttgctgcacctatcaactcctcatgtaggtatgaagcccagcatgtattaactctttgaaaactgctaacagagtagattttaagtgttcttgccacaaaaaaataaggcgctacatatgctaattagcttgatttagccattccatagtatagatatatatcaaaacatcatcttgtacaccatacatatatataattttggtgaattaaataacaaataaagaaagaaaatatgagaggaataaattcccatgggtaactcagaggcagatatggacttgagagcaagaagcccagagtccctcaaccccaaactctgccctccccagcccttttactgttccctgagattctgctccatttagagtcctgtacatttgtcccagggcagggctcagacaggccagcagtggaggcaccaggaagtccacccaacttggctgaacttcaaggctcaagttccagtttggaacaaatgttctagggttaatggctggggctgagcaaactcaggaaagacaatctccccagtcttgcaaagtgaaattctcttttctttcagtgtgttgtgaagaactacagaaatgtgttctcattaaaaaaaaaaagaaaaaaaaagattttattttgaaactggttcctgaaatgggaaaccaaaaggttagtgatggctgtgctggccgtttttagcctccctccaccagtttaaccatccctaataatagtccaagaatcacaagacatttccagcaccagaaggtcatcagtcaacagcataggtgcaaaagggagcgtttgctcttctacagatcccaatggtctcatgtattttaacagatgaaatgctctgaaggtggggttgggggcggcctggcctttggaaattagtcaccactcacatagttcttgcatttacacttacaaagcactttcacagctattatccagtgagatgggctgggcagagaaaattacccacattttccagaaatctgagactccaagtgaaatggctcaaggtcatcgctgttaaacccaaagcactgggtgtgttctttccggggccttgaagaaccacagatgggaatcagttacctttgctctaaacttgagccatccctctagatgtcttcctttttcttcccacccttcctcctccttctatgataaagtagggtacaattagtattttgatgatgaaatagaaattttatacctttgatccaatatttttttcttctgtttctcttatttgtctaaccatgagaaggcaagccctaccctaaactatttttgaacctgatatttagtaaataaccaccagcagatgcatgtgagttgaggtgggagacccttttctgagctgaggtgggagacgacaggtaaaggctagccttaacttctgcctgatgcacatttgctctctaggcctagagagtattatggtttacacaagctatggaatttaagaagagagagctcactgtgtgctgggagcatccagagatattctagcaatgggtgccattattgaagaagcaccttgaagatggatctgtggggtggtgtggggaagcaacatgataaggtccaggccaagtgtgtagtggctcatgcctgtaatcccagcactttgagaggccgaggcaggtggatcacgaggtcaagagtttgagaccagcctggccaatatggtgaaaccccatctctactaaaaattcaaaaattagctgggcgtggtggtgcgtgcctcagtcccagctacttgggaggctgaggcagaagaatcgcttgaacccgggaggtggaggttgcagtgagccgagatcacgccactgcactccaacctgagtgacagagcgagactccatctcaaaaaacaaaaagcaaaaaacaaacaaacaaaaaagttaaggtccagaggtttaaaaagtgcattagacattgtgggaaattcacatagcttcaccatgctgacatggtggaaataatgttagggagatattatggagtcatactgtggagggccttaaaagacaagcagagtcattggaattttatcctatgggcatttaggagttgctgaaagtttgtgaatgggagagcagkcgaagaagaatggtattctagaaaactctttttagctgggtatgcaagatggaaaataacgggagtagctggcagaagaaagattataaggaacactgaacgtggagtcaagaggctgactataatttctaaccttgattaggttagtcccagatataagcataaacatatatgattatctcctctctaatatgcaaacctgtgtggcctacccttcaggaggtcctgaacatcccctgaattgagggaggttagagtgctttgtaaactctgaaactacagaacaaacatgggagatagtgatgcagcctggcagatgcattgaaaacatgggcaggttggtgccttggggatgggtggttggagggaaggttgagtgaatgccagctctccatttaggaagtatctttcctctggaggagtatcccctttccttcctggaaacttctgtgtcacctggcacagactgggggctagtggaagatggaggcatgtcaagctggtagtcaagagtcaaagacaagaaatccctgaggtctctagtaacttcctcaaggggaataaaaaaaaaaaaatgacaaagctagccctttaaccccaagcttgaaatcaaaataaacagttgggttactgttttgcagagttgctgagtaattgtaaagggcaaagaagagtcagttttcacaagaagattgctcaatggaaaggttttgccagtggaggtgtctgggaaggtacaagcagaagccggcttagttattgtaaggagctgctcattggaagacaagccttggcctcatggagaaaaagggttaacatgaaacagtgggaagcaaactgctgaactgggactaggttaggagggttaagagagaagcatctgggctttcagccacccttgggcttctagtggaagcatttcacaatctcctttcttcacgggttatgtccttaaattgaacagccagtgggggcatcttggggtagtggaaagtgtgttgcaggcctggcttcagcactgcctggtggtgtgacccttcctctctgggccagggttagactagatgggatgatccctggggctcctttcagatctagacccctaggaggtgtggggcaggcgcagcctgttttatcagatttaaattcagaaaggacagctactgtaaatgaccaggctttagtgctggcagtgacagctacataaggaatttcaaataaggtcatcttaaagcaaaagcaactgcgtgcttgctgaccaaggcttgtggatcagatgaatcagaaagctgggacccttctgagttcatgcttaccaatctgtggggttcagtgtaactagatgatactttccctaatcaacatcatgtatggggcagcaagttccctttgaactttagagaacataagccacagatgatttccctcccacttccattttcccttctcaagtcttagaaaataagatctcttcccttcccctttcccccatttcccaagcaggttctcagtgataaatgtgccactttctctcttgcactcacttgcccttgtcctttctggtgaaaagaactttaccggtccaggctttgggaagtagggtgtcggggcatgaagacaaagttcacaaagctcgaccagctggttcctctggtggcccagactgggctgggttgtgttgtgtgtccacacaggcagagaggtaccacagtgaggtactcttttatttctgaagggaaaccctattcttccagaacagttcacaatcaccattgacattttctggccctgcctgcagaatccagagaaacatccacatgaaataaagctttaccaagtgccaggattcagttttagatgaggcaaatgacccacaggcagataaagaaggagacaggataagtggagaagtcactgtgataccctgtagcatatggggatggccctacaagtatagggtgacttcaaaagaaggaggaatcacactcagattgaagatcagagaaggcttcatggaagagatgacatgagctagaccaattatcaatgacaattatcaatgtcattattattttgatgattatgattaaagctaacttttgttgctctctcactatgtttgaggtactgtgctatgcccttgtatattatctcagttcctcttcatggaaatcctcccctgttagatagcatcattttgtagatgaggaaattgaggctcagaggtgataaattgcttttccaaggccacccagagagtaaatgattagagcctgtgatttccatagaggtatggatgtgagatattcttagtggagggtaagaatgactgattagagtgggtacatcataattttgattgggtagggaatctgtgggagttaaagccagtgggacttgaagaccagtgagaagttcaactttgtctgcagactgcaaggagcctggcagcttttgaggaggacagtgacataatgagaagatggcttttgagatgctaatttagcctggagtgcaaatggactccagggaggactgacggcgaggggatggactcagaactggagtccaatcttctgagaggtgatgaggggttgagctaatggtgccaggcaggaaggagagttagagaagcaaccttagtctgagcagttgtccgtccatgcccttgcttccagcaccaaaggcacagcaagtagaaaagaaagtaaataaagacagtctgcatgctggtgaggttccacaggtttctcgggagcttgcctgtcactcatgtctgatgtcaggtgctggtaaggtggctgccagtctttcctcaccttcaggtgcagggcaatgcaccctctgaattagaccactttaccagtccaatttgtatgttttctccatcactcttgtctccccactcccaaaaccccaaagaagtggaatcaaatgaatcagagttgttttctttttgtttttcaagtggaatcaaggtctgaaggagaatacctgggcggaaccaaagatgggatgctctgaatcattagtcaccttcagggcatcaaacaagaggtgaatcagagagacagggagaagggcaagaagtaatgagctcctggcgcacttgtgaatttcagaggccccatgtagaccgctagtgggcagatgctctgcttccaagctcctgaggttcctcctgcaatgaatgtggctaaggccaaggaaacactaaaaattgcagtggtttttgactcagccaggagagtttagtcacgtgtagttgtactcttccttggtgcttccaaagggctgctttgacatctcagagagcagtacagagtggcatttccaggcctgccatcaccaggacagtgaaagaaaggggtcctaaggactatttaatccaatatgtgaat

SEQ ID NO: 17574 - DNA, 156318 bp, Homo sapiens
  misc_feature (1)...(156318): n = A,T,C or G, or insertion/deletion polymorphism (see Tables 1-2)
tacctcagcccaccaagtagctgggaccacaggcatgcatcaccacacccggctaatttcatttttaaaatttttcttgacacagggtcttactctgtatgcccaggctggagtgcaatggtgtgatcatagctcattgcagccttgacttcccaggcccaagtgatcctcccacctcagcctcccaaatagctgggactacagccatgtgccaccatgcccagctaattttttgattttttgtagagatggcgtctcactatgttgctcaggctggcctcaaactcttgggctcaagcgatcctcccacctcccaaggtgctgtgatcacaggcatgagccactgcgcccggcctcctccattagtttacagcttctcatgaacttagaacgtgtcttagtcttctttgaaccttaacactgtgttcttacacagctacatacttttcttcaggaagtgtaaaatggttgccttcgtgaaaaatcaagtaggaaagaaaaggtaaaacagagttaaccccaatgcttaattcttgtgtctttgcctgttttgaccttttccccatatcttcccctgtgtccctccaaaccacagttactgcacagctgataggctttagtgcaatcctgtatctgttttatcccttttgtggtgccatttgtagctcttggcatgtgggttttaaataaatatttaagccgaatattggcaagttagaaagatagtaatggagggaaaatggacgctttttctctgtgttgaattactacatataacagggtagttttgatatactttgatgagcccagaattctcacatgctttttaattcaaatcatattgagagtaaaaacaagaaataaaaaaatcatttctgcattatattgcaccatcttggcaataagcaaattgtgagatctctgaacactctgggatggtaaaaattgttattatttctctcttatgaaaacccacaactttaatacatgaatagttaacttgtcttcattctggttaaactttgggaaagaagagataggcacttgattcactggtgttggccggatagaaagtagcaagcatccttaaaatagaccaatgtcatcagccttataaaattgttgaggcaaagattatgctcagaaataaaatatctgaaaaatggcagtttttttttgcaggttaattttttttcctagtgccatctacctattgcataccctttttattccccatggaaaacattctgaaaggtattttcccacctaaatcacctctctcaacatgttcttttttttttttttttgtccttgtatagtttctcttcttttcctcaccccaatccacttgtagaaactgatgtcttttctctattgaattttatttttaggaaatttggttcagtgttacctttaggttattttaaatagtaataatagcaactacaatatcaacaccacatagaacatttaactatgtgtcagttattgttctaactgctttacattgccaggtgtggtggttcatgcctgtaatcccagtatttagggaggccgagctgggaggctcgctttgaggccaggactttgagatcagcctgggcaatactgccagatcctattgctacaaaaatacaaaaatcagccaggcatggtggtgcacacttgtagtcccaggtactcaggaggctgaggtgggaggatcacttgagcctgggagtttgaggctgcagtgaactatgattgtaccactgccttccagcctgggcaacagagaccttgtctctaaaataaataaataaataaacaaacactaaactactctatgttaatatttaatagccataatatccctaaaaagaaggtactattcttagctccatttgctagatggggcacttgacagcacagagaggttaagtaacttaagattgcaaagccagtaagtggtagagtcaggattcaaaccctggcttcagctgcagaatctgtggacttaatcaccagactaacctctaggcactagtagatattatcctcatattatttattttttccttacccacaaatatcatcctggcccaagacctcattttcattcattcttatgtatcttggcctttcagtggtgtcttcccttgtgcccctctaaaccatagttatctcacaactgatgaactttagtgcaacctagtaccttctttagatgtttctaagaggtgcagggttttttgtctcaaactcaagaaattacctccactctatatcctcagcaggagacagtagactattcattagttttagaatatatcagctatctgggatgccctttgccctccagcggagggctaggtaagagagaataaacaaaaaagctaagaaatttctggcaaataacctttcacctaggtccccaacccttccatttccccaggcctgaagcatatctgaagcaggaattcagggggtcccaggatgtcccaggaaaagaactcctttaggaacaggaaaagccatatttttctgggtacagtaggagtgacgcagtagaggcaggttcttgtggattaatctgtagcaaagctatgaatttagagttttgcaaagaaaaggacaagtttatccttaaggtagaaccagctttgacgaatggctagtgctgcagggagccataaggatagagaagacagaacttccatctagtcttgagtctgagaatactagaaaaaaggaaggaaagagattactagaggagggtctgaagacctggtgaagcaggaaagagatggaagtacattcttctcctggaaggagtgcaaagaccaagcctcagaactaattccagagccagaagagaggaaagaggccttgggagtccctgagaatctcacctgtcagaacagcggtgccagcctctatgggttaggtcacatcagagaagatataccgggggctatggacttaatctggcccacaggcatgttttgtctgacatgcttttgtgttcttaaaaaaaaacagaatgagttgtcaacatttaatatttgtgaggtttcaccccaaaactcagattcctgacttctcttgatttcctaaatattacattcccccttggaaaccatcagctggaagtgtctgtgccctttagatttgcttgagctgtggacctttatgtttaggttaaaacatcaatctcaaaagtttacatgctgtatgattccacttagataacatttttgaaatgatgaaagtatagagatggagaatagtttagtggttactagaggacaggcatggagttgggtgagcggttgcagtgcggaaggggatttgtgaataccaaaaggtagtatgagggagttcttttgtggtgatggaacagttctatgtcttcattataggagtggttacaaggatctgtaagtgaggtaaagttgcattgaaccacacacacacacacacacacacacacaaaacagaacacaggttaagaaaatggcaagtaataagttctgaagtctatagtaaacagtaatgtactgttgtcgatttcctggtgtgaaagttgtcacaatcaaaatggagttactaatgttaagaaaccctgacaaacagagctagggaaggctgcctacgaagagagggttcttacatttgtatacctgataacaaaaactatcaaaaaaagactgcaaaacccacaaccttgcacaaaggccatcacaaccttacataaaaaaatacttctgcaaggacatctccccagcaaatgcctgtccaacctcggactggcgtcacccttgttattgatctttgtagtcaaggataattatttcaaaacaattatgtaatcctttccattttttcctttaaacacctttgtcttcctttacatccctgaatatgcggttaactgtgatgtgtatattttcattgcaatgctctattcccaaataaacattattttcttttagaaagcctctctgttatttaggttgacactgattttgatgtcttactagagctttgtaagatgtcaccattggggaaagcatgggactctggactatttttgcaacttcttgtgagtctataattatttcaaaataaaaagttaaaaaaaaaaaaaaggaaaagtaagtaggctgagtacctacgggtggtgtttagggaagtgagcaagaggagcatggagagccaacctgaagctgagaagtttttccagtttaacttataaaggacctaagcttgctcctcaccatcgcttttgctgttactatccctgtagtgctcttcgttctgcccattttagacagctgtttctctatcgcttgttaggctgctgagcagagaactagatctattcctaatagcaaaccaatcaatcctagcccattggatgtaacctccaggccttgagcccttttcagttattagttttcccactgcctaatactgagagtcggctttcttgctgccagaggtgtttttcattatgacgtctgaatttgatgccactgcgggtgctagaagttgccagaaggctgtcctccagataactgtcccttggctctaacttgtgtcattgttttgttgcaattaacattcagaatatgtgcggtcatcttattaaaatttatattttttaatggagaaagcacacagagagagttgattgtggagctgtggtttactcttgctcttagttacctgtgtctaaattaagctgaacctctgggccttagctatttctaaacaggcatcacgatttactaaggttaatgcctgagggaacattaaccttgcagacactaatctaattcagtgtcatcacaagtgcataatgcaggagtttggaattttgccaaaaagcactattcaaatgaacatttagttggcaaggggtgggaaggcgggtgtggaaaagggaaggagaacaccagaaatggctctatagatattttcatgccttttcttttccctctcccctcaaaggttacgtttaagtattgcagagaggcgctaaatggaatcttcatattattatgaagaaatcccaatgaacgcgttttatcccacggcaagttccagatgctcacaattactcaacattcactgagcatcttttatgttatatggctgaccttgtgctagggtgtgtacacaaagatgagtaattgtaaacgatggcagtatgcagaagcacctcagggcgcctaatgttagctgacgaaggcaccattaaggaggtcacagtttggctaaagggcccccaaaggatgagacaacygtgtaatcctagctctatagagatcattaccaagtctttgccatacaaagtttgggcttcaggtgaaatgagaagggcaaggttctgcccaagagggtccagggccggatctcttgatctgtgtctatgcccacaccctgcatctcagcttgcagacactaatagggtttgccagtttcaagggcgcagggctacatcttccggaaaaggtggcatttgaaggtggtaagaggccaacgactggaggtggcggcgaagggctaggtaagacagaataaatgaaaaagccaagacatttctggcaaataacctttcacctaggtccccgacccttccatttccccaggcctgaaacgctcccgaatccccgagtcctccactttccaagcgctgggcattggttaaggctgtaggagcagggagtcccccgctctaagagagttcctcagttccgatctttttcaaaccgctttcctcccaggcccagcctggggggcctgcggctcgggtccagcttccacggccaccctgggctggtgacacgcaggcgccggaatcgaagccacgctgtgtctttccagccaggtctctgcgccagacgagggcgggcgccgcggagcgcttcccgtgtgcggggcttcccacaatgcaccgggccggcagtggcggcgaccgcggcggcgctctagctgcggcatgtctgcgtctctactgctctgggaggaggaagagaaggaggaagaggaggaggaggaggagggggaggaagaggagaaaggcgcaggggtgggagctgttgccgaagctgccacagcaaaagttctcccccctccccccttcccctcctctcaaggcccctagaaaggttggagctgccgccgcctgcagtcggtgaccgcgcgactcggcgcccgcccgcggtaaagcgctcggcctggcaggcccgggcccgggggagggcgggggagggggagggggcggcgcgcggggggagcgcgcggcggtaacggcctgaccccggggggagcgagccgtggcgaggctgggggtggccagggggccagccgaggccgagggaaacgctggggctggctgggggacgtgaggaagcagggcgcggagggtgggttggggggttgaggagggataatgacgggggtggcggaggcgagaaggcggcctccgaggctggaggcgggtgtcagaggtaggggaggaggtgggatgtttgcacggggaggccggagggtgctgggtgtgggtgtgaaaaggctagggagacaccagggctctgtccaccgtgcctggtgcagtgctttatgcaccgcaggcctcagtcactgttgctgccggagtgtgctctttgggagaagggaagggcaggggttggagaaaagggaatgcttgcaggaaacgtagtgggagtgcgaacagggcgaggggccggaggaaagatgccggagaggtggaggaatgcggggaggtggctgtggaggagtcttgaggattctggggggtgttcattgtgcagatacgttaggtatttcattatggaaagaactgaagcgtttctcagggaaggaaagaagggagataggagttcccgtgaatagaaaggatcgcgtttgaagcaagagggagtgctaaatagtagagaagatgcagggaatgcataatagaatagacagatgtagtataattaataaatattggcctaagtactgaagagttattccagatgggccgggatggcctagttccgaacctgtgtgggctgttcagtagatgacatctggtaagtgtgggtctgggccgtggttggggtcactgagaattagattttagtctgtagtttggtctgtgacattttagacgtgcaccaatgagtatgagaacctctgaagcagaccttgagaaagggtctggcctgtggggattccttaggctatggagcttcgattttagaaaatttgaagtattaacacttacccgaggttgggtaaatactatcctggcaaacgctggaatggaaattaattgacttggtggttttcttcactgcccagtttatctggtccaggagaattggtgccgtattattcagcctggattgcagtacacaagattataattaatggtcggggggaagacatgcttgctggctcttctttagatacttcatttgtagctcaaattagttggctggattggttccataaatctgtggctggtgggagatcttctgccattcacagttcctgaagtgaactgtgagggagttctccagtgagagaatactctcattcaggcatgatggcattgaagaaaacgtatcagccagcaaagtgtgggcctgcagaatggaggagctagaatatctgttttggttttaggttgcaaggaggtcaggactagttatcagaaggtctaggggaacctaggagactggacgactctagagccaggttggagggaggattagcatctctatgtcaggaaatgaaccaagctctctctggatttgctgagctcacaccagaccagatttccaagagggaactctgggctagaaccatactcttaaaaactacccggatattattcaccttttattaagaaaaaactatatacagctggggcgcggtggctcacacctgtaattatcagcttggaaatggcacatgaggcatccttctggaagttggaaatgtcctgtatattgaactgggtggtggctacataaatttatacctaagtgcccttaagattggagcactttactgtatttatctcaataaatacattttcaaaatccaagttagcctgaatttttgagatagtctgcctacttcccagctttatttccctccattcctcaacatgaaccctaaattatagctaatctannnnnnnnnnnnnnnnnnnntaaacatagtatgctgtactcaattttattgtcatcatggcatgagaaggctagtcttcccttcccttttccctcaccagcactgtatattatctgttcttttaatttttgtaagcagaatgcacttaaatatgtcattattgtctttctaccctttttaaaaaaatttttatttatttatttttttgagacggagtttcactcttgttgcccagactggagtgcaatggcgtgatctcggctcactgcaacctccacctcccgggttcaagcaattctcctgcctcaacctcccaagtagctgggactaaaggtgcctgccgccacccctggctaattttgtatttttagtagagatggagtttctccgtgttggtgaggctggtctcgaactcctgacctcaagtgatccacccgccttggcctccaaagtgctgggattacaggcgtgagccactgtgctcggcctctactcttttattataaaattgttctgagggaacttacaatgaaaaacagcagcccctgtctcacctgcctattgcagttccactttactgaggctgctacttttaagcattaattttgtatttcttaccatgcttttttccatgtctccaagtaatgggcatataatattatttcttgatttatcaaaatgacattatcggagtcagaagatgtttatgaatgtgtcattgacattatcccctttctcctcctttctgacctttgatatttattttagttattttattcagtgtgtttatatttttaaataatatgcttaaaccttgattttagaatccaacaatcttaggctgtatctcttgatttccccattgtattttagggatttagcctaggtatggctttcctgaagtagaaagaacattgacaattagactaaaaatgctggatgagatgataaagagaagtttggatggacctatcagaaagaccatgttgtaggaaccatctttgcagtgtaagatttgcttgttagagatgaagaggagttgcttgacaatgatagttgttcatcttggaattagttaccagattgcagtatttttttttttttttttttgagacggagtctcgctctgtcacccaggctagagtgcagtggtgtgatctcggctcactgcaagctctgcctcccaggttcacgccattctcctgcctcagcctcccgagtagctgggactacaggctcccaccaccacgcccggctaattttctgtatttttagtagagacggggtttcaccgtgttagccaggatgatctcgatctcctgacctcgtgatctacccgcctccgtctcccaaaatgctgggattacagtcatgagtctccgcgcccggcctgattgcagtattctttgacagtcttctggagagttttagtgtgggaaatctggaaatgcattaaaatgacccttgaatgttttttctagggttctgtggcaattcttttttttttttttttttgrgacggagtctagctttgtcgctcaggctgaagtgcagtggcacgatctcggctcactgcaacctctgcctcctgggttcaagcaattctcctgcctcagcctcctgagtagctgagattacaggtgcccgctaccacacctggctaatttttttgtgtttttagtagagacagggtttcactgtagatggtctcgatctcctgacctcatgatctgtccgcttcggcttcccaaaatgctgggattacaggcgtgagccacttcgccctgccccccccccyttttttttttttttttgaaacagggtctcactttgtcacccaggctgaagtgcagtgcgcatgttcccagctcactgcagcctccacctcctgggctcaagcaatcctctcacctcagccccacaagtagccgggaatacaggcatgagccaccactcccagctaactttttttgtattttttatagagacggggtttcgtcatgttgcccaggctggtcttgcactcttgggctcaagtggtctgcttgcctcagcctcccaaagtgctaggattacaggcgtgagccaccgtgcccggccacaattcttatgtttttatttttaggaggtaatggattggcatatacatgtgttttttggggggatgtagtagggagagatgggaaatgtggtaagaggaggatgaggatgaggaacagggtttgatggaggtggtgatacattttgaggaggctgaagaaaaggtaaagaattttgagggggatttggatatagttaatgtgaaggaggtttaccttatggtgatgagactaaaatttttgtcatttttaaggaaattagcatgtttaagtcactaatatgttgggaatgtggtaggaaaaaactatactgggcccaatctcctctgttaggttagagtcataaaatattaatgtttttgaaatttgtgtatgaggtgcaaatcactatggtggatgttgggagattagaaagataattactccacttctttttgggagtctaagtaatggcaactcttgagagtcttccttactttcagtagtaacagtattcacatgtagtttatgtattgctaaattttgtatttgtgacaattattctctttgttttgcaaatggtacattgtaacctgttctagagcagagacttcctgtagtctctagggaaactaacagcaggttgattcttaagtgcttaataaatacctgttgaatgactgatagaaagtagtgttcactgttagtgataatagtgggattgtatgaaattgctgagtactttgggggtattgtaggcaaaactgtgtgtgtgtgtgtttgacagcgtgaaggacaaaagggatatctggagaggacctttagatttaagggaagaagacagactggattagaatggaattgcagtggttctgtaacaacttggaagaggtgggaccaaggggtctcttctaaatttgaagctagtttaatctggagtaaaatctggtctgtagcagggtgctggtttaatttagattttttttttttacctcaggcataaatgactgttttaggactgtctgatttaattcttttttaggatagtaaaaataacagataagcttcttctctcaaggaatttgtagtatttacaatttttttttttttgagacggggtcttgctctgttgcccaggctggggagcagtggtgcgatctcagctcactgcwgcctccgcctcctgggttcaaacaattctcctgcctcagcctcccaagtagctgggattacaggagcgtgccaccatgctcagctaatttttgtatttttagtagaggtggggtttcaccattctggccaggctggtcttgaactcctgacctcaggtgatcctcccaccttggcatcccaaagtagtatttacattcttttgagagagaaagacagttgtgaaataattcagtaatggtataagatttcagaaagttgatttttaaaaacaaatatcaaaattatatctccagataagaacttttatatttcggtggtcattttcagtagcagtgttcagaatgtttttagaacaccttttctgaattaacttctgagtacaattctatagaatttacctatttattgagtatctagtgtgtgctgttgggggaaggggtctataaaggtgagcgaaacatggtccctgtttgctaggagttcataatcccttcaagaggcacactttttttttttttttttttttttgaggttgcagtattctttgtcttctggagagttttagtgtgggaaatctggaaatgtattaaaatgaccctagaatgttctttctaggcttctatggctttttttttttttttttttttttttgaggcaggatctcactctgtcactcaggctggagtccggtggtgtgatcttggctcactgcaacctccgcctcctgagttcaactgattctcgtgcctcagcctaccaagtagctgggactagaggcacacaccagcacacccagctaatttttgtattttaagtagagacacggtttcaccatgttggccaggctggtctcgaactcctggcctcaggtgatctgcctgccttagcctctcaaagtgctgggattacaggtgtgagccactgcgccgagcccaagaggcacacttttgtttgtttgtttgtttgtttgagatggagcctctctctgtcacccaggctggagtgcagtggcgccatcttggctcactgcaacctctgcctcccaggttcaagcgattctcctgcctcagtctcagagtagctgggactacaggcgtgcaccaccacttctggcaattttttgtattttttagtagagatggggtttcgccgtgttggccaggctggtgtcgaactcctggcctcaagtgatccactcaccttggcctcccaaagtgctgtgatttcaggcatgagtcatcacacccggccaagaggcacacttttaaataatacatggtataatcttattctgaatggtcttattgatgacagatctttttactttgaaattttgatttttagaaatgctgaaggttagtcaatatcaaatagagtgaatgaaaaatagttttgccttaaatccagttaatcacagaaacgggaataattttcttggttgacttattagctgattttgaaaacactcccaaggaggaagttggaaatattttgaacaggggtgatagcttcacatgtagttagttaggcactacataaatgttggttgagtgcatcagatggttggatggatggagtgaataaatgagtaagtggtagccttccaaagtaacttattttaaagaggaccatactgatttgaatgtgtaaataaattttttaaaaactcatttttctcagatgaaataaattctgagtatgtttgttaataattttattaccttgagcaagatagtttaagttcacaaatgagttttacagacagtaagtgctgtaggagttcagggaatggagaaatgaacattggctaaggtttggtgaaatgatttaagtgaaccatacttatatttgaaaagattccttagggatctcagagaggaactaaatgactccaaattcctcttgcagccctaaagtgaacctagagtctggatctatttttgtctgaatgctttctgcctgtttcattttagctactcctactggtttgttcctttcagattcacatttgttggtagatgttgagccccctgaaacaactatggggtctgttttccgtcttcgtatagtgtaacttttagttgttcttttatgagcctgtaccccacaaattacttggccttcatgagagaagagcatgagtcaacttggccctgttatcctggcattttcctgcatgcttttctcaaagctgctttctgaattacggaatagaatagacagaactgagggcatgtgtccagtagacacgagcttgttgaatgaatgaatgaatgaatgaatgagatatttgagataatttaggagatctgaattgtctatatgttttatgtttctttttcatttattcataacctgcctttttctacaaaggacttaacagggctgccaaactatatgcactagcaatgaattgaaataattcaataaatctggttaaagagatgatgaagaaaagaaaaatctgtttaaagaatatagatcaatgtgtatcggtgttagagaactaggaataaggtagaagataagcagatggggaaggaaaggtggtatctgatagaaagcatgattctgaaggagggaaaagattactgaaatatgacaggctatctttggaggaaagcatgagaagatggagggtaaagaggattatttgagacggctgttttgaggaggaagatggtaaggctatttgaaggataagagtcaacagaagtttggaatatagtagaagttattaaattatgttgatttataacaaggtttcagaaaatgatgggatgagctttatttaacagataatgcacatttgttatatgcaaaagcatataatgctttgctgtcaggaataaaacctttgggatttatattgtggtagggcagctggacttgtgcacaaatacctgtactataatcacaaatatatctgtgagtcacaaatataccaaatattactgaatttaaaaggcagaaaatgcatttgattaggagaaaacctgagacagaactttaaaggcataaaagtggaattttagctagtctttgaagggattgataagatttttttttttaagttttggattgataggattttgattggcaaagattactgaaagagagcattcctgcctgagagattagcgtaagcaaaggcttggaggtgagaagcccaggagatgtggggaatggtgagttaggttttaatttttaaactatgacctatagtaagaaatacatgtcacacttctatctaatatatgcatgtatgaatgtttgtgtgtgggtaaaacaagaagtttcataatacagtaactgtccttaacagtggcaggtgcagttggatgttatctattttgtttgactaaaaagaaaaaaagctggccaagggggaagaaaaaaaagctgattgtcactcattaaactgatttcatgaccgacaaaataattaatcacaatctatagtttggaacgcagagagttcatgaataaggtataatacaaggtaggagagtcagttggggttgggttgaaaatggatggccttgaaagctaagctaagtagtttgtatttgatatgatgtagtgttgtgcttggtaagcaaacagaagctgggttttagtcttggctcttctgtttacccactgtatgattatggagaattatttcctttctgagtttccattttctcataaaattgataatcatactttcctggcaagggttatggtgaggatgtgagaattaaagtatgttaacatatgattaaagtatgttagcagaaatcattagtgtatagctgttgaacttttctgagtagagaattgagccaaggaccgtatattagatagctggcaatagctataccttactgggtagattgcgggtaatgtggtggtagagtaagattgtatgtgaaaagaccagttagaaaacaaaaagaccagttaggtggctactggagatattaagaagggcttgaattagtttgatagcagtaggattagaatatggaagtggaatgcagttggaggtagggaagaggggaagatgactagaaatatgctatttatttatttattattgaatgaacgaacgtgaggctcttgatctgttgcccaggctggaatgcagttgtgtgaacgcagcagctcactgcagcctctacctcgtggattcaagtgatcctcttgcctcagccttccgagtacctgggaccacaggcatgtaccaccacgcctggctaattttcaattttttttgtagagatgtggtctcaccatgttgcctgggctgatctcaaactcttgggctccagtgatcccctccctcagcttcccaaagtgttgggattacaggtgtgagccaccatgcctggctgactggaaatttagagttgtagaaatattcaaatggcagcagctgaaattggattatatttttgggtagtttagtgcagtacattagagtataattttagtttctttcatgtagtaggtgctcaattatttgttgaatgatagaaactaaatacgtggactgtgggatgaattgtgagtagaagcagtgatgggtggatgtgagaaggagggttagactggaggatactttgatggactgccagaatttattcgttcagggtatatttttatatttactgtatgcaatggactgccagaatttattcattcagggtatatttttatatttaccatgtgcaaggttctatggtagggagtgtgaaggatacatgtttatatatgacacagtccgtgttcttcaggaatttatccagggacaaaacatacacatccatctatgacacaagtactgtggcaggtttgttcaaggttggctttgtggagaaattggtgcgaagcttagaccttgaaggataaataagataataggcaagaaggtgagggttggctttcctagaagaaggagtgatatgagtgacagtgagcaaagttcaggacatgtttaggggttggtggtctagattagctataatttagggttcatgttgaggaatggagggaaataaagctgggaagtaggcagactatctcaaaaattcaggctaacttggattttgaaaatgtatttattgagataaatacagtaaagtgctccaatcttaagggcacttaggtataaatttatgtagccaccacccagttcaatatacaggacatttccgacttccagaaggatgcctcatgtgccatttccaagctgatatctcatccaaccaaaaataactattattctgacttttgtcataacagagtagtgttgtgtgtttttgaattttgtataagtggaacccaatttctgtgtctagttcctttttctcaaggagcatgtctgtgagttttatccatgttatgtttggctgtttattcttttttcattgctgtgtggtattctatcatatgaatataccacagtgtatttatctattccatgattattggatggtttcaagttttttgaagtctgaggtgttctgtttgtttttttcaggcagagtctcactcacccaggctggagtggtgcgatgtctgctcactgcaacctccgccttctgggttcaagctattctcctaccttagccgccctagtagccaggattacaggcatgtgacaccacgcccagctaatttttgcatttttagtagagacagggttttgccatattggccaggcttttctcaaactcctcacctcaagtgatctgcccacctcggtctcccagagtgctgggattacaggcatgagccaccatacctggctgaagtctgaggagttttaacttaagtcagtatgcagtggagaaccagtgttgatttttgaacgggtaaataagagactatttaagaatactaatctggtgacctttctctttttgtaatgaagagaacctggtgactgggagacaaagttaggaaaaagtgtgaagtaggctggacacagtggcttatgcctgtaatctcagcattttgggaggctgaggcaggcagattgcttgagctcaggagtttgagaccagcctaggcaacatggcgaaaccttgtctctrcaaagataaaaaaattagcggggcrtggtggcacatgcctgtagttccaggtgcacgggaggctgaggcaggagaatgacttgaacccagaaggcagaggttgcagtgagctgaaatctacactccagcctgggtgacagagggagaccctgtctcaaaarraaaaaaaaaaagtgtgaagtattgagggtataagttgggtagtcatagtgggaataaaaggagagggatagctataagaaatacctcaaagaaagaatgggaaggtttgatggcagataggcttttgggaaacagtagagaaaaagaaaactgaagaaaagctctagggcttttaatctgggtgactgagattgatggtgccattagtagaaattattagatcacttagcagaactgttttggggttttaagacacattgacctgtgtgtgaggcatcagtactggattggagctaagaaaagaagtccaatatagagttgggaatacatacatagagttgataattatatagctactaattttggatttagttagggcactgacggttatgaaattatttggactgataattgaagtgttaattgaagtaatagttgaagaatctagttaaaaagaaatcattatgcattccaattctagttaaaaagaaatcattatatattctaattcctcaggagtaaattggattgtaggagagggtgatggtttaaagattattttgggtagctgggggaagacagccatatgaagaatgaaaatgtagaaacagtggtgagggatgagaccctcagtggctgagaattataggaggctccaggtcagaccttgggaaaatatccacaatttgggctaggaagagcagcagtgatttcagatagaagaaacaaccagagaggtcagagtagaatcattacagtgacataaagcaaggtgggtagcttaagtgtcattgccaaaaagagggtaaggactggccaagcatggtagctcatacctgttatttcagcagttcgggaggctgaggtgggcatattgcttgagctcaggagttcgagaccatgctgggcaacatgatgaaacctcatctctaccaaagataacaaactttgctgggtgtggtggcgcgcacttgtagtcccagctacttggggggctgaggtgggaggatcacttgagcttgggaggcggaggttgcagtgagctggtattgaaccactgcactccagcctgggtgacagagtaagagcccgtctcaaaaaaaaaacaaaaacaaaaacaaaaaaagggtaaggactttggtgggggatcatatgatttggaacatagattttttagtttttgtttttttttgtggtcttcaagagagcagttcagagaccagggtgcatggtggtttactgagtgggttggaagaatatggaagcaataaatacaggaattgattaaagaagtttagtttgagaaggaagaacaacaactcttattctaaaactggaggcaagaagtaacagatggatgaagttacagcattttagaagctgtgaagaggatttgattacaggtggagaaggtgtgatttgagggaattttatagaagggttcgagtatttgttggaattagggatttaaatatgaaaatgatttggattagtcaatgagacggagagttgtatttagaataaatctgttgtggaagatttcatagctttctggtggtgcttaacacccagtgcgtgggcatggagaaaacagatggtgaggattgtctatcactggggagatgcatagtgagaataatggaaggtcatgatattctggagaggacagtgttaaaatggctgttggacaggtttaaattatatagggagacaataaagccaagtggaggtaaagagcaggtctacaactagaacataaagtagttgtggataaagaaaaggggggtggtctctgaagttacaatcctagtggattgtaactatttttttttttttgagacagggtctcgctctgtcacccaggctgcagtacagtggcataatcttggctcactgcagcctctgcctcccaggttcaagtgattctcctgcctcaaccacccaagtagctgggattaaggcatgagccgccatgtccggctaattttctgtatttttaaaggagacagggtttcaccatgttggccagggctggtgtcgaactcctgacctcaagtgatccacctgctttggcctcctaaagtgttgggattacagacgtgagccaccacacccggcctagcacttttcagttgatggctctgttttgtttctttgtggctagctgaagtgcagatgaaggtcttaggagtttttgaaggtcagggtgtagaaagttcttgagcatctttgttgaagtcattgagaataatggctgaatttgggagcaagcagaattgaagttattgggtaggggaaataggagggtgttctggaggttggtagatgttgcrgaaggaatggtttcagtgagtaatgtgactcccaagcgattttttagtgataggataacagggagtggtcctggggagcaagaagcagcaagtccttttttatcaagctgaaggagtaggagaatgatatagctagtcatgagagaagcagattgtccaggaaaagccaggtaagatgagacaggtggtcacaataattgggcaagagttgatagtgattggaatcattgagccacgggaattgagaaaaatagctagatttgttacatttaccagttctcttattattattattttttaatttttcagacagggtcttctctgttacccaggctggagtgcagtggtccagtcatggctcactgcagccttgcctcctgggctcaagcaattctcctgcctcagccttctgagtagttgggattacatatgtgtaccaccatacctggcttttcttttctatatatatgtatatatatattttttaattttttaattttaattttaattttttttttttaaagagatgtggtcttcctatgttgcccaggctggtcttaaacttctggtctcaagcgatcttccctccttggcctcccaacagtttgtttataaaataaataatacttgcaaaatcataaccattcatgtgtaatatgctgatataaatttagctgaaagatatttgtgggttaagaaatgagacattggaaacaaaagatgaggtggaggtgtattaaagataaggtaagctgagtatgatggctcacacctgtaatcccagtgatttgggaggcaggggcaggaggatcacttgagctcaggagttcgagaccagcctgggcaacatagggaaaccctgtctctacacaaaaataaaaaattagctgggcatggtggtgcacacctatagttccagttactcaggaggctgaggtgggagaatcacttgagccctggaagtcaaggctgcagtgagccatgattgcaccactgcgctcagcctgggccacagagtgagaccctgtctaaaaaaatcaaaaaaatacaaaaaccctgtctaaaaaaaaagatgaaggtaaaagacaaaagatgttctattgtttgttgacaatagaacatggagaagctgataggatctggtaaatagatggactggaaatgaatgaggaagttgaagttgtaggcataagagaggagagagtagcttgcagcagagaaaatatggagagaacatatggaaaggggtttaaacaggccatggtttgtaggggcgaggatattgacaagcatcattaagtgtaatatttttattaaactgggaagtagggagcccttgtattccctgggcttttgcagcccaggcccagttgtgccagctgcatgggcgggcctgtgctggcggtgcacttagcagctggtggagcagcggcgtggagctgcatggtggcgggtgggctgccgcccacttgggtctgtgtgctcttggcccatggcagggcaggcaggtgggcgctcgctgaagtgagcaggaaataactgatgtcagaaacctattctttctctgtgcaaataagaacagtctatgccacccatgataaaaggtggcagtatgtcatgccagcttttaaaaaaatattgtcagtgatagagacattgagatctctatttgtgtgcttgagaaccacatcatgttttctgtttgcaaaaactggcaaaaacttgcataagtaaagagattcgggtaaaatgtggaagaatggggcacatggtaagaatgagatgtcctaagggaactaaagtggactctttactttcttttttgtctataatgactttaataatcctgaagtgctgggattatagacatgagccactgtgcatggcccatatcagagtttttgatgttcatgtttcagagagagagagagaaagcatatttaatgtagaaacatgaaatggcagtgagaaaaatatgacaaggcacaaaatacgtagtattggtgttccatcctagtgtagctttgcttcaggattagttccaggatttagccctgggctttcatcactttcttcctgccttaacttctacatctgtttagccaccaaatttaataatgaaagatctctggagactcagagtgttgaaggcctgagagggcccagggttctcactttgctcaactcatgaaacttggctgtaccatcatgtagcagccctgcctgattcagtctagagttgtttttaggatgtgcctcagactggaccttgttgagggagagcatattctgaatatttgggtggattgtgtgggttaggccaatgatgagtatcttaaagaaggtgatgggaaggattatagtagacatggagagaagtgtgttttaaatgataactatattaattcaacatagataaatgtcttcacaatacaggggtttgacctttgaacatctagggtggcatggagaagttttccctgtaaaattgagaagagccaatatccaagagattagaatgaaatgcacacttgctgttctgcaggcccctgtatatgtgtacttgtcatatgtacacacctgtatgtgtagatacatataatattaaaatttgtttatttgattaggttgtataattagttttaagggaagtgggactagtagtggaactagttttgagttatgaatgagttaaatgaattgttacagaatatttggaaaggtcattttcaaggttttggggacgagcctaggaaacagatttttctgtagccataggggcttctggaatagatgcacaaactttgatggcagtttggggcaaatttgtgtaagttggagagtgttagctttgaggaaatgagaacagacaagaaaaacgcagtgtttgagaaagttatttatgtattgatttggtaggagctgataaaaaattataaaagttgtggagagattttgaatagctaaagtgggagmtatcatggaagtgatttatgaagcttttttttttctttttcttttttgagatggcatcttgctctgttgcccagagtggagtgcagtggcgttatcacgcctcactgcaacctctgccttttgggttcaagcgattctcctgtctcagcctcctgaataactgggattacaggtgcccgccaccacacccggctaattttttgtatttttagtagagatgaggtttcaccattttggataggctggtcttgaactcctgacttcacgtgatccgctcgcctcagcctcccaaagtgctgggattacaggcctgagtccccgcgccggtccgatttatgaagcttgttacttcaagtattagaaaagtaaaatggaaagatggtttagagaagatttcttttgggaacaatataaaacaagcaaggcaagaaaaaactaaaatgagtaaattagggtgtggaaaagttagagtaagaggaaggattaaggcggaggctactgaaagagatttcttactgtcaggctgtgtgataatacaaagctgtgttctgcagcgttttgttggatactattgataactggttctttaaggaaaggggcttaarcaggccttggtttgtagaggtgaggatattgacaagcatcattaaatgtaatatttttattaaagaaacttggaagtagggagccctcatattccctgggcttttgcagcccaggcccgattgggccagctgcgcgggcgggactgtgccggctgtgcggttggtggctgtggaacagcgaagtggagctgcgtggtggcgggtgggctgccgcccgcctgggtccgtgcgctcttggcccgtggctgggcgagtgggcgctccctgaagtgagcaggccctggaagggggggaggacgggcttttgcccaccgtctggcgaaccccgcacgcctctttttggggggtgtgtgtgtgtcccgcgcgagtgtgcctgtatgcagggaccagcaccttccatgacttccttttgtgtgtaagtgcgtgcgtgcgtgcgtgtgtctgtgcgcgtgcgcccctctgcagggaggaggaggaggaggaggcggaggggcgcggagaagctggcgcactttgggcctcggcggggtcgtctgcggcggccggacctcccagataccgcgccttctgggcctgccccgctggcgcagtcaggaccccttccctcaacgggatgggaaactttgtgagtggcttctccgcagccactaacaagtgtccgccagacagcgggggggccgccgaaggctgatgatggacacccgtttttcttcttattcctcttttacaaatcttctgttgaactgcattgtgtttacagtttcacgtctgtgaaaaggtcagcaggtaacttgctttactagacagctttttactgggtattaagagcaaaaaatgtacacctgtatccttatattaaaaaaccctgcttgtctagtggtaagaacaatcctaaggcctttccagaattgggctgtggggcaaacttttgctctccagactttgtgaaacaccttttacgatgccaggaaagaactacttgtgcagtagaatgaaagctagagttggaaatgcaaaagttgaagctctttccaacagcttgcatttaaaacagctttttgttttatataataattgtgatttgttgagtttacatgaagaattttgcaaaattaggcatggtgtgattaaacaagagcgtttcttaattttatagagggcagtggtaaaggcaccactcagtttggaaatttcaagtatgttgaaatgttgctataaataaaatcctattcagatttttagatttaataaatctaaaaatatatttgcagttgtcctttgggtgcaggaggaagtcctgggtttctctgtgcttgtttctgggcagattttcagtattgttagcatgatacaggtatagaaccttaacctgagtgaataatttgcttgagattaccagtctgttttggagctggaatagactctgggtctcttatgcccagtctggtgaccaatcccagaatagactaaggaaactgggtgtttgtctgtttggtggaaaatagggctgagccaaaaartgaacgtgtgaacgtttacttttctgttaaaacatttaaaagtaatttctccacactggatttctttggcctttctttaaaaacagaggacttgagtatattacccagtggtacttctagtgggatttgtaccacatttacatttgattacaacaggcagatgcttatggtttttaacggggggaagatatatttttcatgcgagtgttctcagtggttagaatagggagtaagtaacttgagcacttttagcctccttgaaatgctagggagaagaggaattaagttaatgtcattaatctctgttgaaaacgtttggacctctttattgaggattctttacaaggcatggatggaatacctatggatttccccatagcttatatacttttattctcattgttactacattagccacacacaacaatatttaattaatgttttcattaggcctcatacaagagggtacctttttctagtatgtgagttgcaattttttttttttttaaatagagactggggtctcactgtgttgagcagcctggtctcaaacacctggcctcaagctatcctcctgcctcggcctcccaaagtgctaggattacacatgtgagccactgtgcccagcccgaccttttgttttgctggaaaacattcctgtcttttcttatgccattcctcctatatcacaaaacaaaaacagtcttcttctttttcccttgtctggaaaccctggacattttaaatcgaatgcaatagttctcaaaccagaggtgattttgtcaaacgtctggagacatttttggtcagcacgctgagggggttccactggcatctagtgggtagataaacctcctacaatgcatatgacagtccccatgacaaagaaattatccactgcaamatgtcagtagtgctgatgttgacaaaaccctgatctgatgtattgagaataacattctcccaaatgatttaaacctatgaaagttatttgtaatctaattgatatctctatatcatgtatattataaatctttttccaatgttgtcattagaatgatcatgggtcaaaggttatgaagtatatattagaacattagaacacaggattgtggagctggaagattaacaagtataactccttcagtatgtagatgaagacattgagttatggagagatggtgacttacccaaggttggacagataatgcagagctcaggtctcttattacctctacttcttagtttaaatcattgctgagggaaagggtgtggcatcacttttgcttgatacagataaatttaatcaaattacaatgttaaataatcgcattgtgagaaatattgtctttcagtgaattagttactttttcagattcacacatatttttgaattcttcagcatggtgttgttaccactgtaaacttttcagtggctgctttttaagaaaatgtctgaaaaatttaaaaagaccacatacaatttttaaaacaaaacaattaaagttagttatgatagcttaggcaaaattttgaatgcaaactcaaccagaattactgaaacatcttagggtatcttgaacttaacacatttgttctgttgtgtgaggatcactaaagtggtgaattattgtgctgattgtaaatctgttatagcaagaccccctagttaattttagaaaaagataactggaaccttcaggtgaaatgtaattggggaaatacaaattggatatttacatgaaatattttcagattgcttaagcggtgtattgtcagaagaagtatcaatggggttcttttttaaattaattttttaaagaattgggcaacaattccataaaatagaataagtgttccctcaatggggttcttttatgtttaattttttttcctaaaaacaaaacaaaaaaagtgaactgagttttccaggctctgaatgtctgagtgtgatttgtgtggccgcaggagcagtgaamatctccaaaaagacaatatgagcaaagatttccttaaaaatttatatatgacattgaaatttwaaaaaattttgaaatttaaaatttaaattttatgtaagaaatttatttaatagaaaaaacttaaaatgcatattagcataaagaaaaatggaatcaagagaaactgcttttaatattttggtatatggctttcttatatttttattaaccttttattatggaaaaacgtaaatgatgaaaaatagaatattatgaactctcatatagcaattaatggctaagcttatgtcatctgtacctccaccttacccctctctcctctctctttttttagtttctatatagagatggggtcttgctatgttgcccaggctggtctcaaactcctaggctcacgtgatcttcccgctttggcttcccaaagtgctgggattacaagcatgaaccactgaacctggcctcacatgttaatttttttttttttaaactttattctgggctgtgcacagtggctcatgcctgtaatccctacactatgggagaccaaggcaggtgaatctcttgaactcaggagttcaagaacagcctaggaaacatggcgaaactctgtccctactatataaaaaaaggaaaaaacctttattttgaaaaaattatagactcacaggaagtggcaaaattagtacatagtcctgtgtacccttcacccagacatcttaataaatttctagtaagacatcaaaactaggaaattgacattggtatattactgttaaccacactacagaatttatatcattttcactgctttttaaacctgcacttatttttgtgtgttcacagttctagcaattttatgccatatataaattcatgtaactaccaccaagaccaagatccagaactattgcatcatcacaaaggaaactcctcttgctatccctttatgttcccaccccattccaacactcctccttgtaccctggcaaactgtttactatctatagttttgttctttccagaatgacatagtttgtttatgtatgtatactttgtatacatacatactttgtttagccattcacttgttaaagaacttttagtatgttgcagtattttgttattatgaataaagaggttatggacatttgtgtacagcgttttttgtaaacaaaagttttcctttctttgagataaaagcccaagagtgggattgctgggttgtatggcaagtacatgtttagttatttaaaaaacttccaaactgctcaaaaatcagttgaacatatttgtattggtctgttttggggttctgtattctcttccattgataagtgtgtctgccttccctccagtaccacgctgtcttgattattatagctttatagtgagtcttatcgagtagagtgcctcctctcacttcattcttctctgtcaagattgttttagctcttctggttttgttgcctttccatataaattttagaataatcacatctgtatctacaaaaaaaatcttgctgggagtttgataggaattgaataaacctatagttgaatttgagaagatcttttttttttttttttttaagatagaggtccttcagtccgtgaccacaggatatttctccgtttacttagatcttccatgttattttgaagcaaattccagccatcatatagttttccttaaacggtgttattgaggtataacttatataccatacaattcacccacttaagctatacagttcagttgttttcagtgtacagaggcatacagccatcagcataatcaattttagaacagtttcatcaccctaaaaagaaactacccattagcagtcaatttccattccctcttcctccccgtccctggcaactactagtctactttcagtctctaggactttgcctgttctggacatttcatatgaattgaatcataaagtagatgatcttttttgtctggcttcttttacttagtgtaatgttacatgatgtagcatgtgtcagcagttcattcctttttattgctgaatagtaatctattatatgggtttaccacttttttttgtattcattcatcagttgttgggttgtttccactttgtttttttttttttggccattgtgaataatgctgctgtgaacgtccatgtgcaagtttttatgtgaacatttgttttcatttcttttgtgtatatgtgtatgtaagagtgaaaaattgctgagtcatgtggtacctctgtttaaccatttgagtaacttccagactatgtttcaaagcagctttaccattttacatttctatcagcagtatatgagggttccagtttctccatatcctygataacacttcatactgtctttttgattatagctatgctggtgggtgtgaagcagtatttcatggtttgattagcatgtctctgttggctaatgctgtggagcatcatttcatctgcttattggccatttgtatgtattttttggagaaatgtcttctgatcttttgcctgttttttagttgggttgtctttttattgttgggttttaagagttctttatatgttctggatgttagacttatcaggtaaatgatttgcatatatcttctccaattctgtgggttgttttcactttcttgatagtgtcttttgaagcataacagttaaaattttcttattgtaataaaaaatacataatatgagacctatccttttaacaaatttctaagtgtgcaatacagtattgttaattataagcacaatgttgtacagcagatctctagaacgttttcattttggatagcttaaacaatacccattgaatagcaactgcgctttttttttttttttttttttttttgagaaacaaggtctcactctgtggcccaggccggagtgcggtggcacggtaacagattgcagtctcaaccttctgggcttaaacaagcttctcgcctcagccttctgagtagctaggactacaggcacctgccaccacgcctggctaattttaaatttttaaattatttttgtagagactgggtctcattctgttgcccaggctggagtgcagtggtgcaatcacagctcactgtagtctcgacctcttggcttcaagcgatcctcccatcttggtcactcagagtgccgggattacaggtgtgggccaccacacccagcctcaactcctcatttctacctcccctcatcccctggcaaccattgttttactttctgctcctatgagattgactactttatcttaaatccctcataaaaagtggaatcatacagtatttggcctcctgtgactggcttgtttcacttataatgttcttaaggttcatccatgttgtcaacgttatagaatttccttctttaaggatgaataatgttccattgtgtgtgtgtrtatatatatggactgctgccagtcggaggcctgttacagattgggctgcacagcaggaagtgagtggcaggtgagtgagcattactgcctgagctctgcctactgtcaaatcagcagtggcattagattctcttacattctcttaggagcgtgaagcctatttttaacagcgcaggtgaggaatctgttttacatgctccttttgagaatctaatgcctgatgatctaaggtggaacagtttcatcctgaaaccatccttgacccattgaaaaattgtcttccgtgaaaccagtccctggtgctaaaaaggttggggactactgctgtagttaacatgagtgcaaatatttcctcaaaaatccatggtggtggctcacgcctgttatcccagcacctggggaggccgaggccaaggcaggcgggtcatttgaggtcaggagtttgagacccgcctggccaacatggtgaaaccctgtctctaataaaaatacaaaaaaaaattagatgggcctggtgacacatgcctgtagtctcagctacttgggaggctgagttgggagaatcacttgaacccaggagacgggagattgcagtaagccgagattgcgccactgcactgtagtctgggtgacagagtgagactctgtctcaaaaaacaaaacaaaaccaaaacccattatcaattcttttggataaatatgcacaagtgggatttctggaacatacagtagttctatttttagttttgtgaggaacctctgaactttaaaaaaaatattatgcaccattttgcattcctatgaacagtacacagggtttacaatttctccatccttgccaatacttgttattgttatttttggataatggttgttcatacaagttcatgtatctttttggtataatgatttctttcttttggatatacacccagtaatgggattgtggggtcaaatagtagctctgttttaagtctgtttgttttttgagacagggtctggctctgtcatctgagctgtagtgcagtggtgagatcatagctcactgcaacctcaaactcctggactcaagtgatcctcctgcctcagcctcctgaagtgctgggattacaggtgtaaaccaccacatctggcctgttttaagttttttgagaaatcttgaagttgttttccacagtggctgaactaatttacatttccaccagcaatatttaagtgttcccttctcttcacagcctcaccaacatctgttagtttatgatttttaataatagccattcttactggtgtgagatggtatctcattgtggttttgatttgcatattcctgatgattactgatggtgagcatctgcttatatacctgttggccttgtgtatgttgtctttgaataaatattttttcaggtccttttcccatttgaaaagcaggctatttgttattttttgctattgagttgtaggagttccttgtatattgtggattttagccccttagcagatgtgtagttgcaaatattttttcccatttcataagttgcctagttgctctgttgattgatctgtttgctctgcgaagctttttagtttgatgtaatctcacttgtctgtttttacgcttgttgcccgtgcttttggtgtcaaatcctagaaatcatggctgtgccatgaagcttttctcccatgttttcttctaggagttttacagtttcaggccttattaaagtttctaatctattttgagttgacttttatgtatggtgtaaaatgagggtcaaacttcaattctttttcatatagctgcccagatttcccagtaccatttattgaagagactgttcttttcctgttgtggattcttggcacctttcttgaagatcagttgcctctgtatgcctgggtttatttctgggctttctgttctgttccattggtctgtatgttttgtttttatgccagtaccatactgttttaatgtgttttgaaatcaggaagtgtgaggcctttagctttgttgttctttttcaagattgttttggctacattcgggggcttttgtggttctgtttgggttttaggattgtttttgtattcctgtaaaaaatgccattggggttttcattgagatcgtattgaatctgtacatcgctgtgagtagtatggacattttaacattaagtcttctaatccatgaacatgggatgtgtttccatttatttgtgtcttcaatttctttcatcagtgttttgtagttttcagtgcatacaagtctttgcctccttagttaagtttaagtattgtttttgatgctgttgctgttggatagctttttttttttttttttttttgagacagggtcttgctttttttcctgggctggagtgcagtggtgctatcacagctcactgcaaccttggcgtctcgggcccgagtgatcctcctgtctcagcctcctgagtagctgggactataggtatgcgccaccacactagacttttcttgtgacacttttgaagcttcacctgttacttataggtctttaattcatttaactaattttttttttcttggagacaaggtcttgctctgtcacccaggctggagtgcagtggcacgatcaaggctcactgcagccttgatctcccaggctcaagcaatcctccagctacagcctcccgagtagctgggactatggcacatgccaccacgcccagctaatttttgtattttttttttggtagaaatgacgttttgccatgttgcccaggctggtctcaagctcctgggctcaaatgatccacctgcgtttgctgggataacaggcatgagccactgagccaggtctttaatccatttagagttaatatttgtatatgggatgatgaaggtatccagtttcattcttttgcatgtagatattccttggttctagcactggtttgttgaaaagacttctttctctactgaattgtcttggtgtcaaaaaattggttgacttagcctggtgcagtgggcacactcctgtagtctcagctgtttgggaggctgagataggaggatctttgagcccaggagttcgagtccagcctgggcaacataatgagaccccacctctataaaaagaatacataaaattaggaggctgaggcaggagaatcacttgaacccaggaggtggagtttgcagtgagctgagatcgtgccactgcactccagcctgggtgacagagtgggaccctgtctcagaaaaaaaaaaaaataatacataaaatttaacaaaaaagattgaccataaatttagttatttaagtctggactctaaattctattccttgatctatatgtttatcttcatgccagtaccacagtgtcttgattactgtagctttgttagttttaaaatcagaatgtatgcatcctttaactttgttcttttctttcaagatcgttttggattttcttggtcctttgcaattccatatgaattttagcattagtttgtccatttctgcaaagaaaggttctggggttttgatatgagttgcactgaatcagtaggtgatttggtgaagtattttcctcttaacaatatgaaatttttcaatccatgaacattagatgtttgtttaggtctttgttaatttctttcagggatgttttgtagttttcagtgtacatgtcttgtacctgttttgttaaatttattaccaagtactttatttttttcctgctattataagtgcttatgattttcttaattttatttttgaattgttcattgcttgtgtacagaaatataattgatttttgtaaattttgcatccttggtgaacttgtttattctagtagctttagtggattccatagggttttctatatatatgatcatgtcatttggaaatagagacagttttttttcccaatattaatgccatttaattcagttttttgcttaatttactgtaaattaagcaaaatttacagtaagttttggggattagttcattctcacactgctataaagaaatacccaagcctgggtaatttataaagaggtttaattggctggggaggcctgaagaaacttacaaatatggcagaagatgaaggggagataaggaccttcttcacatgttggctgaagagagaaatgcaagtagtggaaatgccagttgcttataaaaccatcacatcttttgagaactcattcactatcatgagaatagcatgggggaactgctcgtgtgatccaatcatcttcctcccttgacatgtggggattacaggtccctgtcktgatatgtggggattacaattcgagatcaaatttgggtggggtacagaaccaaatcatatcatttaccttgctagaacctctactgtagtgttgaatagaagtagtagcaagagtagacatccttgtcttctttctgatcttagggggaagcacttattattttacttttgaatatgatattagctttgatttttcatagatggcctttatcaggttgaggaagttccctttcctagttgggtgtttttattgtgtaaatggtgttgtatttcatcaaatgtttttcttcatctaagatgatctgccaaaaataaaagtttttggactttgttctattgatgtggtgtattatattgattttcaaatcttaagccaaccttgcatttctgagataaatcctacatggtcatgcataatcctttctatgtgttggtagatttggttagtattttgttgaggatttttgcagctacatttgtaagagttataggcttgtcattttcttttcttgtgatgtctttgtcttgtgttggtaacagtaatgctgatctcataaaatgagttgaagaatattctccccaagttttgggaagagtttgtgaacagttggtattaattcttcattaaatgtttggtagaattcaccagtgaagccatctgagcctgcaggtttttttttgttttttgttttttggcagcagttgggggggcttttaaattaagaagtcagttttatttaatggctatggggttatttatattctctgtttcatcttggttgtgttttgctaatgtggttttgtgaagttggtgtcaaatttaagagcataaaattgtttgtaatattcccttatattcttttaaaactgctataggatctgtactgatgttctgtttcatacctgatgttttgtgtcttctgtttgtctttttktgttgttgttgttgttgttagttttgatagaggcttacaaattttttgcttaattgattttctctattttcctcttttatttcttcttttaataattccttccttcttgctttggcttcattttgctcttttttagtttcttttggtaattcaattactggttcgacatctttcctcatttctaatgtaagcatttagtgcgtctgattgttgttagctgcatcccatgtattttgatgtgtattatgtttttattttcatttatttttatgtatatttaaaaattttgagacttctgttttcatccatggactttttaaaagtgtgttgtttattgctctatttagagattttcctgttgtctttctgttactgatttctagttactggttagaaaatacactgttaccatttcagttcttttaagttttttgaggtttgttttatggccttggtgaatgttccatgggtacttaagaaaaatgtgtattctgctgttattgagtggaatattctctacatatgtcaagaagaccatgttggttgattgtgttattaatgtagccactctgctttaaaaaatttattgtcatgtctttccattcttgtgcttttaacttgttatgttgctgaatttaaatttcttgcaagcaacatataattgggccattaaaaaaaaaatctactcaggctagctgagaggagatccagagcccagagcatccaggccactgccccacttcccctgtgtcccatcgcctgccacctgcatcctcagtcctcttccaactatctgctaaaacatgatggattactatgaagttctaggtgtgcagagacatacctcacccaaggatattaaaaaagcataatggaaactggcactgaagtggcacccagattcctgagaataaagaagaagcagagagaaaatcaaaacaagtggctgaggcatgtgaggtgctgtaagatgctaaaagatggtacatctatgacaggattaaatggtggcaaagaaggattaaatggtggaggaggaggtggaagtcattttgacagtccatttgagtttggcttcacattttgtaacccagatgatgtcttcagggaatttttttggtggaagggacccatttttatttgacttctttgaagacccttttgaggacttttttttggaatggggtccctgaggaggccaagggacagagtcattttttccacattcagtggatttccatcttttggaagtggattttcttcttttgatacaagatttgtttcattcaggtcactaggtcatgggggcttcacttcattctctttcgtgtcgtttggtggtagtgggatgggcacttccaaattgatatcaggttctactaaaatggctaatggcagaaaaatcactacaaagagaattgttgagaatggtcaggaaggaatagaatttgaggaagatggccagttaaagtccttaaccatacagggttaggagcagctgctgcacttgggtaactcaagtaatttaatgcgtgcatttaacagaactgttaaactataacaagcaccatttgaagattaacaggaacattttttttgaacatttcaaatgaactcaactttcagtataattgtaccaaatctaaagtatttatagacagctcaacagagtccccatttgtcatagacttttcagtttattgttggtgtgtccggagttggttcctgtcggtgggttcgtggtctctctaacttcaagaatgaagccatggaccttygcgttcagtgagtgttacagctcttaaagatggcacrgacccaaagagtgagcggtagcaaggtttattttgaagaaaggacaaagcttccacagtgtggatggggacccgagcggattgctgctgctggctggcgtggctagcttttattcccttatttgtccctgcccatgttctgtttctgtgctatcagaatgcccttttttcaatcctccctgcaattggctgcttttaggattctgctgattggtgcgttttacagagcgctgattggtgtgttttacagagcgctgattggtgcattttacaatcctcttgctagctacagagtgctcattggtgagtttttacagagcgctgattggtgcattttacaatccccttgctagctacagagcactggttggtgcattttacaatcctcttgtaagacagaaaagttctccaagtccctagtccccaggaagtccagctggcttcacctctcattgggaccacataataggacctttttttttgtctttaaaattgtaaatctctatgtgtactttgcatttttactaaatgtactccaaggtgagccttgacacgtcaatggtaggaaaagattgcatactaaaccaaaacacgtaaaagcatggatctacttttccatcgtgtttaaaatgtgagtcatgtagtgttagtctgctgtgaagttagcattgccaggatgaatcttctacagaaattgttacatttctggtttaatataaattaagaatttttctggtagtgcgtgaatgtttgtttcctgtctccttgcagattactagaacctttatttaggattccatcttgacttatttataatgttgttttgagtctatctcagttttgtagtggctgttttggttattatatgcatacatgacttagtctactaatatcaacttttatacttcaacagaagtgtggaaacctcacttttattttacctttcaccttctccaattttaaatataattgtcttgagtatcagatggtgttataacttttgtttccatcatgtaatatgatttataaaactaaccaagaaaaagtcttgtttatacctatatttccgttctttctgttgtttcttctttgatatttcaacattcctttttaaaaaaatcattttctttatgttcagcaaattttcttcagccagtcttttatggataggtgtgctagagacttttttttttttaacttttcttcatttgagaatatacttttatttccttattatttctgaagggcagtttcactggatatagaattcccagttggcagttgcattttttccaatatttgaaaaatactgtgccacttttatttttggcctctgtggtttgagatgagaaatctggtgtcatttgaattggtgttcccttatgggtaatgtgttgtttctctctggctgctttcaaggttttttttttgtctttagtttttgaatgtttaattatgatgttagagtgaatttcgttaggcttatcctctttgtatttgcttagctatttggatctgcaagttagtgttcctaaatttgagtacgtttcagttatcatttcttcaagtagtgtttgagccccactccctttcttccttctttatgaaactttgatggtgtgaatgttggatttttttttttttattgccctgtagttccctaaagctactacttttttcaatttattttcttctcttgttcagattgggtgaattctacttttctgtyctcaagttcaacgattctcttccccatgatttccattcccccccccgccccgaaacagagtgtggctctgtcacccaggctggagttagtggcacgatcttggctcactgcagccaccacctcccaggctcaagtcattcccctaccttagcgtcctgagtagctgggactacaggtgtaaagccaccatgtctggctaatttttatattttttgtagagatggtgtttcgccatgttgcccaggctggtcttgaactcctaagctcacgtaatccacctgccttggccttccaaagtgctgggattacaggcacgagccaccatgcctagcccatctctatgtttttattgagcccaccttaaaaatttattgtactttttagttgtcttaatttttttctttttagtttttatttatttgcttatttattttatttacttttttttctaggcagtagtgcagtggtgtgatcacagctcactaccgctctgacctcccaggctcaagcaatcttcttaccttagcctggcaagtagctgggactacaggtgtgtgccaccatgcccagttaatttgtaaattttttttgtacagatggggtctcactgtgttgcccacgctggtcttaccctcctgagcagaagtgatcctcctgcttcatcttcccaaagtgctgaaattacaggtgtgagctactgcagctggctttgcttttttttttttttttaaatttttctgtagtaggtatctgaagactatgcttctttttttaataacttctgtttctttgctgagattttccattttttcacttatttctggataatgtataattgtggaaacatttttattatggctgttttttttttcacttgttgcagtagaatttgttaatatattgttgaaacttttgcttaaaaattcttgtcaaattccaacatctgatttaccctctactttggctttggttgattttcttttctcatttatggtatgattttcttaggtgttttttgttacatcatggacattttttttttttttttttttttttttgagccggagtctcgctctgtcgcccaggctggagtgcagtggcgggatctcggctcactgcaagctccgcctcctgggttcacgccattctcctgcctcagcctcccaagtagctgggactacaggcgcccgccactacgcccggctaattttttttgtatttttagtagagacggggtttcaccgttttagccgggatggtctcgatctcctgacctcgtgatccgcccgcctcggcctcccaaagtgctgggattacaggcatgagccaccgcgcccggccatcatggacattttatctgttaccttaggaggctctgggccctatttaaatttttattttaggagtgggctgtggttctagtggcagtttaatttttagagactttgcagtctacttggtttgtttgatcctactggagctcccactggaaggggtttccccatgctgggtttctgattgtctacagatgggagaggattatggtgggacccacctactggtctcttcttttctcgcctgtcctggtaactttgggcaagtgaagaggttcttggcccaacctgagccacttgctatggctgggtccctgaatttygcctacttgcctctctgtctctaggtggaaaacagcctcaggccaaatagggaagaagagtgcttcctgtggtctttattgtcatttgggcttcaagttgatctccttctcctgatgttttcaggacaacatcagagagttgttgccatttgttttggcggaggaatgtgactatctgagctgctttctgttgctagattggtggttgggaaatgccaggtctggattgtcttcttctgttgggtgtgaggacatgaaacactctgctgctcttttgtttctccattccttgggtcccaaattggtttactgcctttttaccacctttggattttcctttgcttattatttcagtggtttacagttgtgcttcgtgagtaggggcagtaggagaacagatctaggccattttatctgaactggaagttgaagtccctgcatcatctcaatccaggcagttatttcagcattgaaaataatggtatatattgtctacggccataccaccctgaacgcacccgatctcgtctgaaaataatggtatataattatgtgctttgtgaacttaaaatttatttttaatttttaatttttgtaggtacatagtaggtgtatatgtttatggggtacatgagatattttgatacaggcataatatgattatggggcatccatctcctcgagtatttatcctttgtattaccaacaatccaattatattattttagttatttaaaaatgtacagccttgtttacttctaarcattatataaaatgtgtgcttcacttataaaccacactatctgacactcagaaggtttttgtgaggtcagtcatatccagctcaagaggttgctagggaatagatgcatactgttttactgtgcgtctacacataaacagaattttgttatttagttaattaaagtgagtttttgaattctgagcattttcttcaaagatgtgtttaatagattgtacttaagatgtttcaactattcccgtaatacgttactgcattttagcactcttaaacatttttcaaaaaaagactgaaaatcttgtattatgcaactgatttattctaattaatagattggaaaaggtaagataaattgtcgtgcttttacattgcctagttttccaatggagaataaattggcccaaaataagaacatgttcaccgtacattaatagaagctagtgtttctggctggggatggtggctcacacctgtaatctcagcaacttgggaggctgaggtgggaggatcacttgagggtcaggagtttgagatcagcctggggaaatgtagtgagactccatcactaacaacaacaacaacggaatcactgggctcctttgcagctacttcttagtattctctaattgattcttatggcaaatctcagttttcctaatcagattaaaaatgattcccttcgctcagtgactgtatgatttcttttatgtttaggcacacctctacattgtgttcagtgcctagtgtaattctgggcatgtattctagacagagtagatcggattggttctggcattgaataaggtgaaaaatatcaaaagatggactggaaatggagtatggctttttgtggcccacttacaagtttttaaatgaccatatttaattatatttcatattaaaactagtaattccattcttgttatttttgacttgtgaaaggtttttttttttttttttttttttgagacagggtctcactctgtcactcagtctggagtgcagtggcacaatgtcggctcactgcgacctttgccccccaggctaaagcgattctcatgcctcagccttccaagtagctgggattacaggcgtgtaccaccatgcctggctaattacttgtaatagtattttaacatgtttttgatgacaaagaattgacactttaaaaatcaaagttaaatgaagtgttaaactttaatttttaagtgggcatttctatattcttttctagggttcccttcattattacagtaactttatgtaataaaaatgatgagttttctctgattatatacatatgtacctatcattgtaaatagcatcttcatttcaaaatttatgtctattggtgttacattgaactttgaagatgtttactttttttctgactcctagaatattgctaagagtaatgttaratatatcttaatttgaaaatgaccttacctgtggtgttatgttagagtagacatttattaggaggtggaggatctggttgatggcttttgtttttgatttggagatagggtctcactctgttgctcaggctggagtgcagtggtgcaatcctagctcactgcagcctcaaactccttggctcaagtaatcctcccacctcagccttcctagtgtctgggtggcatgcaccaccatgcctggctaacaaaaaaawttttttttttttgtagagctggggtctcactatgttctccaggctggtctcaaactcctgggctcaagtgatcctctcaccttggcctcccaaagtgttgggattataggcatgaactgctgtgcctggccttagttgaagtccttgtcttgccactaagatggtgtgtaatcttcgttacttaacctcttgaacctgtttcatcatctaaagaactgagacaaacaataatacttgctcagatagttgtgtgtgagtgtttagggggtgtggaatgaaatgtcgcatgtgaaagcactttgtaaactctaaagtactttatcagaatatggtggtttcatctttgagaagattgtttcaaagtttgcctgggtgatcttgatcatcatagtacaaagtgtatcatgattatttacaaaattaatgtttattcagtaaaaacttatgtaagaattaaacagcttttccttaagtttggtggcttactaaccttaaaaactcatttacattatctggggaaggattacatagttgcttgttagtgcagcatcctcactgtgataggttagttttggaatgtttcttctggaagcaggtgatttagatttaaaagttctatctctttagtagtttaaagtttataaaatgcttatttttgtagcattgtttataacaatgcttttgtagcatcactttttctaacatagatggacagttggtttcttgtttgacaaatgtgtattgggtagttgatttgaaaaggtcaagggtaggtgaaaattttcacttgatggctttattttactcattttgctcagccagcttctatatatctgagtgctcctttgtaggattttctttctcagctaagtgcagtaaccacactaattacaaagttttaaagattttggcttgattttttttttttttttttgtgagagtagaaatggaaaatggcttaagaagggtgattgctggctgggtgcggtggctcacactggtaataccagcactttgggaggccacggcgggtggatcatgaggtcaggagatcgagaacatcctggccaacatggtgaaaccccatctctactaaaatacaaaaaattagctgagcatggaggcacgcgcctgtagtcccagctatgtgggaggctgaggcaggggaatcacttgaacctgggaggtggaggttgtggtgagctgagattgtaccaccgcactccagcctggtgacagagcaagactacatctcaaaaaaaaaaaaaaaaaaggtgatttctggggtggttggtttgagtttattggttggttatccttgggatagatatggttataaaaaatatactattaggccattcagatatcatttagttcaaaatatataaagtataactccttagagggaatcttaataactttaaatttaaatttgaaagcagttactataaatttaaagaacacatacgtctgttctttgcattgtcactctatagagattcaaaccaaattcatagaaatctcttgcctggaacaagtttttattctttttaaaacatcattcagaaaggctcattaaatcataaaagtaagaactaatttaaaaatataacttgactaatgtgtaaatgtataatgtgtaaaatgtgctctagttaaaagatgctaaaggactgtaagcatttttagtttcagattcttatgccatgtgtgctgtaatttatcctttcattgctttgggcttttgatttaaagggcagaggtagcctttttatttggtagtgctcatgggagcataaacagttaatgtgtaagcattacacgtttcattgaaactttaaaaatgattttctagaaagattaccttaattaaccaagaactatgttctttatcaatgaatggcttttcaaaggatgatcatacttaggagtaacattaaggttttatttattgcttcagaaatttatattcttgacagaatttttgtgggagtttcttctaacacatctcttatctggatcttgctacgttaattcataaaacttcatctttagcaatcttacttttctaggcaaagatgacagttaaaacataatttggtgggctaaaagtatactctgcaaacaacgtaaagatatactttgaaaatactgtatcagtagaaactgtctacatgaaatgtgaaatatttgaaaacatgaaatgtgaaatatttgaaaatacgaaagaagctcttcctatctgttgcaacatgcatgcagtttttgtagcttttctgaaggagtacttctgaaatttgttactagcattatttttaaacacagaatggaaattaagttagattggactaacctatttatgttgctaagaattaccatggtgcatttgatacagtgtttcataaagtttatagtggacttatcaataggttgaatctctttattgttaagacagtcaagtctttttctggaaattctaggtaaggtaatgttgccaaaccccatttaggctggttttgagaccaagtttcgccattttattaggtttatgtgaccttgggtgacttttctacatgcctttgttttgttatctgtgattccataattagaaagagagtgttgtatggtggttaagcttctagagcctgatttcctgggaggaaattccagctttactaataattaaaaaaatactgagtctcttatgtgtaaggcactgttttaggcactgggatatgtcagtggataaaacagacaaaaatttcttctcttgtggagcttatagttagggcagaaaaaaacatgaataagttggttgtgtaatatgttaggaggtgggcagtacagtgcaaaatgtataacaataaaagggggattgagtgtatgtggtgggatgttgcaatttcaaatggtgtgactggaagaggcctcattaacaagactttagctagacttgtagtagctaaaggatttagttacgaggatctctcaaggaagagtgttccagacagaggaacagccagtgcagtagattctgctgtatgctggagattctgcgacaataaggaggtcaggtcactgctgctggagtggagtgaacaaggggagaggctagaaaatgaggtctgaaagatgagggtgggtggtggtggaggtggtcgttgatgggtgggggataagcacaggagtgcatgtaaggccttgtagacccttataaggagttcgggtctgcctcttactacttttgtattctttgggaaattatataaccttttagttttgtcatctgtaaaatgtgaataataacaatactatctcataggtttgttgttttgattaagtgatttaatacctgtagtgtcctaggaacactactgagcagagtccaaagcatatattcattgcttacatattgcatatattcttacatgtggaatcaacattaagagatcaccttcttccttttcttttgaaaaggtagcaaagggagagttaattgctccctgctttgatttttctatgataaatttcttatgcttcaattatatcacattattatcacaaacatttactctgtatgtgcttatcatccttgctaaattatgaatgcctttggacagagaccagggtattttattatgtcttaggaatcttaatgtgttgtaaaaatatatcatgtgataaaaaatgttgactgagttaatgacaaaaatgttggcttaattaataaattggaccacctgctagtaagtatattggaacattgccagtctatcaaaactaaatagcggaagggtggtagctaatgacttctgcaaaatacttgtgcattttatttctgtgccataattattcaaattggtattagtagaaaatttccttaaatattatataggtatacaagtttgtaccatgtaaaatgaaaagtctttatgtatattattgtgtatctattaacatttgctgtcattggttgataggaaacaaatactaccttgattgatagcatagatacaataaaactcctaccttaaaatacaatagttccctacttaacagtggtttgatttaggatattttgactttatgatgatgcagaaggcataggcgtttagctataggcataaacttgtgacctattgggacataacctcatcataagtcaaggaatatctgtatatttttagtcttaatctgtttatatctgcccaagtgtttataatcaaagattatttagccagaaaaatgttaaaagaattgctaaggaggaatattcactgactgctgaagtgggggagtagggcaaggaaagaggaagatctgaactgacttgggtggttgtccaagtaattttctatctgtctttttgtatttgcatggtttccgtttccatcttagtaggttctcttccccccttcttggttgagaggagtggaagagaagaaagggggatagaggcttgaagaaatgaaattagtagatgatgctaaatgaattagggttccagagacagactatgtgacaggtgacttgggggaaattgtgggtttacatggtagaggagtggttgtgtgggaaagacattccagaatttctgtttataaatttatactttgaggttatattattttgtgtgtatgcacgtttccttttccttcttgcttcactattttatttttgttttctttttacatatctaagttatattctgtgatgtgtagctgcagtaatttagtgctttcaataaaatgtgatgcaagaaggtgagtatgctttttgtgaaaatgttttcaacggaatgttaagatttcaaaaacatttgtccagtctatagatgttactagctcatgatgagatgtgtaataatatcctgattgtggattagatacatcacatcaacttttaaagactcacaatgttaaaatgcataatgtgaagacatttttttccctgtctataggctttgcagtgtccttttctattcaattttattcttgtaattagcaattctaaaagttgaatatagtaatgtatgtagcaatatgtgtacagaatatataatattctaatagaatagtgaacaagcagtgcaatgcagaaacagttgttaaaagaagaattttagacaaattaaatttagcagagtgtatctgtgcaaagaactattcatgaatcaggcagcactctgaaccaggagaggtttggagagctccacccagcaacataggcaggcagtatttatacacagaaaaagcaagtgacaagcagaaatagcttgattggttaccgcttggcatttgccttatayggacatggtcttatcaggtggcagtctgtaattggttgaggcttggctactgtgatttgctgagactcagctacttgttacaaaaatatactcttaaattaggtagcagtttgtttacatagtaagttaggtttaattggctacctagagaagcaactttaaacctaatttaatttaacataatttagctttactttacccatttttaatagtgtctaacagtagtatagttttatagcttttattatccttttggtactattgctataggagtatgtacttaaaataactttgcataattgagaggaatgacatgtatatgcttttgaatgcttggctgcaaaacattgaggcaagcaattaggagcttagtagaaatcaagtattttaaaatagattttttttgtttgtaactacctcaataacaaagctactgactagctaaatactggaaaatgctaaattatcagaaagactgtactgtttgtagtccttgataaagcatatgtaaatacagccttgaattgatgtacttggttattttctagagattatcaatttctagaaaatattctgcttttacatttatggcttttattgatgtgcaaggtatttatggatccctaaacttgtattaggactgttacataaaatgctttatctattgtttctgaataaaattatatttggcttgttctttatttctgataattcaactttcagtcttcattactttcatttaatatacctcagaaaaatcccagttacatgaataaagtgatctgtggtcggcatcaatgcagtaccaatgtggaatgttaattttctgtgttagtctctgctaaaaggttagttatagcatgatgtttaaaaaatatcgatggaccattttagcattattaaataccttttgctttgaacttttaaaatgctgtttgtgttttcaaaaactgcatccttaatatatttagattttttcagctgagggaaatgttactgtaagagtttatcaagaaatagtgctatatgagtgttggagagtatcaaaatatgattttagtgaaacacatttgtgctttccttcctatgttatgatatttaagatgatagtcaagtttattgtcctgacttcaaagaaatcttaatccttcactggaagttaagtttgaaaaagtccaatttgtatgtgagtcattgttgtgatatcatttagcatttgatggctcattgcactcagactaagtgttagttgttactaattttatttactctaacagtatctaccatggaaagaattttggtagacttaggacacttaaatgtaacagttttacctgacttctttaagactatgtttaatcctgattcttttgggggttaacctgtatttgtgtacttttgtaggatagagggaggaatcagcagcttggaaattcaagcacgtgatctggcgggatgggcgtttgcctaacgtatttaatggaggtaattcagcattctttgagtcaatctttaatttttacctgtaatggatgcccatgttactacacrtacttacaataactgttgggtataagtgtgcatttatggccaatcccttttctttttatattcatataaataacatggtatcactattataaatattataaataatatgtagatatggacatatgtacatagaaaagaacattattaattttataagatgaagtcaattatcttctcttaagattacttgcatatcttttaggcctcatttcctttatgttaggaaggcaaatgatcctctcctttcttgttggcctatgttggtgcatatattaaacctatgcttttatctttcacacaacatgaaagaagatatctaacagttttcaaggagtttacatatatgtcagtggcacatactcatgtcagttattaatgatcataaaaattcttctgtttgttgtatttttaatttttaattttttaatagagacagggtctcgactatgttgcccaggctggtcctcaacccctgaactcaagtagtcctcttgcctcagcctcccaaagtgctaggattacaggtgtgagccactgtacccggcctgatcataaaaattctaaaatttctctgtgcattttaaaatttgttttttgagaatttttttttttttttttttttttttgagatagggttttgccctgttgcccaggctggagtgcagtggtgtgatcttggctcactgcaccctctacctgcggggctcaagtgatccacccacctcaggcctctcaagtagctgggaccacaggcacatgccaccacacctggctaacttttgtgttttttcttgagatagggttttgccatgttgcccaggcgggtcttgaactcctgagctcaagcaatccatccgccttggcctcccaaagtgctgggattatagacctgagccactgcgctcagcctgagaattctttttcaccttgtggattgaaattatttggagtttcagaagccatattttaggattttcctgtttttaccatatcttctgataattgtcatgttcaacatttttcacttctttacccacgtttattataataggtgtatacacttaggcaatagagaatgttataacatcgaaaaaaggctttccaacccttccccattcagtataatcattgtatatccttccagacaatttctatacatatacaagtatttatatgtgtgcttatatttacacatttttttacacaaatgagatcacaccatattattcagtaatattaaaaaataaacttccacatttttgcaaatcattccttttcactttatgctgcatagtattctgatatttggacatatcataatttgtctaattagtcatctacttatggatatttaggcttttttttttgctattataaatgatgatgtagtgaatattcttgggtacacctttgcacatatttaaaaatatgtctggctaggcgcgatcgctcatgcctgtaatcccagcactttgggaggccaaggcaggtggatcacttgaggtcaggagttcgagactagcttggccaacatggtgaaaccccagctatactaaaaatacaaaaattagccagacaggtgggtgcctgttaccccagctactcgggaggctgaggcagaagaatcgcttaaacccaggaggcggaggttgcgttgagccaagatgccaccactgcactccagcctgggcgacagagcgagactctgtctttaaaaaaaaaaaaaaaaaaatttatatatatatataaaaaattatatatatatctgtagtatgaatatacatatatacatatacatataaatatacattcatatgtatatactacagatatatatatctatacatatatttatactacagatatatatgtgtttttccatatcttctgataattgtcatgttcaacatttttcacttctttactcatgtttattatgataggtgtatacacttaggcaatagagaatgttataacatcgaagaaaggctttccaacccttccccattcagtataatcattgtatatccttccagacaatttctatacatgtacagatatatatatatatatatatatcagtagtataaattccgaagggaaaaattattggaccaaagattatgtacatttaacaatttggtggataaattgcctaactctaaaaagaaggccaaatatcagtagtctatgagagaggggatctctctatctctttgacaacactagctagtgtcaaactttttaatatttgtcagttttttgttgattagcttttcttttcttatgagtgagtttgaggattttctccattattattggccataatgtgtgttttcagttaccaatttggtcatgtgctttgcccttttatggagctctttatatacttgtatattaaggaaaggagcctcttgtcattttttttttaagttttccaattgacagttgtatatacttatgagggtataatgttttttatttttgcttgacacatacatagtgtatatttatggtaacatacatagtgtatatttaaattttacacactattaaaattactgtatattcaaaataaacactttatatattttgatacatgcttacattgtgtaatgatcaaatctggctaattagagtattttcatcacttcaaatatttaccatttctttgtgagcctcttgtcatttattagacaaattacttttgctcatcttttgattttattattttgcccaatagaagttttcattttttattgttgaatatagtaatctcatcttccatggctgaggtgggcagtgaagaacagttctgtgttagatttaaaggtctttatcattgattatagggctcacttttcgctccaggttgtagcatctctgaatgacatgagtctctaacttatactttgacttttgcttctttttcttttttttcttaaattagtttggccaggtgtctttaggaagaaaaagaaatatacataaataattatcttttaaaatataaataataggtattgggactcatgatggaagaataggtatacattcataatgacaactacaaagataaaatgcctgagagcatattacttaaaaaaaaatttgaaactgtatggaagaatgagtatttgaatcagttacattttttgataggaggatacatatgagactcttcttcaaatatatatttaaagctgtatattttaagtattgcgtttgctgcatcctgtaaattttgatatttgttttcattttcattagttaaaaatattttctaatttccctttacattttgtctttgttatttagaagtttgaagtttaatttccaaatgtttgtggatttcccagttttttagttgatatcaaattcaattctggtatggttagagaacatataaatgtatttgtttgtaagacagggtcttgctgtgttgcccaggctggtcttgaactccagggcttaagcaatccatccacctcaggctcccgaagtgctggggttacaggcatgggccacgttgtgcggctcagacaacatatttttatgacttcaatccatttaagtttagtgagacttattttatggccccgcgtgtggcctgtcctagagaatgttttaaaactgtatgtattctagtattgtttggtagtgttttctatatatgccacttaggtatagttggttgatagtgtggttcaggtcttctctgtctttgctaattttctgtctaattattctgtcacttatttagagtgggacattgagatctccaaatataattgttgaatttttaatttttcctttcaataatgttagttactgcttcattattttgggactctttttaggtgcatacacrgttattatatcttcctgatgttttgactgtttattattacgaaatatctttctttgtctctatagtcttaaagtctgttttgtctgatgttaatatagccattctgtctcttacagttactgcttctatagtatatcctttttttcccatccttttactttcagttttgaatgtaggatatgtcttgttgacagcatatagttggaatttgtgtttttatcctttccgacagtcgctgcctttccactggactatttagaccattcatatttaattagggatatggttggatttacatttgccattttggtatctgctacacacacacactatatatatatatatctttatatacatatatatctgtatacatatataaaaagatatatatctttacatatataaaaagatatcttgatgtatgtatataaagatatatatatctttatatgtatatatacwtataaatatgtatatttatatacatatataaaaagatatatatacatatataaagcaagtatatatatatatactcatatatatagtgtcatttcactatggtttatatatgatatgatcctttatatatatatgtatctttgcatagatacaggtagatatcacctatgtttttgttcctttgtttcctctattgccttttgtgttaaatactttttagtgtgccattttaattactccattgatttttttaactatatttttaaagatattttctttgtggttgctgtcaggattatgcattttaacaggctgcttattatcagtaagataaactttcttccaatgtaggtccattttctcttctttattgtactgctattgtaatatacatctgtatatattataaacccagtagtacagtgtcgtgatcattgctttatacattcttaggtcttttaaagggaggaagaaatgagaaaaatatgtttatggagtgttttttgaattaatccacatatttgccatttctgatgctcttcaattctttctgtggatttaagtctgatgtgttttcctttcagcttaatgggcttcctttagtgtttgtttaaggcaggtctactagcaaaaaaaattttctcaatatttggttatctgggaatattttttcatttttgaaggatagttttgctgtcttcttggttgacagctgtatctttcagctttttgaatatgtgatttccctgtctttcttgcctctattgtttctaactggaagttagccactaatctctgcatatgctgaatcattattctcttcctgctttcaagatttttctccttgggtttgctttcaacaagtttgactatgttgtgtccaggtgtaggttgctttatattttcctacttgaaattcattgtgcttcttagatctgtagatttattttccttagaaaaattaaatttggggccaggtgtggtggctcatacctataatcccagcacaggtggggatttgggaggccaagatggtcagatcacctgaggtcaggagttcgagaccagcttggctaacatggtgaaaccctgtctctacaaaaatacaaaaattagccaggcatgatggagggttcctgtaatcccagctactcgggaggctgaggcaggagaatcgcttgaaccggggaggcagaggttgcactgagccragattgtactatcgcactccagcctgggcaactgagtgagactctgtctcaaaaaaaaagtaaaagtaartttggcaagtttttggccaatattttattaattttttttttctgctctttctcttctttcctggtactcaaaatgttggtaagctgaatgttgttccatacgtctttgaggctctgttcattttacttccatctttttctactctgtttttcagagtggatggtttctattgatgtatcttaaaggtcactgattttcttttgccataaatctgttgagcccttctgatgaattttttatttctgttactgtattcttaaacttcaggatttccatttggttcttttacataatttctgcatctttgttgaagatctcttatttgttgattgcagtttttcataattaaaaaactttaaaacatgagttccttttaacatatttaacatatgtataatagatattttacataatatattgtaacaactctggattgtgatgagcccctcccctcttattgttactgttgtcatttcactatagtttatatatgatacaatcctactgagaaaaataaattttactttgcacaaaagtgtatctggcaaaagagatatacatgaatatccaggaaaattctgaaatgcaggagtactgagaggtgaatagttctacaagaatttgagctcttaaaaaaatatataaactgttgaaatgttttttaaaaaatgaattaatattatactttctgaagttcaaagaggaaatcattagtgatatggatgtaggtgggaaagactatttattctttttgcctttgtaccatcataagctaatgtaaaatcataggatctttcatgtatcatctggtctccacacttcttgtgaaggagtgtatgtgaactattcttgatagataggaatctaatattttaagaacctccagggtaggaaattccataaaatctttagtttgttaactatgctcagaatacttactgtcaggaagttttcttcctgtgtatagcctrtactctgtttttgttttgagtgtgctaaaaattttccatatgattttatctatcttttttgtcagctttkctctgtcactggtaatcttgctgggaatcttgctgattttataaccataatcgtttctattgtttttggccactagaattttatgttgaatttatataatagtttcttttaagttttggcatgcgttagttctgtttgtttgtaaggcctgccattgtgtttcttctctcttcacttcatagactttaacaaagcaggtatgattactgtttgtaagtagtttctttttattttttttattattatactttaagttttagggtacatgtgcacaatgtgcaggttagttacatatgtatacatgtgccatgctggtgcactgcaccctgtaagtagtttcttaagttttgttttttctaaccttttaggtttgtaattatctgaatttccttgaatatcctgtatctttgaggctgtagactccacatctaggcaattgttcttttttccttttttttttttttgagacagagtctcgctctgttgcccaggctggagtgcagtggcgcaatcttggctcactgcaagctctgcctcctgggttcacgccattctcctgcctcagcctccgagtagctgggattacaggcgccggctgccacgcctggctaattttttgtatttttagtagagacggggtttcatcatgttagccaggatggtctcaatctcctgacctcgtgatccgcctgcctcggcctcccaaagtgctgggattacaggcgtgagcaactgcgactggccggcaattgttctttataaggccaagtttatttctcatttactgtctacttaccactattgtattttcccaatttcaaacataaaaacaagtcagtacattggtcattcagtcataacttactgtatttagaaagaattttcacttcagtattcataccaatttgcacatattatatttgtatagtatcttttcctaccataaataatgtttgttgtgtgtgtgttttattgtaggaatcggatggcataagtgattaaggtggtattgaggatttctgaagcctatgaaaggtagaaactcaaccatgatttctttttcaactctacagcattcctttccttgaagtcttcgtttttaccttagtctcgggtaattttaatacttatttttcataatcttgaataaataagttttttcaaatatgaagtcattgtgttcagctgctagaattttatactgaatttatataatagtttcttaaagttttggtatttatatttggaagaaactagtttttttcctgagaaaagaaatttaaatgatgaatratgatgtcattttagactctaacacaacaaaaatgtgtagtcttaagtgaaatttaattgagagttattttcttggtttaacactttttctcaacagggtatagcattttttaccccctatcctgaacacatatacactcattaagtttcccagaattttcagagaaactgttttcataccgaggaaagttagacatgttagtcaaatttaatgatgtttgctatataatttttaaaatgtgagaaaacatatcagtttttatacatctatacatgttgtatgtatgcctgcactaatataaggaagcagtcttatagataattcagtaatcacttaagtttgatatattagtatatagacttggctactgtgacagaggcttataaaggtagaaatatatttatatttacttgaaaagtctgtgtaaactatcttgagattaaatggaggctgcaaaatcactgtgtcccagggctcctttgtcttgctctgctcttcttctatgcagtttctgtattgtgggcgaggatggttaccattgtgtctgctaataagaagaaaaagagaagggcattctctttacctttaagaggagtttgtgtatatcactttcactcagatccctctggctctttgtcacgtcacaaccagttgcaaaggaggctgggaagtgagtgactctgacctaggcagccatatgttgcacttaatttttattactgcataagaaggagagaacagattctggggagatagccagctatctgtcacattaaggtttgagtcagatttattttcattaaaaaaaaaaaaatggcctcaggcctgtaatcccagcaggctggcaggctgaggctggtggatcacgaagtcaggacatcgagaccatcctggctcacacggtgaaaccctgtctctrcatacaaaaaaaattagccgtgcgaggtggtgggcccctgtagtcccggctactcgggaggctgaggcaggagaatggcgggaacctgggaggcatagcttgcagtgagctgagatggcaccactgcactccagcctgggtgagagcgagactctctctcaaaaaaaaaaaaaaaaaaaaaagccgttgattatttaaacagttaacttttttgttgttgttctggaatgagtcttggttactgtatagtatgtattaaaaataaccattagcaatctaggcatagtggtatgtgcacagtcccatctcatgtaattaaaaaaaaaaattaggtgtttaacatttgttcatagtatacagggaaattttgttttaagaagtttttttaaaatatttattatgtaagattacagaaactatagtttgaatattaatgtttgaattattgatatttgcataaaatgtaatggatgcaatgactagatccaacagaatgtcagattctgctttgcgtgaactttttttttaccttttccctccccctctccttgttaagataaattatagctgtttcttaaactgtttggatttccataaatttgatgttttagtatttctaaatactactatcttcttgatgttacattgttttacaaaacagatgataagtatttggaatgcagaatatgcctagattctgttttatttgagaggggcttcagtgtggtatagaaatgcctgttaactttgacttattcaaatatttataaattatttttctgtggtgaaaaaatagagttttttttaaagcttttaggtttttaaagtcatataaaatgattattgttaacgtgtaagttttctgattaatacttgtgttagcagctattgaaatagatatttgtttaaacatcctttcttgttagcactgatcagagaccattttgtccagttaccattattataaatgatgttcctattaggatattttgaaatagtagtactttaaaaattaacatggtttagaagatatgttttatagatacaaaatggtagttatacagaggtatatctgaagaggtctttgaatgtacttagacaagaaatagattttgttttattaataagagatgaagtagtttctgcttagatcaaaactatacttttcaaggatgaaagcaaatacaaaacttcttcagaataacaaatagcaaatttgttaaaggttctggtattaatcatgggtttcatctcaccaaatgatctggaggccggttgatatttgtatttctaatgctgatatttttaaggtataatttctcacggttagaaacataggttagaaatgttaatatccaagttaatgtaactggcatcctccaaataacagagtgctttggatcagaagtaatttgtgaaatctagcttttttcttttacctgttttcagaacaagttcctttkagtgcttctcttggcttacaagtgaagtttcattttagattgaatgggttctgttacaaagtcaggggaagaggtattactgaatttgtgagaatattttaagttgggaattactctttttatacaaaagacgatgatgattaggttcagaagcttgcctattataacctgctttgactcatagttgaagttccatattattcaaaaaagtttatggaaaataatattactaccaaactcaataaatgaaacagaaacgtaggatctctaagtgagaaatatttatttctttcatgctcaaatgcagattaattaaaggtaataagtgacacatggatgttcatatacattcagaaagggaacttggtgctttaaaaaattttagagcatatagcacaagccttcaaatctgttttcattttaaaatgtacagccctctttttttgatacaggtgtatcattaggactgactggttttacatttrttagccatatttaggattatttttaaattttcaattggaatgggaaggtagagagattttcctggtaaggctttgagaaaacagagrgaggaaggtagcttaagaagatacatttaaacacatgaaaaagaaagaatggctgaggagaaattcactgagatatgagtaacagatagaaaattggaaaatagaaaacgtggaaagtgttgaatcctcccacaggagaaaaggggattctgtgtcggaaagttctcccatagtagccatgaggtggagtagtcagctaaggacagtttgattgctttgccaagccaagcaatgatgacagaaggccttaagagcaggtggtgagaggacaatgagagttcaactacttcctaatgtgtccagggccttttaaagtcaggaaatagtgtgataaggtaaaaagtgcattgagtcaggtaagtctggtttgaaatcccagtttacttctgagctatgtatccttgggtaagccccaatttgtctgttaaatggggatatgctgttactgtcttgagggttattgtaaatattaagtaaggtaatatatttaaaggtgcccagcacagtgtcttacatctcagcacacattagttgtctttcctctccaggttttcataatttctgaattttagaatacagacataaacatattaatttggaaagacctcattaattgtataaaactcccattacaaaaaacctcagcaagcatttttttcccagtttttaattgacccttgtagaacaagcaagcatttttaagagccttgtatatttgattaaaaatgagtagtagtgcccaacttgtccatttgtaatgcttctgttaactttgtcctctgaagatgagcccagacagttccccgagttttggacataattgtcaaaaacatttgtattaaaagcctatgtatttaattccttattaaaagccccgaccgaaaactgtttactctgtttcaacttaatataaatctataaagcttagtttttaattacttacacataattgattagaaacattaaattagaaggtgaccacaagaagagtcagctatttcttctggtagacaggagaaaggtaatggcagataatttacgttctttttaagtagccctctgccactaggcttaaatgrctagagggttacctaagccactgcagttaggcttttacacagctgaactaaacacgtgtcaataggaaggatgttaggtgtgtgggggggttgggagtgggagcagggaggggaaatttaatggaactggaagttgtgttgtggccccctagatacccctgtagacagtttctctcgcagagggatggtgatgagggaagaataaatcatggaagcgggggaagaatgcagaatttgaagtaatctgcgaaagggagatttaggagaaattggcctgagttggtctccttcctttctctttcctgctccgttgtagttttcatcattctctgctctgggtaacttgcagtgcagaggaaggattgcctctcactcttagctgaattagcccttggacatcattttccagtctgtcttggttcttaacagcgctgccattttgtactctgtggtgtcagctgcctaaggtctctacaagataaagggtcttyacagggagctcagagtggcttattactccacgtattttcttttctttccagttggatagaggttccttgaagctgaaattaattgtttagtttttttttcccttccaaatcagtcttccatgtgagtaataagatttaaaggaagcattctttctttcctcctctcttctgtgtagtatccctagcccctgactttccattaattatacacacatttggattagaaagcagttggctttttgaggagttaacaggaagagacagttaattatttacatattagtgtggcttgattacctcagttttctttctttacacttggctgatcctccctaaaaataatgaaattagaggagggatatggcatgtgttagcttttgagcatgggaccttttgttgtatttggatttttgaatatgcagtgaggcacatgagagctttgactgagaccacttaagagtttaagtgggaaaggttaaaaccataatggcatagaagggaggtgcaaggacaataaaaatgtatttttttttgtacttttatctttcattattaagtgtagctttgtcctattccctttttccatgggcctggtaaaatttcctggccagagacaggttgaggtatatgatagaggtatgactcactttgtctttgaaacatattttaaaataacactaagtctttgttttaaaataaagaagaaaaacaagmcctagagtcaattctgttactcataccctgttagcttgccgtaacattaaagaaagaaaagatgttggtacatgaaaaaggaataataaaaagtcaaaattagtcttcttcatgaagatcctttcttatttcattttccaaattccaggtaagtttcttaccagaaaaaawawawatatatatatatatatgtgtgtgtgtgtatatgtatttctctctctctctctctatatatatatatatatataaaagatcttactatctacatagttctccttgattttttttcacttaatgtatcttggagaatcagcacataatgctaacgtcattccttttaatggctgcatgtgttccattgtatggctgagtcataattaatttaacaagtcacctgtctatggatgcttaaatttgtttccagtcttttcccattgaagggttgtagcaaacatccttatacttacttctttggtgaatgtctatgaataaacccataaggttgtatactgtatatccctagcagtgagattgctggatcaagagtacatacagttttcattttgatagatatttccaaagctcattttaaaactttgtcttatttaaaaccttgtgtccattgatattggagtctgttttggtatcttagtacttgctggtattttggggaaatttcagggtatttcaaaaacagtttctaggccagacagtttaactccaaatatatgccttaatttggggccataggaataaggaacttagtaaaaaggaagtgagatttctttttctttgcatgtggttggttttcaggaatatttttgaagaggtcatttgtttttcatttggagtatttccactttgtcttcactttactacttctgtatcaaggtgtgctctcttcctgttccaagtctctcactctagtactttatgccttttttccaaaatattatctgtccccagagtactactacttcctcaatatttattgttttggcttgatgctaggcataagattaatttaaaaaaatcacatcgagctaaaaatcttctgcacaggaaaggatacagtcaataaagtgaagagacaacccacagaatgggggaaaatatttgcaaactacccatctgacaagggattaataaccagaatatatacggagctcaaacaactctataggaaaaaaaatctagtaattcaatcaaaaaatgggcaaaagatttcaatagacatttctcaaaagaagagatataaatggcagacaggcatatgaaaaggtgctcaacattgttgatcatcagaaaaatggagatcaaaactgcaatgagatgtcatctcactccagttaaaatggcttatatccaaaagacaggcaattaccaatgctggtgaggatgtggagaaaagggaacccttctatgctgttggtgggaatgtaaattagtacaaccactgtggagaaaagtttggtggttcctcaaaaaactaaaaattgagctagcatacaatctagcaatcgcactgctgggtatatttcccctaaaaaggaaatcagtatattaaaagatagttgcactcctgtatttgttgcagcactgtttacaatagctaagacttggaagccacctaagtgtctgtgaacagatgagtggataaagaaaatgtacatatgcacaatggagtagtattcagccataaagaaagaatgagatccagtcatttgcaacaacacgggtgaaactggagatcattatgttaaatgaaataagccaggcacagaaagacaaatgcatgttctcatttatttgtgggatctaaaaatcaaaacagttgaactcatggatatagagagtaaaaggggatagttactagaggctgagaaggggaaggtggggatagttaatgggcacacacaaaaaaatagaaaaaatgaataagacctactatttgatagcacaataggatgactatagtcaataacaacttgattgtgcatttaaaaataaagagtgtaattgggttgtttgtagctcaaagggtaaattattgaggggatggataccccattctccatgatttgcttatttcacgttgcgtgcttgtatcaaaatatctcatgtaccccataaatgtatatacttatgtatatatttactccctccatttttttttttttttttgagatggagtcctgctctgtcaccaggttggagtgcagtggctcgatctcggctcactgcacccttcccctcctgggttcaaatgattgtcctgcctcagcctcctgagtagctgggactacaggcatgcaccatcatgcccagctaatttttttgtatttttagtagagacagggtttcaccatgttggccaggatggtctcgatctcctgacctgctgatctgcccgcctcggcctcccaaagtgttgggatgacagacgtgagccactgcacccggccaatgttttatatatttaaaacataaaaatatagttattttatatatttaatggttgtttctaagttttctttagtgatttgtctgatagtgttcctgtcagtttattgatctcttctaatttttaaggtattttaatatattaaggatatggagtttttgactgatgttacaaatacttttcaccarttgattcttaaggatttccaaataaatggacagaataatgaaattttagcattaagagacttgtttcatttagttttagtttgttttctaagaaatgtgataaatgaaatttttgaagagagcagctatttggtgatgtatgtaacatctttgacctttatttttatttgtttatttttgagacagggtcttattctgtcacctaggtggagtgcagtagtacagtcacagctcactgcagccccaacctcctgggctcaagccatcctcctgcctcagcctcccaagtagctgggaccacaggtgcgtgccaccatgcccagctcattattgtatttttattttgtagagatggggttttgccttgttgccctagctggtctcaaacccctgggctcaagcgatatgcccgcctcggcctcctagagtgttggaattacaggcgtgagctaccatacccagcaatctttgacctttagattttaactttactacctaaagattttgaaaagtgaaatcagatgttttgtacagatatactgtatatattctaggttgataatacctggtaccagggaagaaagattagcaagttatgaattacacatttgtgtattttgctgtttataaggtttttttgagctgttcatttcagtaaagttttctctgttaatgataaccttagtaaaggaaagagtattttgatttcagtagtgtgttggaatttaacttaggtatttgactgctgaaaactatgatcaaagttggtcattacttaggtgattaatttgggaaagaagtgactaaactgaamtatacttaacattttcgttatggtattgactactgtagtgattttctgtgtctacctttgtttacattttttatttcatcaagataaattccaaaatgtagaattcctygttcaaagaatatgtacatttttatagcttttgatacgtttcatagcatttgataccaaatggcttttgaaaatagttgatctaatacatacttttattatcagtagatgagtgtctttttttaatacttcaacattggatgtattttttaagagtcattatcagtttggtagatgaaatatgatagtgctgtttaatggtaatttcttggattactgctgagactcttttttatatgyttaatgactatttctaaatttttaaaaatgatttgcttgatgatgttctgtcagtttattccttactgaattcatctctatttttaacacatttcaatatattattaatatattaaagaatatggatcccttgactgatgttacaaatacttttccctaatttgtttttatgtcaggcttatttttcaataataaagtagttaggatttgatgcctttatatgaaaatgaaaatttgtgttttattctaccagcctttggaaaccgatattggtattataattttaaaattggaggcagttccaaagtacatcaataaaatctttgtatttgaatgttcaaattcttaatttgaaaatttaaaatgaagtagtcatataaaactaatttactatgttttgttgccaaacttggttttctaggcagttatacttaagcatgaacattgacgacaaactggaaggattgtttcttaaatgtggcggcatagacgaaatgcagtcttccaggacaatggttgtaatgggtggagtgtctggccagtctactgtgtctggagagctacaggattcagtacttcaagatcgaagtatgcctcaccaggagatccttgctgcagatgaagtgttacaagaaagtgaaatgagacaacaggatatgatatcacatgatgaactcatggtccatgaggagacagtgaaaaatgatgaagagcagatggaaacacatgaaagacttcctcaaggactacagtatgcacttaatgtccctgtaagtaattcctttataagatattaaacttagaaacataattttttgttacgtaatactgcaagtcatcgaagaaatttcagaaaatgtttcagggctaaatagtgttcttgaatagatatactaaaatattgacataaatcatatttgaaaggcaaaattaagttcttgtattatattattttagaagcttatttctttcaggataacaatatttctcaggattattttggtattaaattttaaatgcttaattttaaaagatattttatctaacttctaggtttctccttaaagagtaaaacatttgaatcttcaacgtaactagaaaaatatcacacattcaagggtttttcctacaaattctgtaattcttgccttcttaaatttttctaatatgctcctattctctgttctctttgtatcctccgcttgcttgatctgtttatctttttaaagtatatcagccctttactctttcctatctacctcagacgtcatttaagatgtttcataagcacccatatgtttttccttcttctacctttatttttacccaataatcagtgaaaccacaaccatcatgtaaattcttgtctcttctttctatgatatcaaacctgggttcctttcagttcatctaacatgtactttttcttttgctttaggactttaatatatcctgcttgagatattaccctcagtcatacttcatacctgttttataacctctagatagtgctccatcatcatcagcctgtcacttctcttgactctaggttgagtccctgtgatagggacttgtgatttacttgtacgatgcttctctgatggattgtagactccataaggacaggagttttgtcttacttttcactgtagtccaggtgttggcacatggtgtgaatgagcggataactacttgtagttgtgctctgatacatacattcaccagctttacctagcccattgcagtaactttttcctctttagcctgatgatgtaatggattacattagttgatttttgaatatggaagcaactttcatacctggaataaatcctgcttgtttgtggtatatagttctttttagatgtggttggatttgatttgatcatattttgaggatttttacatttgtgttcatgagaaatattagtctatagttttcttgatgtctttgtctgtttttggtattagggtaatgctggtctcatagaataaattagcaagtattccctctgcttatatcttctggaagagattgtagagaactgatgtaatttcttccttaaatgtttggtagaattcaccagtgaactgctttgggtctggtgctttctgttttggaaagttattgttgatttgatttctcctataaatataggtctcttcagattatctgattcttcttgtgtgagttttgacagattgtgtcttccaaggaattggtctattttgataaagttgtcaaatttgtgggaacaaagttcatagtattgttttattatccttttaatgtccaggggtttatagtgatgtcctctctttgatttctgatattagtaatttgtgttttctctttttttctttttttcttgtcttaagacagtaatttaaaaaaattactgtcttaacaattcccttttttttggtgtatcatttactaagttaaattatatagggttttttggggtctgtaattgatgtacatttgattttaaaaagacactgtcttatatcaggacaaagcagatttacatacaactrtcagcagaaaaaatttctgtgtgatctgaacagaggtactcttttctttgatcataagaaaatgcagtacttttagaaggtaaagctattaagattacagaagttttaccaaaatgctttaagcaaaaactcttttaagaaaaaggtatgagttctcattttctattcttagcataaattttaatactttctaatagaacctaactcttctgaatgcctttcagcatcatccaaagcttgaacttctatttctggattaaaaattcattcacaaatgagctgtgcaatacratcactttttctgactttaaacttttttttgccaaaattaaacagtacagcaccaacatttcctcagtaatcttcatctatcaataaagtgttttgcagctaatccaaaycatggagctactcttctgtaacatccagaaggaagagctatctgaatgtccattttccctagagctttctccataggtggtattgtatcatcataggcacygttgaggtcatagcctgtggcctgtgtggatccctgagtcagggttgtggcctgctcagagaatggggcaaaacggagctgcatgctgccttcctctgcaaaccagcctgtttgctgkgggtaacggtgggtgtctcttcagagcagggcatggcagagtgaaaatgcgagcagaggagagagcaacaatttttaagtgtccattttagtagtgcaaactatattgacattgttgtacaacagatctctagaactttttcatcttgcaaaactgaaactgaaactcatgttcgaacaactctgcatttccccctgcccagtggtagaggcttgcttattttattgatattttcaaagaaacagcttttgattttcttgatttttttccctctatttcctattttcagtttcatttatttctgctctaatttttataatttttttctgcttgtttcggatttaatttgctcttctttttctactttcctaaagtggaagcgtattcattttagattttttgtttctaatatatgcattcatactataaattttcctctaagcactgcattagctacattgcatagattttgatagttgtatttttattttcatttagttcaatatattttaaaatttctgttaagatttcttctttggactgggtgtggtgcctcacgcctataatctcagcactttgggaggctaaagtggcggattacttgagctcaggagtttgagactagcttgggcaacatgacaaaaccccatctctactaaaaatacaaaaattagccgggcatggtggcatgcacctgtaatcccagctatgtgggaggctgaggcataagaatcacttgaactccagaggcagaggttgcagtgagccaagattgtgccactgcactccagcctgggtgacagagtgaaactctgtctttaaaaaaaaaaaaaaaaaaaaaaattctttgaaccattattgtttagaartgtgttgtttaatatccaagtattttgagatattttctagctaccattctgttattagttgtagtttaattctgttgtggtcttagagcagacgccatatgattgctattctcttaagtttgttagattgtattttatggcccagaatgttgtccaccttggtgaaatgttacgtgcgagcttgaaaagaatgtgcattctgtttttgttggatgaggtagtctatagattgcaatagactggcatttttattggactgacagtagcctgcgccttctccagtgtatctttcagatagtttctacagtgatctttccaaacgagatgtatacatgtcattcccttactgaaacttccccagtggttcctcattactaaacagctaaaatgtacttttttgcatgggcggaaatagccgtcataatcccgtcccttatccaacttttttttttaactgtagttcagcccctttcgccaccattttatgctttaagcatatcaaattaatttagttgcctaggtccactatggkttttttctgttacttttgttcatgtcgtatatgcctataatattatttatttggcaatttactgttactcatgtttcaccttaaaagatgtctctttcttgtgatttttcattatggtaactataataactttgcatttctttgcttgcaagactgtcttgtcattatattttaaggtatttttttctgtatcctgcctttaaattttgtgttctcaatacctgggttatagtaggcaatcagattttttttgagtgaaaatatacattctgtttttaattgaggaaaagtttaaagtgaaatgttcagattctgagtttgtagttcagagttttgacaactgcataaacttgtataatccataatccatcaagataccaaatgttttagtaatcctgggaagtttttttgtaattcttcccagtcaattcctccacaacagttgttctgatattttttcttcatagattgtcattgtccttgatgagaacctcatgtaaatggagttacatgtaactcttgtgtctggctgcttttgcacaacatgttttgggattcatccatgttggttgaatgtatcaacagttcattctttttccctattgattaatgtttagtcattttaattaatatcaaaatttgtttattcatcctcctttttgtggttacttgtgttgtctcttgctttcaattactatgaataaagtggttaggaaaattgttgtacaagtcttttttcatttctcttggtacgtgtttgtgtaagtcttatttcttgtgggttttcattgatggacctagtgtctgtctttaaatcagtgtcacactgttttgattgctgtatcttttatagtaaatcttgaaatcaaattgtgtatgtcctccaattttgttgttcttttgtaatactgtagtgactatgttaggtcctttgcattttcatataaagtatggaatccaccttttaggtttttgttttttttttttttatagaaaagtcaactgattctgattgagattgcattgattctgtatattgacttgaytgacaaaccaacatctaaacaataatggctcccagtccatgaatgtagtacacctttacttttatttaggttttctttatttcagcattgttctgtagttttcagtgtaaagttattgggcacattttgttaattttatccttaagtatttcatggttttggttggatgctatcataaatggtatgttttaaaatgtcaaattctaattgttactttctagaatatagaaatgcagttgattctttttatattgactatgtattctgtgactttgttatctttactgattagttatagtagttatgttgtagattccttaggtttcttcactattgtattgtccatatgttttacttactttccaatctgyatctcttttatttctttttcttattgcactgtctggggcctacaaaacaatgatgaatagaagcgatgcaagtagacatgtttgctttgttccagatcttaaggggactgcatttactctttcatcattaagaattatgttaggggccgggtgcagtggctaatgcctgtaatctcagcactttagggggccgaggcaggcaagggattgcttragttaagaacttcaagaccagcctgcacaacatggggaaaccccatctctgccaaaaaaaaaaaaaaaaaaaattatctgggcatggtggtgtgcacctgtagtctcagctgcttgggaggctgaattgggaggatcacctgagtccaggaggcagaggttgcagtgagccaagatcacaccattgtactccagcctgggtgacagagtgagactgtttcaaaaaaaagaattaggtgtaggtttttcatagattacttttattaggttgaagtgttcttcctagtttgctgagactttgtttaaaaaacgtgagtggtttgggaggccgaagcgggcggatcacgaggtcaggagattgagacaatcctggctaacaaggtgaaaccccgtctcaactaaaaaaatacaaaaaattagccgggcgtggtrgcrrgcgcctgtggtcccagctactcggaggctgaggcaggagaatggcgtgaatgcgggaggcggagcttgcagtgagctgagatcgcgccactgcactccagcctgggcgacagagcgagactccgtctcaaaaaaaaaaaaaacatgaatggatatttaacttcatcaagtacttcttctgcatcgattgaaatgatcatatgaatatcctgtcattattctcttaatatggtgaattatgctgattttcaaatattaaacagctcttgcgttcctgggataaatcacacttggtcatgatgtatcgtccttttttcttgttgaattcagtttgctaatttaaacatttgtatgtttatgagagatattagtccatggttttcttttttttttttttggaatagctatgtcgtttttaggtatattggcctcattgtaaatgggttaggaagtgtttccttctctgttttctgaaagagtttgtgtaagattgatatttttatcatacatatttgataggctttaccagtaaagctaatctagagttgagttttctttgtgggaagggttttttgttgttctttggagacaaggtcttgctctgttgcccaggctggagtgcagagtgcagggtcacagtcacagctcactgtaatctcaacctcttaggcttaaatgatcctcccacctcagcttcccaagtagttgggactatacacacatgtcatcacatcaggctaattagaaaaaattttttttgtagagacagggtctcactatgttgtccagacttgtcttgaactcctgggctcaagtggcctcccacctcagcctgtgggaaggttttaaattacaaattttatttaaaaaaacataagtaggctattcatactaaacattttttcttgaataagttttggtaaattgtgttttcttaattgtttaattgaccaaagttctattaatattttcttttgttgttttaaggatcaatggtgatttcttttttctcattcctgatattggtataataatttttctttttcttaattagactgggtagagatttacttgttttcattgtctgttcaaatagtgaagtttcggttttatcgattttcactattcactttaacttttgttcatttttactttttattatttctttctactactttggttttcatttgctcttcttatcttagctttttaaagtagaaagtttggtgactgattttagatattcatttttgacctaaacatgtgaagctccaaacttttttctcagcatagcttttgatatattttttcattttaattcaattaaagatacttctaacttcctttatttctttttgattcatgagttaattagaagtgttttgcttaatttctgaatattttgaagttttccagatatcttttcatcattaatatctagtaagtgtggttagaaaatatatgctgtatgatttctgcccttttaaatttattgagacttgtttcagtgcttggcatatgatctatttggtgagtgttctatgtgtacttgaaaagaatgtgtattctggctattgttggttggattattttataaatgtcagttaggtcaagttgtttagttgtattcactttttctttttttcttttttttttttttgcccgtgctggtgtgcagtggtgtgatcatggcttaatgtagccttcacctcctgagctcaagtaatcctcacaactcagtctcctgagctacctggtctacaggcacacaccaccatgccaggcttattttaaaatttttttgtagagacagagtctcactatgttgcccaggctagtctcacactcctgggttcgagcgatcctcctgctttcacctcccaaagtactgggattacaggtgtgagccacaacgcccggccactaattgtattctttaactcttttatgtactcactgaactacatgttctgttagttactgggagagagctgctaaagtccagcagttaaagtttgttagccaaaagactcagttcaaaattacatgttgaatttaattgtcatgttcttcagtttttgttagtctgggttaattcatcacttttggaatttatattttacatttatttagtagaatgtccctcaggccttacctgattttttttcctccttaggatatttaagttaagcatctttggcaggaatattgtacaaataatgctgtgttttctcgccattgcattctgacaggcagcacctgagttttatttgccgtcattcagatgatggttcactttgatcaattgataccttccaggctttgctgctataaagttattccttatcacactttatttatcaatatggaattagggtttttaaaaatttgctgggttaaaatctattactgtgattattttaatactcagtttgtttaagatttggctaacagaagccttttcaagcaggttttatgttcttggacatatctcgtcagtcgttgagtacttctttgctttttggcacattatgttctargcttatcttgtcctttttctgctttagttctggagtcagccatttctccaaggaccccctagttcattttagtggagaatggtatttagaagccaaggtctgggtgctgaacatgctgctccttgcagttgggatatagctgctcctaggcctctcaatggacagagctagagaatgtatgtatgtatataatgatgtacatttacatatagtgcacatattcctttctataatttccatatctatcaatattgaaaaccatgagttcctactgctacctcccattacaagtccagcagagtacattagacggtgagaaacctggcttgttatctcagcatatttacttattttcttattatcctaacccctaatgcagatgctcctaggcttgtaagcctcacaggagtacttgctacccctgccctgcgtggatacctttctcctcctacatgtgctttgacaacttgaactagaccttagcaccaagcagaccccctccttatggcactcttacttagatacattgcactggtctacatccactctttgatactttcttcaccccacttagcttttgacatggtggtccaggctgcccttttcccacaatctagactcttccttatgctgcttgggctccagcacctcatgctgagctgcccctctatatggagaaccacctcaccctgcttggtctttgacatcttatattgggccatcctcccatgtagaagccctcttccttctgtctggtatctgacaccttgtttggccccagcttatggctttagacctgactggttcctggaggataagaggataggcaagagcaggaaggggaaaaggacaaaaatctatccttttacttaaaaatttttttattttaaaattatatagatttatggaaggtggcaaaaatggtacagagaagaccccctccatccctcatccaatttctcccagttgttacattttatataaatacactgcaatgtcaaaatcaagaaattcacattgcgacagtgtatcccatgttgagtactttatgcagcaacccctaaccgtttttggcaccagggaccagttttgtggaagacagtttttccacgaatggggtgggggtggagatggtttcaggatgattcaaaagcattacatgtattgtgcactttatttctattattattatattataatatataatgaagtaattatacaactcaccataatgtagagtcagtaggagccctgggcttgttttcctgcaactagaccatcccatgtgggagtgatgggagacagtgacagatcatcaattaggcattaggttctcataaggagcagggaacctagatcccttgcatgtgcagttcacaatagggtttgagctcctatgagaatttaatgctgtcggtgacctaacaggaggcagagctcaggcattaatgcaagcagtggggacagtgtgtaaatacagatgaagctttgcttgctcactggcygctcacctcctgatgtgcagccgggttcctaacaggtcacggcttggtgctggtccacggcctgggagttggggacccttgcagcatgtgtagatttgtgtaaccaccaaagcaatcaagattcagaactaagccaggataacaaagatctctctggtgctaccccctatagtcacacctcttctcttccttccatcattcctaacccctgaatatccttaatctgttgtttatttctagaactgtgtcatttttgagaatgttgtatcaatggaatcctacaggatgtgaccttttggaattgactatttttttcactcaacgtaatgctcttgagagtcgtccaggttgttgcatgtatcagtaatttcttactgtttgttttgtagtagtgttgcatagcaccaatgtaccgcagtttaccattcacttattgagggacattttagttgtctccaggttttggttattaaaaataaagctgctattaacatttgtgtgcaggtttttctgtgaatataggtattcatctctagaataaataccctaccatacccctatcacccagatacagtcactcataacattttaatgtatgtgctttatgcttttttgataagcatgccatacataagatcatattgctttttatgtagtcttttcacttaacagtatattttgaatttttctcaattgtgtgttcttctaaaacaacttcagtgtctgcttgataattccatttttatggtaacccataattcagtccttttattcctaatagataatgataaatttgagtccattctgaaaatgaatcaatgaaaagctgtattatgcgatataccagatgggcagaatttgcaaagtgtttgcataacattggtttatagtagaacataagagacatgagaaattctatcccttacttcttacttatgggttcctgttgataaggcagggaggtaaagggcaggtctgggtttcattaatgtactttttttttcttttctttttttcttttttttttttgagacagggtcttgttctgtcacccaggctggagtgcagtggcatgatcatggttcatggcagacttgatctctttgggtcaagtgatcctctcactgttgcctccaaagttgctggcaccacagttgtgtgccaccttgcctggctaatgttcacaatttttttcagagatgggatctcagtatgttgtccagactgctcttgaactcctgggctcaagcgatcctcccaccttggcctcccaaagtgctgggattactggtgtgagccaccacaactggccatgaatgtacttttatttatttatttttttgagatggagtctcgccctgtcacccaggctggagtgcagtggcatggtcttggctcagtgcaacctccacctcctgggttcaagcatttctccctgcctcagcctcccaagtaactgggattccagatgcccgccaccatgcctggctaatttttgtatttttaatagagacagtgtttcaccatgttggccaggctggtcttgaactcctgacctcaggtgatccacccacctcggcctcccagagtggtgggattataggtgtgagccactgcgcctggccgaatgtacatttttgaattgaagagagaacattgatctagaatagtatgatacaggtccccaaaactgtagaaacttaacagtcctttactcaagtgtttttctagattgtgctaaataaagccttttaaaaattgatattgagcatgttaatgattttcttctttgatttgctcattcatgtggaaggtacaaagaactttatgttaacttattttggttagttcaaagcaaaaaaatgagtttttagtgttttaaaattatttaagttctgtagcctatgtaaactcgctagtgtttggtgacatttgaagtataagtcatcatgtgtgataactgccaattttcaggatttattttggctctctaagtcactcagatttagctcaatggcactatgttttcaacagcaaaatataggccagctgtttcttattttaataaattttattaatagtgatggggtctcgctgtgttacccaggctggtctcaaactcctggcctcaaaagtgatcctgctgggattacaggcatgagctgccatacctggcctaggccaacttttgaacgtctacatctttctcattagaactttgttttttaatattttagacatttaaattagattttaataaaattaatttttcagttccttggtcacactagtcacatttcaagtgttcagtagtcacatgtagctaatggcttctgtattggatagcataaaggatattttcatcatttcaaaatattttattagatagcactatattagaaagcctctcaactcagaaacaaaatttatttcagcaattaaaaaaactatttggcttayccattttacacttatcagacccattcaggaggatttagcaaatcataaatttttatggtctttattttttcagtttggtggcaagcatgttaagaggaaggacttatgttctgtattagcaaaacagagcaaattgtaattcacagtgatgtatgctgcattcatcttctagaaaactattgctttgtatcacttgagtgaaaagattttataaagtaggaactatctaaaaaatcatgctctagtcacataatgatgtaataaaatatgaaatatttcaggcatgtgtaattccttaaaaaatgctttagcattcatgtaacattgttagtcatgaatttttgtgctataaagcagcatgtgtaaaattgcaggcatactgttacgcattttcgtgtttatgattaattcatttaatgacccaggaaactcaaaacatatttggccattggtataagacctctgttttggtttttagtttttaaatttccttgaatcctatcgttagttatacccaattcttaattaccattgcatttcttttaaagtttatttgagggattcagtagtagttttggtttttgcactggctgttgggtccttaccttttgaagtgattgcattgtcttttattggggatatatgtttcaagaggtgcttcaaaaaatacattcaggccaggcatggtggctctcacctctaatctcagcactttgggaggctgaggtgggcacatcatttgaggtcaggagttcaagtccagcctggccaacatggtgaaaccctgtctctactaaaaatacaaaaattaggcaggcatggtggtgggcgcctgtaatcccagctactcaggaggctgaggcacgagaattgcttgaacctgggaggtggaggttgcagtgagccgagatggcaccactgccctccagcttgggtgacagagtgggaccctgcctcagaaacaacaacaacaaaacaaacattcaaatcctttttacgtcagcgtattatttgaatatcattttcacaagtagtttaattgagcttgttttaaggagaatagatggtaactaacttcaactctagttttttcacaagattttactctcataccacatggctctttaaaaaagtgtattatctaacagcaatcattatttgggcagaaagcatggactgagtgctattcctttcctggtgagagtcgtgtttattgcttattattaatgatttcaactcaacaggcaagtagatgaatcagattatctcttccagtagattgttttagggagttgacccaacatggtctatttttcagtatcctcacttgttcttaaggttgtttgacccagtttatatcctttttttcccccttaagtagacatgaattgttggtagaagatttctttatagatgactttattatttttatttttaaattttttacagagatggaaacttgctaggttgcccaggctggccttgaactcctggcttcaagccagtcttttgcctcagcctctcaaagtgttrggattacaggtgtaagtcaccacagccggtttccagctgactttaataacataaccagtctcctaacactcttaatatagttctgtctgacctttgatgtctaattgcttcatctggaattgtgagacagtggtactgaaggagagttatgctcttaaactagtagtacaccaactggaaatcatttaggacagggtatgtagagtcagcctagctacatcagtttcagagaggtctactttggtgtttttatatttgcattttattataaaaggactacatagtcattgtaaatattaaaacaaggtagaagaaataataaagtgaaaagtaaaatttccttctttccaatgtctgtctactactctaattccaaagaaatagctactaatattgatacctttctggaagttttacatttataaagaaacatattgtgtgcatgcatttatgtctaatacattttggatatataatacatacatttggctgggtgcagtggctcacgcctgtaatcccagcactttgggaggccgaggcggacggatcacgaggtcaggagattgagaccatcctggctaacatggtgaaaccctgtctctactaaaaatacaaaaaaaaattagctgggcatggtggcacgcgcctgtagtcccagctacttrggaggctgaggcaggagaatggcatgaacctgggaggtggggcttgcagtgagctgagatcacgccactgcactccagcctgggcgacagagtgagactctgtctcaaaaaaaaaaaaaaaaaaaaaaawtttaatataaatgtacaatattttgttttattacataaattggataatgctatttgtatgcatttgaaatttacattattcatttaatgacgcatcttgtggagatttccatgttattgcatgtaaaactgccctattttaatgagtgattaaaggatatgccataatttatttaatcacattcctctgttgattgacatttgttattactgggtttgtttgaatgaaataattggaaaggagcatgtgtgtgtgtgtgtgtgtgtgtgtgtatgcacatttataacattgctctaggtatatgtctttttattgaaatgtaacatttatacagaaaagcgcacaaatcataagagtacatcttgattaaatttctctgaagtgaacatctcgtgtaactgctatcaagatcaagatatagaatcccttttggtcacagcactcctctagttcctaaagattactactaccccaacacttttgtcatagtctattagttttacctgactttgaattcgaaataagcagaatcataggcactatatactaggtatctggtttctttattttcattgtttatgagatatacccatgttattgcatgtaatttctgtagaatcatcagttgggtgaatttcatttattctagtctaatagtcatttagattgtttctagatgtttggtattaagtgctgctgtgaatattcttggatgtcacttgtgtgtgtatgtactcatttctgttggttatatacttagaattgaatttactggatatgcctatgttcagctttagtacatactgacagaagttttttaaattggttttgccaatttataataattgctctatatccttgctatttgatcttgtcagtccttttaagtttagctgttttggtggtatgatagtggaattgcaatatgacttaatgtttcatttcactagtaactaatgaaattgattatcttttcatgtttattgacaatttaaatattattttttagtaaggtagatgttcatcttttgcttaattttctagtaggttgtttctttctcttacagatttgtagtagttctttatccactggttggatgcatgtattgcagtgatcatttctgactctggtgggtctttttacttttttggtaaacaggagttaataaggttcgatttattgtataagtcttttccttttggtattttttgtgtccttcttaagaaatttttgcctgtcccaacattgtgaagatattttccttttttaacttttggaggctttatggttttccgttcccatttagatcagtaatccactgggaattgatttttgctggtgatgtgaattgtggagattaagatttagttgatagttctggtttctttctcaaacttacccatagagatttcctttcactttactttgctgggttagtgtttcagtttttagaacaacttagtatattaagataataatattttttttaattaatggtaaggatttgtgctaggactagatttaatatctttttaagattgaaaaatgtataaattttaaaactataaagaaaataaaaattgttataatcttactactttaggaaaactgctcttgacataccattgctagcattttaatgtttctttttttgtttttttttctatgtaggtagttggtgtgtttgcataaaatttgctgtgtctatatttgtgtttgtataaaattgtgaaaatgtatttatctacatgcctatttatatttattactttaccttaaaccatgagcatttcatcttggtcattaaaagtcagatttctaatatttgtataatgccatatagctgtattataatttatctccctatttctttattattgggtattagacatttgcacccttttcttactgttataaataatactgtggtgttgtatatgtgcttttttgtcatgagaaagtatttcctcagtataggtctcttaaggcttttattgtatattggccaaattgtagtctacaaaagatgaccctctagtagtgtatgagagtcccaacttagtatcattataaataatctaaagaaggaaatatgaagtataatttctagatttgtatattatatttaggaagaacagcaacaactggactttgtcctgggtggaaggtagaaaagaaaactaaaaaatagcattggctgggcatggtggctcacgcctgtaatcccagcactttgggaggccgaggcgggtggatctcttgagaccaggaatttgagaccagcttggccaacatggccaaccctgtctctactaaaaatacaaaataattagctgggcgtggtggtacatgtctgtagtcccagctactccaaaggctgaggcatgagaattgcttgaacttgggaggcggaggttgcagtgaggcgagattgcaccactgcactccagtctgggtgatagagcgagactctgtcttaaaaaaaaaaaaaaagaatctttagataggatactgggatgatatattgaaaggcagggaatttagaaggaggatctaacgtgaaaggaaagatttttttttttggcatattgagttttagatatcaagatgtctacgtagagatattttatagaaattgctaatcctttgtgtatccaagcagttacacacctattaattgtatgataattaataactgtatattcgtttagtgctttaaggtgttcaaggtgcttttcatgtaatctcttttgattttctgatgtaagatggatattattactactgccaattaacagatgagtttattatgatactaagtagcatcaagaactacttcatactgctctgtactgtagttagtactttacagagttatcttatttaactctgtaaaaatcctatgagattttcccctccaggttacaggtgagcaaagttcggcatgatcccaattttagttgttcaacctcacacactgttagtattactctttgaaactggattttatttctttgaattcccaagcctgtgcttttcttgttttgccatactacttctggaagccaagttcacctagctaataattggaagagatagtattgaaatccaagtcttctaatgtttcatctaaatattcttggcattttgtctttttttttttttgagatggagtctcactctgtcgcccaggctggagtgcagtggcacgatcctggctcgctgcaacctctgccacctgggttcaagctattttcctgcctcagcctcccaagtagctgggattacaggagtctgccactgtgcccagctaatttttgtagttttagtagagacggggtttcaccatcttggccagctggtcttgaatttctgacctcgtgatccacccacctcggcctcccaaagtgctgggattacaggcatgagcctctgtgcctggccaatttttttttaacattttattttcctttagtaataatcactaggtgttctaaaaccactagaagtttttttcttattttgaaagcaaccaaactatagttcatatgtggaaaaatacagtatgtttctataaaaagcatttttaaataagtttgaataatttagatttattgaaaagcagtcctggactgaaaggtatttgatcttaagtcctagttgtacaacttaataacttgggtaagacacttacctccctgaaattttagtttgtttattggtaacatgaggataagaaagaattcacagatcacaatcattaggatcttagtcactggattcagaagactttggtttaaattttgtctttctgtcttaattactgtgcttttaggcaagtaactcaaccttcctgggccttagttttctatttttttaatgaaaattcttaacatagtgttactgtaggatttaatgcaatagactatacaggctagagaccatgtcttccccatgtattgtattaatatcttcagcacttaggacagtgcatggtagtgaatgtctgataaatcttagtatatgctgaggaggcagaatcacaaactcataaaaatgccatgtaaatgctgagtatttttgtagttagaaaaatcagagtctagtttaacttttcattttgaaataattttatacttaaagttgcagaaatagtagagtttgcatgaacttttcacacagcttcccctaatgttaaaacttatgtaaccgtatggtacagttgtcaagaccaagaatttaacattggtgaaatagtattaaactacagaccttgtttgaattttatgtttccctccaaataccctttttctgtttgaggattcaattcaggacccacatttcattgagttatcctgtttttttagccacctccaatctgtttcagttgaatgcagacttttcctcatcttttatgacctttatactttgatgagtgttggtcagttgtgttgtagactgtttcttaatttgagcttctctggtgttttctcatggttagattgatgctctacatttttgactacccacagaagtgatgttgtgtccccctcagtgcatcatatcgggggcacataatgtggataggtcttaaaactggtgatagtaaccttgatccttctttactgtgattatctgccaggtttccccactgtagagttactgtttttttctttataattgacagataatcttggaggagatactttgagaccgtttaaatatcctctctctcaaaattttgcccactaacttcagcatctattggtgggccttgcctgtaatggttattaccatgatgtttacctaattgtgatttttgtcttttccgcattccttctatattgatgttccttgtagctgtcccatttcctccatttatttgttgtttttactgtttcattttgtatctgtggatatgcattttattctgtgggttataatccagtactgttgttgcttacgttcttgctcagattccatctttggtcattaggagctctttcagtctgggtcttatgtccttttgacatcctctgatccttttttgaacactttagcttctgacattatgattttctagagtcatcttatatttttccccgacccagctctgggctcaaccacttctcagagaactctggttcttttttgtttggataatggcatttagaaactaagttctggatgctaggtgtgttgggtgtcgttgcttttcagtgacctcagcaaacaagctaggaaaatacatgtatgtctactaacccacacatgcacacaacatctatagtaatttctttatattggtagggcccgggcatctgtattaaaagagattgagtgaaagagagaaagggattgtatagttaagatgtatctagattagcagctctcaaatgttctggccgtggggtccctttatactcttaaaaaatactgaggactcctcagagcttttgcttatgttggttatatgtatcagtatttaccatattcaaaactaaagctgagaaatttaaagttttatgtattaatttgtcacaataaaacttactacatgttagcatgtaacatttgtaaataaaaaataactgttttccaaaacaaaaaatttagtgagaagagggaaattgttttacatttttttgatatctctttattatctggcttaatataactggatataatgcatatctgtggtgacatatattaagtctgtgatgatatcacattttaattagcctctgtaaaatgccactgtatacttttaagggaaagagagttttaaaaagcagctactattgtgaaagtagttttgatgtcatgaatgacctgaaagggcataagggaccttcaggagtccccatgctatgctggctgtttcttgcaagttctaaaacatctcttaattaccctgacctttttctcattttcagtctttccttttttattctcccgactttaaacataaagagttaagaaccactgatgtagatttactgaaactgttacaaaatacaggcacatattactggaaggatggatccagaagaactgctatgaagaaaaggagagaacttaaattaggtgattttatggaacttggaagactagaatttccaagtaggatagggatggtcagcactgtttcaggtaaggtaacttgatttgatcagttcatctagttaatctttaattatgtaaactataagatgctgatatagtaaccagagtttacatttatagtgagaaatgtaatagggaaatagatcagaatgtttgtttccaactgtggctctctgaaccttttcgaaaatcaaaggatagctgtggactttcccctaacaaatgtagctcctttcaaaattttgcatgcggtcatggatcaggcaaacgggacagatatagttcgtgattcacacaggcctatccatcagtgtactgcttcacctccctgtcctgttctgtgactttgtgagcttggaatttgaagtcttcctgttgtctggttacatcaaactgttcttgcagttctatcttggaaatatacatgcaaattaaatttaaatcttaaatttctccttttctggactccatgaatacccccaaatattgctgacattcgttagacagtacgtttacagtacagttaattgtgttatacctttccttttacatttaaactagttatacttttagtcaccttgatttaacttgggtgtttcctaggcaatattttggaacaggttccttctagtgatagttaaacacatctttttttatatggctgtgtatactacttttactctcagaacaaccatttctctaaatttgggcacagttattttatctctgtatgctgactacagattattcttttaaaatgtttggccaaaagaaggaatatagtagctggaaaaattttggtccacaagaacttacaggggaaatttcagtgtgcttttaagaagagaagaagtagctagtagtgtcagggagactataaaatagatagtgaagcagcagagctatgaaaatgggtgggaatggaatcaggagtataggggaaaacagaaagaccaccttccttttactctactgggttggaagatgagtgagaataccaaaatttgaaattgaaaattgataggaacatgtgacttcagaaatggagaggagtgatggtaaggtcatatccttctgccaagtaccttaggtcttttctgtaaagtggatcatatagaattttgaaagctgagctggggagctgataatgaatactataggcaacagtctgttgccaattcctcactgaggaaatgttaaggaaatagttttatattmatttatttgtagaagaatacattgggagatgataatgctctaagtcagtgaggktggtatggttaattggagggaagtggatgtcactgggtatgggtgcaggatgttgagaatgaagagaagagtctaaaatgattccaaggagtcagtcatcttgtttggaaggtggggagagggggtagaccaaaatttgcaactgtagtgaaayatttattcatcacattgtgtctggcaacattattttaggtacaatttatatttgttacatcgcttattatcattattgagactaggtgaagttaagaagagtagcagatttgcaagaaaaagttaaaaggggggatatatgtgctaaacttgcagctgtcattgtctgttgtttcatccccaaagcctgatgcagttatttcacgttgtctttatttctccctttgaatttctacccttattctctgttctgttcagttagagtatgacacatgtgctgtctgtattaggtgtttttttggtaatgcatcagaaccctgcacgtacattttaagacctttgaaaaggaaatctgatatttagaatgtgcttagtatctagaatggcactttgcacatattacaatctcagtaaatgtttttgttatagtattttagcctgacagagcaggcacttaatagctgttgaatgagaaaatgaatgacagctattataagaaataccaacaaagagtatcttactttaaaatatcaaaacagtwtacatgtacatgaaatagttaaatataaaagtaagactttattttggggtgagaaataagtcttgataaagcaagtcattctggagttgagttaatgattagaatcaaaggaagaatattttcagtatagggaggactctttaaagtcaggaaaataaagagggaaagattgaaaatgagaaaaagggtaattaagagatattttagaacttgcaagaaagaaccggcatagggagtggcaagaggagaggaagcatgacactataggtctctacttctgtcttaacctggggaagaagttagatgagtatagaagggagatatgaaaaggaaatcatgtctgaccgcttctgtagtatcaaagtgggaagcccagagggagactgactcagtggatgagcaggggctttagagttttaggagaaatgtctgagtttagtcaaatctgaagaaagaagggcaggtagagtggtggtggatggtggtggtggtggcatatctggactggtaataagaacagcattgaaattcaggcctgcaaataagcatgagggtactaatgggactaggtgaaaatcacagtattaatataatcactttccatatatgtggaaataacaggttcagatatacgtgttaatcttttttactgtttgcatttaaaggctcttggttggtttgtgaatggcagttaacagcagaacttatttatgaatttatcttacactcttcttgacacttgctaaaaagagttcctcttttttrttgccacatgctacatttccatggtttatttggaatttacacgctgacagaaatgtttgtactactttttggtactccttcaaaatagggcagagaaattccacagctgcttacatagtctgttatctcttcttgtctcatacccattcccagttattgtttttcagtaaataccacttcagaggtgataagaggtctgtattcccaagtcttgtaggtggtgattttaccatcgtattttgtagtcaaaataattgataccaacgaagccagaagagtggtcactgtacccttctgtaacttggtagaattactagctaaataaataatcatttacatcatgtttttgtgccagggttcttgatttgtgattctcacatggcctgcatttcaggaattcatgagaacttccactttttattttgtcagtatgaaattcctggcttaggttgcattttttctcgtgaacctcttctacatagctgttttccacctttacactgaatctgtaagatgttcatcatcttttgcaccatgctttttagtgtgtttcttgaaaatgtagccattagcacattgtacttactgaattattctcaaggatctttactgtattttatagcctgagttgaaagtttcctagttttaaggttcttgttttacttcaaggatagattgaaaatgtagcagtgaggaggggatgactgaacaccatcaaatctgatgagaactgacgatggtactgttagtgatcttagaaccttggtttttcttttctttctttaaggacaagtaactctgagaattaagatctgaaaattgaagaacattgttgaaatcttaatgtttcttctagtatttctctattatgtagttagcatcatgtcttgtacagtgtagcagcctaaaattataattgcttctataaacacatatttggtgatggtctgttgtagagcccaggaaagtactggctgagatcttgagtcatatgacaaaactgttgagcatgaagataattagattttcattgttaatttgtctttcttttgacaaattatcttttagaatttgtgtggtttacttgatattttataaatacagagcccatctagaagtctaaatacctcttttattccctagtattgtgttgaattttggaccttaaccttttttgtgcgcttttaacttcagtatcagtttccttaaatgtgggaatgaaattgatgttacgatttcctgacttctgcttggtcttatgatcatcttttcccaggacgtctttgatcttttttctcaggtagattaaaaaaaaaatctgtttatccctcaatttatgtactctcaattcttattacccactgcctattaatgaattctatagcactgtatatagttaggacacacacacatagatcatcattctggaagcacctgtatgtgggtttagcaaaggattaaacataaaatggccttttgtcacaatgaactttttatttatgtctaaaattggcttttctttttttaaacagataagcgtaaagcaggaaattacttttactgatgtatctgagcaactgatgagagacaaaaaacaaatcagagagccagtagacttacagaaaaagaagaagcggaaacaacgttctcccgcaaaagtaagacaatgtattaaggtggtaatcacaacctcttaattccaactgttggttaattctataggcaagaacctggctggaccctaaggcagatgtagaagtcttgtgtggtttagtaggagggggtgcgtgcctgcatggaggtggtgggccttgctttcaatttttctgcttctctttcaccatgttcctgacttgtctaaaagtgaacttttctttttccatatctctatcggatggcatgcattgccctttcttctcatttgtattagttttccttatctttatattaaggtttcaggaaaatgtaataccagttattcatcaggaaaagatataggatccctgttaataggatgtaaacttcatgagggcagggacttcattttgttcacagctgtatcctaagagcctggaataggagacrtaatagatcctcagtaaatattttatgggttaatgaatgggttagtaaataaacaagtaacccaggctgagtgcagtggcatgatcatggctcactgcagcctcagtctcccagtctcaagggatcctcctccctcagcctcctgagtagctgggaccacaggcatgtgccaacatgcctggctaatttttgaatttcttacagaaatggggtcttgctatgttggccaggctagtctcaaactcctggtctcaagccgtcctcccacttcagcctcccaaagtattaggattacaggcgtgagccaccactcctggcctgtttttttctctttagtatagtgatagctgaatgtatacagcatttttggtattcctagaaattctctgaactctctgcagcatatttgcatttttatagttaactcttatttttttcttccctcatgtggtgagaaagtcctttttaaaaagatcatactgtaatatgatttttttgatggctttttaraaatttgtgatttgaaatcataatcatcattattatttatatttttgtatacttttggmcttattagtgtgttggagccagcttgagctggcttgcaagatttcatttgcaaattagttgccaaaaccattggtagcttataattagctatggtgggaatatttacaccctggaaatcagcaaatgtttctatacctcctgattccttagttggtggttaaatatttgccagcataccactattttggggacatataaatatgcctacaatagcaaattttgaaaaacatagagactaaaataacccatagttacatttcctagagataactacttggattttctgccatattccctttcttttttcaaatttgtgcagatagatatggaggtataatatagaataaattagctgatttttaacacttgaaatgtaagcaacttttgtgcttaaagtttttaatgttttttgtaatcatttattagctacataatctatttcttaatagatcatgttatatttaatggttgttttattggacattattatgttgtttgaaagttgtagtccttttgtttctgttttaaatcatgctgcacttaaaatgtttgagtatgtatctttgtgcactattgatcaaagggtgtgaacttttggaaagatttcttgataatgttactcttttcagaaatgttataccagttacacttctacctgcagtggacctgaggtgtatctgtctgcattctcactggtcttgagtgtctgactttgcttaagatgggagcctcattatagtttaaatttgaatttctttagtttctggtcacactaaacttctaaaatttttgttggcattttatatttcatgttttgtgaaattctcccttcttcttttcttccctctccctccacttctttttttggggctttaatgtttttctcagtaatttatatcatttttgggggttctttacattaatgaacaaatcaagttcttcagatatagaataatactaggttttatgtaaaaaattatttctaaaatcrtttgtgatagtgattggttgttacttcggattcattgctgatctatggggtatctatttcaagtgtactctcttcttgaaattctgactaaaacccagattatcttcttattgggtgttggactctgtatttggtgatatgttctaggtatttgtaaatatagattaggtatttacaggctttaagctattttgcttgtctaatttgcgataaactcatttataatgtatcattttagaatatttctaaaggtattatttaagtatttatatacctctgtagttgccagatgacggagttgtcctattctaagtatagtgygtataagagaatgttttagggtagccctttagagaattcttaggaagatgaartgactagaaacaatatacagcagacagaggtgtaagaataacaaacaggccaggtacagtggctcacacttgtaatcctagcactttgggaggctgagacggaagaattgcttgaccccaggagttcaagaccatcctgggcaacattgtggaaccctgtctctggttttgtttttttttttttttaaataaagaacaaacaattatttttcaattgtcctggcatgttacatgtaatgggacagggaatggttttggactgttttttaaccactggtctgccatctccaggtgaatgggttttttgtgtctggagtcttagaactttaagatataaccagtgagtaattttacattttctcaggagtgtatataaaaatttatgcttcagaacttctgttaaaataattcattctgctctttggtatgaagagaaagagaaacttacccatgtttgtaaatcagtaagtgttacttgttttaaattccttaaaaacaattttaagttcctcaaagaattatgatttattatgcctagaggactccactctcccccagcaccttttccaaatcttaaaatcttgccattgtgaatattttgagtttgtgtcaccattgtgtagtattagattggggatctgcacaagaagtataactaatgtgatagagttttagtaaaaacatcagagcttataaacatccatgtaactatggctgccttaaagtactgtgttgttattccatctttagctgccatggattttaagcaataattgccttctgaacttttctcatatggcaaagctgagtctttttttttttttttttggaaaacttaaatgcaatgggaaagcctgatcatcttaaggtaggttttgacacttgaaatttgcctaaatacacttggcagcatgcctgatgaagagggtaactgagctagggaacatcatctaggtcaagctatttgcatctgttgtggaattagctgttttaagaaagtaagttttctacataatagaagcttacaccttttaaatatcaaatttcattttattttcaccattttttkggggaaatctttaaggtgttgttttccttttaaatctagtgtatttgaacataattcagcttttaatgtcttgaagctgacataaacattttttaaaattgcgtattgcagttgaagccctctaggagaacagagattttagggctctcccccatccacctgaccctgcaaatccacactgctagactttaagtgttatactgcttataatcacttcacttctcattccttggtgacgtgctattcatttttacattgctgtatatctgggtggccacttaacatcactttcctttgcccctttgagtctgtttttggtgactgttatactcttaagcttgaaaacttcaaatcttgacactagaagtttctgaataaatgaggtattactactggactttggtattcacttgttacatgaattagaaggtaacagtttccatctcagaagggttttaggaggattgttgggttaacattaatgaaatctaagaatttttttcagtaaaatataacaatattatctaaatcccatgttgtatatattatataggtcttttccamctccttagtaactgaatgagagagaggatatttttaattccttctctttattctgaaatgtatctctcttttcatttattcaacaaataatttgagtgcctgttatgtgccaggatctctcatcaggtactgaaaaaaggaactgggtttgttgtaacactttaggtgatctgaataaaaattcattattcaaagttatgctgaactgaggaagagcacttttcacacatcagatagattatataatagagaatcctttcccagcaatttattatatattgttggttcccagaaaagattttagactttggtatcagaaagattgaattatgtaaaataaggaaaatttaatgaaaagaaacagagaagtagatataccagacatttgycatgctttcttctacatgttaccttgatttaggaagaagtagctttaaagatgaactgattataagacggaggatgcaaacaggaagtatggaatagtaagaaaatgaaggaagaagattggcaaaataatagagttttatttatctaattttcccaggaaattgtgtgtcttgtataaattgtttttccatagaactgaaccctaactttgaaaaaaaatctgatgtaaatctttctttagaaaatatcacctacttctttgcctaatattcaggaaacagggaagaaacagcctttttctaaaacccagggtcattttgctgaacatagttgttgtgccatgcttatgatacagtgaatttcttgttctggtgctgtcaaaagcttrccatttaaaaaggaaatttggtgatgagaaaaatctagtactgagaaacaataaaaaatcttgatgaatgaaagaaagtgacaatgttagagtaggttattaacgatgaccaggacagtcaagttgccgtgatgggtattactcagggtgactttgttatttgtatatctttggacttgcactattttccatttctcattggatttggagagtaaagagaattgtcacagctgtcattctccatccccagttgcagtagaacgtctcataataggtgagaaatgtaaactctcttatctaattagtcttttgagttttggtggcttcaaagttgattttgattgattcaggaatatatgataaaaacctatagtgtttagtttaaaatatgctttaataattttagtagtacacatttgaatgtgaaaaatcatgtctgccttttaagaaaacagaactttttctcagtgaggggtgtcaggtttcatttattcagtggcagtgatccttatggagtgaaaaatctctgaatttgaataggcagaccttagggctttgcctgatgaaaatgggtatattatttaagataacctttaccatatgtgtatatttaggtagctggctggtaatagatttgtcttaaaacagaaaatatgtcataatggatatgagattaagaaagcagattaactgagaaattccatttgatactcaatttttttctataaagtcttgttttaaatttactaaacagataagaaaaaaaatgtagtgtgttgagaattagagtattactaatttctccacttgctaaaacctgattgcttggtctatgtaatataccatatttctcctgaagtagcaatgacaaggggcaagataaagcatctgaagatgtctagcaggcatcttagaattcaaaattttaaacataaaattcttcagttgtaatggtgtccatatgttggggaaaaaagaaaagcaaagatgttttatggaaccagttgcaggtaagactgctaatctctaaggcaaacacactcagctggtagatcacattctactaaaagatcttgaaaaggtgtgagcaagaaaagaaggcaagtctataccggggaagaaaattttgcctgcgttagtgtgctatttgtgttctgctaagggattttattctttgcctacccgcttctctcactactcagttatctgaagactaaaaaattgaaaagtaaagtattgcttttagcaacaaatttaaaaaacaagaaagtggtaagctaggaggagtaattgttatggacagcaggcagccaggtcctttgacaggtatagagtctccactatgctccagataccattttgaacactgagattataagggtgaataaaaatcagttggatatatttaaaacaggttacaaattggaagggccattgatgctcatctgagtcaagatgagtttactctatgtcctttattactctggcctaaaaagaaagtaaggaaaatataaaatgtccaagaatttggtgtttctgtctttgaacttaaaaaaagctagattttcctgtgtgtttatccacaaggcagtggtagctgtttcatccataaaattcaccttgaattaaggcttgaatctacaatgaaaggcagcagtacctccagtgccagaaaacaatgacctagaactccttaactcttcataaaagggctttgtacagtcaaggattacatccgtttcacattaagcaacttgggccagatttgttctttacaaagcctttccttgcagttgctatgccacagaaagctattgaagtgccatgttttttggcagttggattttcttatttgttatcaacatacatgaaaaaaaatacctggtgctgtcttgtttttagttccattttatataagtatttaacatctttttgtttgttttatgtataaaatattttgagtcatattttaaaagattttgtgtgttttccttttgcacagtgttaacttgcttattattatgtgacttggaggggttgaaaaaattcaaaactgactggcccagagatgaagctttccactttctttgactctcctcaggaagctgtgacacccacttccattctcctgccaaatgtttcccttccatgactttggtgcatagactttgaagcattgttgaccacattggctgtttgcccagaatccaaatgccctgtataatttgcataataattaccactgatctgcatatagtataggctgaactgtcttcttgaatttaaagtaaaaatgttttaaggattaaagcttttttcccttacgtactgcccttttctaggtttgagaaggggtcatagctgtgtgtttgcaggccctaatcagtttccacagttctttatatttatttcccagatttctctacctttgttggacagtttcttagctcccattctgtatgcccacacctacagcattgtttccctctcactggccatacccctcctgatcagatcttctagttttctttgctgtttcagcataatrttgtgcctttttttttttttttttgctttcgtcaataatgaaaaaggaatcattattttcactcttccacatgtctgatgaaaggcaatttttttttttttttgagatgggttttactgtattgcccaggctggagtgcagtggcatgatgatggctcattgcagccttgacctcctggcccaagtgatcctcccatcctcagcctcccaagtagctgagagtacaggtgtgtgccaccacacctggctaatttttgtattttagtggagacggggtttcctcattttgcccaggctggtctcgaactcctgaactgaagtgagccacccacctcagccacccaaagtgctgggattacaggcttgagccaccatgcctggccaaaaggcagcttaatgttgcacattgaacaagttgttgataaattggaatacatgcagcctaaggtgagtttctctgtggtaccatccaaaccaggcttgcaatactcttaatctcaataagcccagaaagacaaggttgctttgtctcttgtcttccttctttttacccacttctattttttaaaaaactgaatttataagtgctgaataattttcttattcagtacttatgccccagatggaccccatacccacttctaatttatttatttgacaaatattcttaggaatatgtttaataataatttagtagttctagaataaccttagtgatcctagactgaaacagaccataaattctaccatattgtaacttgaaaagttagtgttctcttttttttttagtaataggtaaccacttacatggttcaaaaaaatgtgttaagtggacagtgtaaaacctccctcccattttatctcttgtctgcccagttccccagccatcacaatcaaggttatatacttctgtatatatatccttctcaagtagtttttatgcctatgcaaatatatattcctatatgtaccttttatatacaaaagttagcaaaactatacactgggttctaaactttgccttttttttttttaacttaacaaatcctgacacgcttttcatataagtatatagagagctttgtcattttatttcacaaccacataatattaaattgtattcattttccatgatttatttaattagccccatactgattgatattagatcatgtctaaaggcttttttcctgcatatatgagaatttgaaattgaaaatatacctgtgttcaccctaactgaagacttaggaactccatcacgcataagcattacagaggagaaggccgtgatgagatcttacttaaccagcttccaaggttttattagtgatttttgctcattctgagtcacattgtactttcctacagttaatgataacattattctaatagtcttttcaagatcatttaagaacaaaatatttcataatctgtggtgaccgttgtttgcattatcttttttttaaaattactatttaattacattttaaaaacttatttcttttgtttttgcctttttttttttgaactagatccttacaataaatgaggatggatcacttggtttgaaaacccctaaatctcacgtttgtgagcactgcaatgctgcctttagaacgaactatcacttacagagacatgtcttcattcatacaggtatttcttgaattaaaatgggcttgtggccattaaagttattatctttgttattttcatcttcgtgtaactgtcattcattcctaagaccatagctaatctggcattccaaatcagagattttgtaggccagaatgtcagaaggaaaccaggaaaaactcttaagtgagaaaacaattagcatggatgtgtaaaattaattaaatagtcttaattggacacctgtttggcttaatgtgctccatttagctagagaaatgattaaagaatgtattattaaaagcctgtttatcagtgttcattttttgtgtgtgcaaaatgtccaggcagagtttaaaacatggatttggaaatcaaatataaataaatgatagctaagataatgaaattgtagagaacagtattaaagatgacagacctttgggtaaacaaactagacatgtaagatgaaatgaggaagaaaaacagttataagggagattcattgaactaggaaaatagtgtcccagaagctagtagaagatagaattccaagcaggatgtgaccaacagtgccagtgccctaggaggatagaggttagagaaccaagaaaaaatctttggaataaatagcaaggagatcacaagtagcttttcagaaagcagagtataagggttaaaccgcaagtgggcagtgaagaatttgacttagagtagactactcttttaaggaggtgtagtgaaagagaaggagagaaagtactaaggtagaagtgtttcaggactgaaacaaggtttctcagcatagagcaggccagagaatactttccttaaaaggaaaagccccagcagagagagaaagtttgaagagacaggatcttttaaaaaagggatgtttagaaagttctgaaggttctgaagaaaatatgtaaaagggcataaatggatggttaactagggagaaaacaggatgggcgcaccttcttccagataaaaaggaagaaaagatgtttaggacacgtgagaacctgtatttctttctcaccccatgatgttaaaattcaattttaaattgttttatttatttccttcccccccttgaatatatagatcaaatttaatcttatttttctgtgattgtgagaatatgaatttttaaatcctgggaaaaaaattgagaggacataaaattctgttaataacattaaaaatttgtatggctattttgtaattttccaaaatttgggcatctaagatttttctttcctcagaaacagtaactaaaaaccgttgttttattcagtaactaatttgtggatgtgaaattattttaaggtgaaaaaccatttcaatgtagtcaatgtgacatgcgtttcatacagaagtacctgcttcagagacatgagaagattcatactggtgagtgttaaccacccttactaggttcattaaaatgattatttcaaatggagggaagaatttttaataagtggcagtgacttgctgccatttccattggtttagactataaatcacaggttatcttttttctcccttcaataaatcaatgttaactgttaagacttaactttaatgtccaagcccaagaaattactttgaaatagagttgcataataacctaaaatatatgtttaaagtcacaaaaggaaggaagattttctgaaattgctatttccttaggtgtttactgaactcaaaattatcgttaattagtctggggtaggaagcaaattcctgactcctaaagcagcagtacaattcattctctttctttccctttcatgtatataccttacccttagacatgtaatcttaaaaagttgagaactgccaatttctcagtcaagttattaatgatttagaaattaaatattctagaggattactataaaggaacacataccgtaaaaacctaagtctcattttagagcaaatatttatttgcatctatttttgccaacggtaaaaccaacttttataagtaactttgatttagtagtctgttgactttgcctttgttgcctctaagcatgttgaaaagtgtttctttagaattgatttccagtgttttgctttttgtgatggaataaaagcagagttggtaaatttgtataactttgaattttacatttgaatagaattgagaattgtgataatatgagaatattgaaaatatttaagttcttcatatttttctgttttaagtactcaagcaagtacctgcccagtgttgttattttgatgtgttctcatgggacctgcagtatttgtgaaaggacagtttgtcatatagaaacaaccttttctgtctgataacttttttttcaattttctttgcccccaaaaagaagcctgaatgtgtctggtctgcttaaataaaactttaactgggctgggctcagtggctcatgcctgtaatctcagcactttgggaggctgaggtgggcggatcacttgaggtcgggagttcgataccagcctgaccaacatggaagaaaccccgtctctactaaaaatacaaaattagccgggcatggtagcacatgcctgtaatcccagctactcgggaggctgaggcaggagaattgcttgaacccgggaggcggaggttgcggtgagtcgagatcgcgccattgcactccagcctgggcaataagagtgaaactccgtctcaaaaataaataaataaaataaataaataaataaataaataaaactttaactgtgcaacatgtctgtatgcttggatgttctactttttaacaatcattttgcacattactagtttcagttttttaagtaaacgtattcatctctttttattagaaggggctatactaggcactgtgggagaaaaaaatttatagattttgtgtgacttatagctaaatttaaattcctatataacaataaaacctgatcagatacaaatgaaagtgattatttttgtgtgttcttaatacctaataggttttgatattttactcattcattcaacaaaaatttattgagcatccagtgtttttcaagcaccagaaatagataacagaaggcagtttctttctttggagtttacgttcttgtggaaaaacagacgtggaaaaacacacatataagcaagcacagtgcagttaagtgttgtagaattttatacaaaattctcaagatactattgtgccctgaggaagagacacatgtgctgtccgttcttagggcaggtgtcacagaaaagccacatgaggctaagttaagaatatatgtgtgtgggtgggtgtgtatctgaaaaaaatatttttgaaacaatactcaccttcattgcactgtgatattttgtgtgtgagtatgaattctttttttaaaaaagtgctggtcacaatcctgtaatcaactgcactagaccatggggaatcttggatttaagcagagtataatgggttgttaatgtttgtttagaatttactaagtaccagaaaactgtgttaaatatctcatttagtcctcacattaatcttgaaaggcaggagttattactgtccccattttatagatgaggaggtagtaagaagtgcacataagttaaggaactttcccaaatgtatatatctagtaaatgatggaaccaagatttcagctcaagcctctgtgagtccagagtacacatgtgaaatcactggctatgcagaatgggactagaagcagaaagttatatttgggcctttttgagtttttcttgctctgtcactaagccaattatggcttagccttcctataggtatagtarcatctaaaagtggtagaagcaaaggctggagttctcatgttagagagaacagtgtagaagaagataaggagttgagaggaaccagggcaaagcaatcactagggttccttaacaaagaaaagttcttttgaagagagaatcaattctgccctattgttccctccctactaggtggaactgatataaggggatagttttcccttctttacttcgtattcttgattstttttatagattctttttaaagacagtaaaatgttttttgttaaacctatttgggaatatatatctagaaccacaaataggtctccatcatttattattctgttcttactgttcttcctttcattttctaagtgacttttatttttggaggagggtagtgccctgaagtttgcccatgtgaaggctttctttatttgtaggcccttagtttagaagaatgcatttaaatagttacggcattaaaaaagattttccatatttttatccatttttaaattgtcaaatgagtaatgagtcacctaaccgaccctcaaaggttggtgaaaaccatctgcccttaaaggctccattttccatacatccttccttctccctttaggtctcattatactgtcttctcctggtccctcaggcctccaagcccattctctgcccctttgcaacatagttaaaaatcattacttgcttggtagctgtggccaacaataaagaaacctgtgtcttattaaaaccaagaacatagttgatttgggttcaaaaggaaaaatttttaatgtgctctagacaggctattatttaattccatttcctacatttgggcttgtctatgaaacaccattttaggggagagtactttttcatccagaggctggtccctgaaattctggtttaagctttattcctttagactatggcactgaaaactgccacattgtaaatatcctcaggactgctatttttggcagttatgggagatttaccttttttgtgaatattatattttttgtgaatattacagatcctttatttaggtgatgttttggatgtgagagagaagatgaggatttgaggctaaggtcgaagataattataattgatcattttgtttagggccaggattactgatcaagcgcatatcaaggttaaacatttatcatcattggcagatttccttgtggatcaagtacttttgtctgacgtgccctttccttgtctaaggtgcctattttaaaaatgcatatatagaataaatgttagaatggcatatatccatagttgtgttattttcttctcaccccgtgagcattttactctaagaaactgccagtcttatcaccaagagggattgaggagtaaaaaacttaagtacaatttttaattttatttttgtaaattcctctaaatagtaagccacagaatacctatcctgatgttctgttatacaaattatggtagctttttagttatgccagttttcataatttattttttatttcaattagtaaaaatgttacgaagctatttctatagggaagtttttataaatgattctcctcccggccgggtgcggtggctcacgctgtaatcccagcactttgggaggccacggcaggcggatcacgaggtcaggrgtttgagaacatagtgaaacccaatctctactaaaaatacaaaaattagccaggcgtggtggcacatgcctttagtcctagctactcgggaggctgaggcaggagaatcgcctgaacctgggaggcggaggttgtggtgagcagagcatgccattgcactccagcctgggcagcagagcaagactccgtctcaaaaaaaaaaaaaagattctcttcccaaaaaaaagagatttttgaaaaaactaaatcactcagaattatatatgttcactaggtttctttttccataaggttcttttttaagcctttagttcttagatgtatacagttctctctgtaaaaatataaaaacactggaaaacctgtcatctaagttagtgttcttcatgcctgaaaacacagcagtcctctttttctctttactatgacttttattcacaactgtattaaatagctgtattaaatagctgaataataacagcatcttatttttgtaaaccagttgggctaatggggtggggttagagagaatgttgatttactcttgactaacttagcttaaccctttatatttcccttagtatggttcagttatcgataaaaattagttttctgctcacatttttcaagccctaatttatagttaattagctctaatagagaagtcttatgaaagaaaatgttaaagacctacttagagtttaactcttaatttgtgaggatgaaggaaatgaatactgtttgtgtaactgagaatgttgtgtgcactacaagctcctggcattgtgattgctgaagcccagactgcactggcatggacagagcttgccaaggaagtattaagcagagaagtatggattgctgggactgacattttctgctttaacaaagcttttagaaaccaatttttttttatctgcaaagctgttaataattcatactaaaagattggttatacataaaacatataaaagcttaacactatatatcaaaatatcccaataaagacataaaagagatcatttatatgtgtgtatatatgtatataattaaagtatggtgtaattaaatatataaattgataaaaacctgatatatataaaaatattaaaccatacttaaattttttttgtttaggaggataggggaagtcatccagaagattgattccattttattattatgtcttacaacagaaatatggcaaatcagaggctttataatgaaagttgcccagttttcaattaagtgtatgtattttatgtatgagtatccctacccctcaaatctatatagaatgtttttgttagttcatagcagctatatttaaaaaagatgtgtagcatttgttttaacaagtctttaacaaattgagacttggttgaagtggtctcattcttacatatagtcattgaatgaatgaacatgtgaatcatgtgactcacaatttgatgaagcatatgtcagatttccaacacaatggtgcagacaacctgtgctttagaatttcattgaaatagaccagacaattcagattggtgtcttcatggaagagatagaacttaagtgatctcaagagtgaatttgatttaggctttgtaatccatgtgttgcatgggagtcaagtgtcatcacaggaaccataggtagtaaagcaaaggyatgatggaagccaggaccagaaagaaaatctacagtgtactgaaggaagytgggaatcgttgggcaagaagaggtaaacagatactcagataatcgattcagaaacacacacagggtagcaagttaaaactgaggcagaccggcaaacacccagacagttgcagatgctggacargaggccaagcagtgtgtcatatatcctggcttaaaagaaccagaaggaggcaggtacttcattgcagtttaaaaaaacctagcaattcctaagaattcatgattatcatagacctagtgatacttaagtaaatttattgagtacctgttctccaccaagcactgtaamccaatacataaattatctcactttatccacacagcagtcctgtgaggagggtactggtattcctgttttacagataaggttcaaaatgattaagtcacctccctcagtgcgtataactggtaaataacaatctagctcttcgaagtttgtgcccttaaccaatatgctgttgaaagggtagatcaagcaccaaggaaatttcgaagtgacatcaacttttggttttaaccagggagatttttattttgttcaggtaagggcaaagccagtactgaacctggcctgtagcctgtatgtatgtagccttctacgcttcgctgaaacgaagtctgtgggtgtaggggtaagaccggatttcacaatggagtgggcagaggcaagatgtgcatgtaaatggccattctgaggaaagcaggaaggacggggagagtgggggtgaggagataagtctagaaagcttgattttggaattgcattgtctagccttgatgctaagctaaggaatgtcagatttatcktgtaaagcattataagataccaaggcatttaactgccatgttaaaaaaatactgttttgtgaggaaagttggaaatttggaaaataagttactgttaattataactaatatgaagaaaattgtataatatttaatatttttatgctaaaatatttactcataattacaaatgtattaatcaaatttagrtatttaaatttttttaaaacaaatggaacaacatagttaagctttaaggaatgtaatattactttagctttggtcagtttgagaagtaggcaaaacttaaatacttyttttgttttcagagatgaagtctccctctgttgcctaggctggagtgcagtggcatgatcatagctcactgcagcctccacctcctgggctcaagcaatcctcctgccttagcttccttgagtttctgggactacaggtgtgcaccagcatgcctggctaaagttatttttcacagtagtttcttatttttcttatttgtccatagtatggtttggtttgcctttttaaaatattttcaaaaactgtagaaaatgtactctgaaacaagataagtttctctactctttgacttgttaacctgccttcctttaatgtagggccccctgaaaaattatkttacattctacagaagatgaaacattcattcagttgggtctagatataatgctttgttttacaaattatttcacaccatattcttttggaaaaatactcaattacttctttaaactcaaactcctgaagacctcaggatttttgaatattggaagcacaccaccatgcctgggtaatcttttttaattttttgtatttttttttttttagagatggagtctccctatgtatcccaggctggtctggaactcctgggctcaagtgatcctccgattttggcctcccagagtgctgggattataggcctgagccactgtgcctagcttcagtgtgcatttttaattattccagaaaatatactcagtttactcttaattacctaggagtgaattgacgaggtcataggttaattattaaactttttttaattaaaatttttactttagattcagggggtacatatgcaagtttcttacaaggggatattgcatgattctgagatttgggcttctattaatcctgtcacccagacagtgaacatagtacccaataggaagtttttcaggcctttcccccattccttctcttcttccttttggagtccctagtgtctattgttcccattttttacgtctgtgtgtacccaagatttaacgcccacttataagtgggaacatgtgttatttggttttctgttttttatgttaattcacttagggtgattgactccagctgcatccatgtttctgcaaaagacatgattttgctctttttgtggctgtgtagtattccatggtgtatatgtaccacattttctttatctagtccactgctgatggttacctgtgttgattttgtgtctttgcttttgtgaatagtgctgccataaacgtatgagtgcatgtgtcattcggtagaatttttttttcctttgggtatgtacccagtaatgggattgctgggtcaaatggtagttttgtttttacttccttgagaaatctccagactgtttttcacagtcgctgaaataattcacgtctaccaataatgtataagtgttcccttttctctgtagcttcgccaacatgtttttttttttttgacattttaataatagcccttcttagggatgtgagatagtatctcattgtggtgttcatttttttttttaaagatgatgttgctatgtcacttaggctggtgtgcgatggcatgatctgggctcactgtggcctcaacctcccgggctcaagcgatcctcccacctcaggcttctgagtagctgggactgcaggtgcacgccaccacttgcagctaatttttgcttttttttttttttttttttggtagagacygggcttcaccatgttgcccaggctggtctcaaattgctgggctcaagcgatccacctgccttagtctcctaaagtactgggattacaggaataagccactgtgcctgacctttttcatacgttgattgcttgtatgtcttattttgagaagtgtctgttctcatgtcctttgaccagtttttaatggggttgttttttgcttgttgatttaactgccttacaggttctggatattagtttcttgttgaattcatagtttgtgaatattttctcccattctgtaggttgtctgtttactctgctgattcttttgctatgcagaaactctagtttctttaagtcccacttgtcaatttttgtttttgttgcagttttttttgtagagatcaggtcttgccatgttgcctaggctggtcttgaactcctggcctcaagcagtcctcttactttggcctcccaaagtgctaggattgcaggtatgaaccactatgtcctgcctgtcagttttcattgttgttgcaattgcgggacttagtcataaattctttgccaaggcttatgtctggaagggtatttcctaggttttcttccaggatttttatagtttttgttttacatttaagtctttaatttgtcttgcattaatttttgcatatggtgataggtagaagtccactttcattcttttggatatggttagctagtttccactgcaccatttattaggggtcttttccccattgattattttttgccaactttcttgaatatcaattggttgtaggtgtgcagcttttttttctgggttctctattctgttccattggtttgtgtatctatttttgtaccagtaccatgctgttttggttactgtagcctgtagtatagtttgaagtcctggttttgttcttttttggctaggattgctttggcttttggggctgttttttttttttttggttctatataaattttagaatagttttttctatgtctgtgaaaaatgatattagtagttcgataggaatggtggtgaatctgtagattgctttgggaagtatggacaattttaatgttattgattcttctagttcattaacatggaactttttttcgtttgtttatgtcatctgtgatttccttcagcagtgttttttagttcttcttatagagatctttcaccttcttggttagatgtattcctagggtatgggtatgtgtgtgtgcatctagtgtaaatgggattatgttcttgatttgcctctcagttgaatgttattggtgtatagaaatgctgttgattttgtatcctgaaactttactgaaattgtttatcatgtctaggagccttttggcagagtctttagggctttctagatactgaatcatatggtcagcaaagagagataatttgagtgtctcttttcctatttggatgtcttttatttctttcccttgcctgattactctggctaggacttccagtactatgttgaagaggagtgatgagaataggcgtccttgtcttgttccagttcttagggggaatgtgtccagcttttgcctgttcagcatagtgttgattgtggtttgtcatagatggctcttattattgtgaggtatgttcctttgatgcctagttttttgagggtttttataatgaagggatgctggattttatcaaaagctgtttctgtgtctattgagatgatcatatgattatgtgatttttgtttttaattctgtttatttggtgaatcacattcattgatttgcatatggggaaccagcattgcatcccgggaataaagcatacttgatcaaactgaattaactttttggtgtgctcctagattcagtttgctagtattttgttcaggatttttgcatctatttccatcagggatgttggcctttagttttgtttttttttttccccgttgtgtctttgccagattttggtatcaggatgatactggtttcgtagaatgagttagggaggaatcccttctccttgattttttggaatggtttcagtaggattggtaccagctgtcttttgtacatttggtagaattcagctgtgaatccatctggtccagggctttttttttttttttctttcctggttggtgtgttttttattagtgatttaattttggaactcgttattgatctgttcaaggtttgaattttttcctgattcaatcttgggaggtgtgtgtttataagaatttaactatattctctagattttctagtttgtgtgtataggggtgttcataataatctcattggagcttttgtatttctgtgggattagttataatgtcacttttgttgtttctgattgtgcttatttgaatctttttctttgttaatctagctagtggtctgtcaatcttgtttatcctttcaaagaaccaactttttgttttgattctttgtatggtttttgggtctcagtttcatttctactctgttttcttttattccgttagscttgggattagtttgttcttgtttttctagttcctttaggtgtgatgttacatgattaatttgaaatctttctgtcctcttgatgtgggagtttagtgctataaactttcctcttaacactgcttttgctgcattctatagattttggtaggttgtgtctctgttttcgtttgtttcaaagaatattttgatttctgccttgatttcattgtttatccaaaagtcattcaggagcaagttgtttagtttctagtaattgtgtggttttgagggttcttcttggtattgatacctatttttattccaatgtggtctgagaatgtgcttggtatgacttcmatttttttgaatttattgagacttgatttatggcccaacaagaggttgatcttagaatatgttctgtgtgcaaatgagaaaaatgtattttctatggttgttgggtagagtatactgtagagctctattaggtccagttggtcgagtgagaaattagacacttgtccagaatttctgtgttagttttctgcctcaataatctatttaaggctgtcagtgggatgttgaagtctcccgttattgtatggctgtatacatcttttcctaggtttagacgtatttgctttatgaatctaggtgctccaattttgggtgcatatatatttaggatagttaagtcttcttgttgaattgaaccctttatcattataaaatgaccttctttgtctttttttactgttggtttaaagtctgttttatctgatacaagaataatgacccctactctttcttgttttacatttgtgtgattagttaaaattaaagagacaagtgcattaattaaaaaaacaaaatgactgcaaacacaaaaagaacaacctatttgttgctgtttgaagacacacagtattctatatgggcctattgtacttacataatggaggaactctaccttaaaaatcaatcatatatattctttcccacttcatctctcttcaccttaaaaatcaatcatatatggtcttgcccacttcatctaacttttagttctttatcaatggatagagggggaggacgtggagtttgatccactctaactctagagtcctgagaaagtctaactttatcccaatagaaaaatcttgttgtgctctacctgttctgcagacattttgttttcttaaatgatatttaggagaaatagacaatggacttataggaacctgaaaggtattattttaaaatgttaggattccgtgacaaatccaagggagtttggcttatgcagaagcctttgacaaaaatgctagagactggctgggaaacttttgaggtgctgttattaaggagatgcgatgccaggcaaggctgaagaagctcttgattgttacagggtgagtggaggctagctactaaaagcaatacttgatgctatgctttaatcatccagacttcagctagattatttagtaggagaatttgctcagtgtctaacattatctaggccttttctgatattaaaaagtaaaagattgcagtgaaaaaataagcagtagtaacagactatcttagcagaataaaagtatttttgttcattttccaccttgtattttatgtggtattttgtattcgaaagctgttcttggaatattgtgtataaacttgaagtttacatgaaatcattactcttttgaactgagagttaaagctacttactctataacagcctggatatattcactcagcagcgtttgggttgtagatctaattaattagccattaaatttttttcccctgaaggaaactaacttctgaaactaatctcagtctctctttcccctgcctcattgaaatgattgtttaatgatgagatttctcaggaatactactatcatactctagcaaagtatattttattaagtgatgaggttctgaaaaagacctgaagactgaaaattgaatgaaatggacatgaaaggcatttcagaggaaaaataattacagatgaaatttaatagttgtttaaacagaagaaattggagtgaaactaatataggagaatggcttttaaactttttttgatggaactctgattctcaaatgaaatcctacatggtatcaacatcaatagtcaattaaaaaacaaggcagatgatttcaagtggttttccttggctattgatgagttgacagatggtaccaattactrtgatctgtttctacccacttctgacaccaagtgtgtgggtttttcctcataccaacaaacacttctccaactctttggacaccagccggctgtcctattatacagtttaattaaatgctgacactaactacttggagttagcatcagatcctgcaagttaagggctcagtcccacaaggctgccccctcttcggatgccaatcacaagtttaggcctcttgtacttctgaccaactggctataaatcatggggggagggagtttggataatttgctataacagtttacagaacccaggaaagtgctttacttacatttaccattttattacaaaggattcagttgtacagccagatgaagagggtccacaggacaaggtctggaagggtcccaagtaccggagcttctgtcttgtggatttagggtgtgccaccatcctggcacttggatgtgttcaccaacccagaagctctcagaacctcattacttaggggcttttatggaggttagtaatgtaggcatgatggattgattattaactcagtttctagcccttcttcccttcctggaggttgaggagaatggggctgaaatttctaggcttctactcaaggccttgtctttctggtgaccagcccctatcctgaagctatctagggtcccagaaagatcgcctcattagaacgaaagaggcttctatcacccaggaaatccctagggtttcaggagttctgtgtcaggaataaaagacactgctatcactcaggaaattgaaaggattttaggagctctgtcaggaatcagggacaaagaccaaatattagaacaaaagatgcttttatcaccccgatcactcaggaaattactagagttttaggagctctttgtctggacctggggacaaaaattgaatgtatatttcttttttttttttgagacagagtcttactctatttcctaggctggagtgcagtggcacaatcttggctcactgcaacctcagtctcccgggttcaagtgattctcctgccccagcctcctgagtacctgggattacaggtgcatgccaccacacccggctaatttttgtatttgtagtagagacagggttccaccatgttggccaggctggtctcgaactcctcacctcagatgacccacccgtcttggcttcccaaagtcctgggattacaggcgtgggccaccgtgcccagcctaaatatatatttcttatactacaatattaccctgttatttaytcaagaagtcaatactaggtttgaagtgactaaagaattcrtctctgtgcaacaactataggcaagaatagtttcaaaatggaattatacactttaaatggatgaatggaatggtatgcaacttaaatgtcaagrtgttttcaaaaaaatgagtaaagaacttgacaaaacattttaatataaactgaagtggatctgctaagttgtgttacagcgaatggtgggaaaaaaaatacatgtggaacagaatagtttagttgaactaatttacaaagcttgagaaatacaaagcatttaaagtttatggcctttcatgttagtatttgtgaccagtactttgtgagaaacatttgaatacattatgtgtcattgaaccaatagtgtcaatagtgaacttcatttgctctggtgggcttaaccattatcagtgttccrtgaatttctgtcagctatggaagctgaatgttctgatttactctattatatagcagtttaatatcttagaagtggtaaagtcttattgggagcttttgaatgtaaagccaaaattaaactttttctgaattaatatcaccaatctcaatcactgaagaatagctttagaaattagcttctgctgaagacttgaaaatgtttcttaataaattcagcctgttattacaagggaaaccagtgtttatatgtgaaatttctcccatgataaagttatcttgacagcacctaatattgaatcacaaaatgctgttttatgtacttcctatgctatcagttagaacaagaagcaaaatctccactctcacacaaataggcagtggatgtattttccaagctcaaactacaatttcgtcagattttggaccttgatgcaagtgcaaagaaagttttcatatttcagaatccacttaattgtgcaactctgcctactctttaattggaagtagttaatgtccagtgtaatacatgataaaaggcaaatatcagggatctaataaaattttctgtaaatgccttccaagtggtgaataatgcttgataaaatcacattttcatggattgatatcagtatctgtctttgtgacaagacggtttcaaagatgaaatgcataaaatctcattgcagatcagcattaacatacatttacaattgattttaatgatagggaatgctaattttgaagccctataaaagagaattccagcgttttcattagtagaactgtatggtgaaaagttatgcattattattatcatagtttgaatttcattaataaaatttttgtggaaattgttttctctcttatatgagtttgtatacagtatccttgattttaccttttggtctacaaagcttaatattatttactctgtggccctttgtgttaaaaaaaaaaaaaaaaaaacttgtcaacccctgtcaggttattttgaatgccccaccctctcagttcttagacctctgttttcttggtgacactgtcatttattcttcctctgtcatggtcatgttagactagtgctcaccaagctttagtcttcctgtgactgtagtttcttatttcccaggcactctctcctatcagtcctcctcatgtcgtttagtacttaggtttcaacagtcctttgtcttcacaaggacccacaatccagtgattctacctccttttcactatccctcattttcctcatatcttcattttccttatttaatttaaattgtcawcatttatcatattcactaccttgcttacattcatacccttgccctctcatacatagtacttacgttggctaaattacagccataagtaaatttaatgatctttttattcacctgactgtgttactccaacagaaagccacagtgaattagggtcactttagattttaagagggcccataatgacttctggaaatgatttccttagtcctttcattctcctgctcatccagattgggtctttagttcaaacaatgggccagctccacctgtctattgtcgtaattaaaattttattggaacagagccttaccagttccttaatgtattatctatggctacacagcaaagctgagtagctgtgacagagatcatatggcccctgaaagcctaaaatatttactttgtggcccttttaaaagcttgtcagtctttctcctaaacaggtgtttcatacattctcctttccataaacctccaacacttcccccaccctgtatcaatcactgagcaaattgaagtaatcagacgagaaattcagtaagtttgtagtacttctgcttatcaataaatcaggaagttttgatcttttggagaaacatgggcaaatagtgatttattttattttgcaaaaaagctcaggattttttccaatgttttgtttaagtatgtttaggtatgtataggtagtttaaatcttygttttccatgaagggaaatatgtgttgttgacctcagacttcttttaatgtacaatttacatacaataagctttaccatttttagtgtatagttctgtgcgtgttgacagttttgtaactactaccacagtcaagatacagactagttctgtcactccccaagggtcccttgcactttttgaagtgagcccctctcctaccaacaccccatgacaaacactgataagatttttgtctctgtagttttgcctcttccagaacatcatataaattgaattatatggtatgtagctttttgaatctgacttacttcacttagtatagtgcatttgaaagtcatctgtgttgatgcaccaataattcattgctttttattgctgagtagtattccattgggaaaataccttggagtgatattgctgggtcatatgatagayggacaggcatacctcattttattgcacttcactttactacactttgcaaattacagtgttttttttttaattgaaggtttatggcaaccctgtgttgagcgtctgtcagcatcatgtttccagcagcgtgcactcactttctatctctgtgtcatattttgataattctttcaatatttcagaccttttcagtattacctgttgtggtgatttgtgatcggtgatctttgatgttactattgtaattgttttggggcaccacaaactgcacccacataagagagtgaacttaatcgataagtgttgtgtgtgttccaactgctccaccaactggctgttccctcatttctctgcctctactgtgaccccatttcctgagacactacaatattgaaattaagccagttaaccctgcagtggcctctaagtgtgcaagtgaaaggaaaatttgcacacctctcactttaagtcaaaagctagaaatgattaagcttagtgaggaagatacgttgaaagccaagagaggctgaaaagctaggtctcttgtgccagtaagccaagttgtgaatgcaaaggaaaaagttcttaaaggaaattaaaagtactactgtagccccctgacctcaagtggtctgccttcctcagcctcccaaagtgctgagattgcaggtatgagccaccgcacccagtgcaatgaagtatttttaaattgtgataatgtacattggttttttttagacgtaatgctattttacacttaataggctatagtataatgtaaacayaacttttacatgttttacatgcactgagaaacaaaaaaatttgtgtgacttgctttattgtgatgttagctttattgtggttgtctggaactgaacctgcaatatctccaaggtatgcctgtatgtttaatgttatgaaaaatcaccatagcattttccaaagcaactataccattttacatctccacagtatcttatgagatttctggttgatctgtgtccttgacagcacttggcactgctatatttcattttagtcattctaataagtgtgtactagtatctcactgtggttttactataaggacctaacatgttgagcattttttcatgtgtttatttgtatattgggtagaggaataatgtgtctgttcagctattttacgcatttaaaaaattggattctttctttccttattgttgatttttgagagtttttcatttattggatatgtgatttgcaatttttttcccatagattgtttttcaaattgatgaagtatttttttctcaaaaggcctcttagtactttccaagatataacatcatgtttaattttatttttctgtgcaatatacaattaacttcgtatttctaactgtaatataaaataaaaagtaaaagggtaatgagtttacattaacatatttttttgaaataggcagaaatccaaaaccaaaaatttggcatatcagttagatttgatttttctttgttgagtttggagcctaagttttattatatattttaaagaacattatgaatttttaaatattcaatgggtaatgtaagtattcttacataacatctatttcttaaaaaatgggttagactgttttaagtaaaataagttacttaaaataaaagtttactaccaaactgaagcactaaaagatttaacttatatcatatgggtaataaattacatttggaaaatattttaacatatgattaatttgtatttattcttactaattttcagattcatgctttgcttgtagcaattaaaatgtagttacagccaggtgcagtggtgcacacctgtagacccagctacttgggaggataaggtgggagaatcatatcatgagcccaggagtttgagcccagcctgggtaacataggaagatgctatccccctttttttttttttttttttttttgagatggagtctcactgtctcccaggctggagtgcagtggcgcaatctcggctcactgcaagctctgcctcccgggttcacgccattctcctgcctcagcctcccgagtagctgggaatacaggcacctgccaccatgcccggctaattttttttgtattttttagtagagatggggtttcaccgtgttagccaggatggtttcgatctcctgacctcatgatccgcccaccttggcctcccaaagttctgggattacaggcgtgagccaccgcacccagctggaagatgctatctctttaaaaaaaatgcagttaccacagtatatatgaaattaacagtatgatctcagtaagtgaagaccctcattcacattaaataatctaaaagtccatagtaaaattaagggacctgatgctattagagagaataggttatataaagtcttagaactactattgtaattgtattacagtttttggtactttgcttgtcactgactagaaggaacactataaaggtagggaaggtgaaggaggcagaataggaaatgagtaacaagacaagagcagttttcagaagaggaggaaacagttgagatgaaaaaacaatgagtataatacttctgcaaatatttcagggatttatgaagtcatggtgaacattagacatccggaagcagtttttattaaaaataaaaatttttgagggtagagagaaatgggaaggaaaagaagcatttccttattttgaaaaaccacagagttgtggatttgccacaaataacctagtctgaaaatggcgtaatcccctgtatgtgctctggagaagaaagggtgaactttttttttttttttttttttttaatagagacggagtctcgctctgtcgcccaggctggagtgcagtggcgtgatctcagctcaccaccaacctccgcagcccgagttcaagcgattctcgtctcagcctcccacgtagctgggactacaggtgcacgccaccacgtccagctaatttttttgtatttttagtagagacggggtttcgccatgttcaggccaggctgttctcaaactcctgacctcaggtgatctgcccaccttggcctcccaaagtgctgggattacaggcgtgagccaccgtgcccggccaaacctattttaaaagaagaaattataatccagtccctgtaatttttcatatacagtgtttctcatccaataaaagttacagtccatgctaagtgacagaacagaatgacagaaagccaagagaaaaatagataataaaaacaaactcatgggtgattcagagattagagttatcagagtagagtttttaaactgttactgacatttaagaaaatagtggaaaaggtatggaaaatagatgaaaagagaaataattttaccagagaattgcagtttgtaaaaaaaaaaaaaaaaaaaaaaaactggaagttctggaactgaaaacataataactgatataaaaaacattgcacataagtttaatggaagattagagacaacaaaagagaagattaatgaattgaaagacatcagtaggaaatatcacagagaaaatgaaaacagagaaagagacatgggacacaatctttactgggattcctcacttctctcaagggtagtacatgactagtaggaaaggataatttactgcatagaatggatgtcttagagcattagggcttaattttttgttttgttttgttttgtttttttgagatggagtctcactctgttgcccaggctggagtgtagtggcacgatctcggctcactgcagccactgcctcctgggttcaagcgattcttctgcctgagcctcccgagtagctgggattacaggcatctgccatcatggctggctaatttttgtatttttatagagatggggtttcaccatattggccaggttggtcttgagctcctgagctcaggtgatccgcccgccttgacctcccaaagtgctgggattacgggcatgagccaccacacctagccagggcttaattttttttttttttttgggaaatggagtctcgctctttgacccaggccagactgcagtggtgctgtctcggctcactgcaagctccacctcctgggttcacgccattctcctgcctcagcctcccgagtagctgggactacaggcacctgccaccgtgcccggctaatttttttttctgtattttcagtagagacagggttttgctgtgttagccaggatgggctcgatctcctgacctcgtgatccacccgcctcggcctcccaaagtgctggaattacactgcgccccgccgatttttttttttaaatggaattctaattgaggaaagctgggcatatttataattggaatcccagataaatacgagaaagaacagtggctgaactttacaaaattgatgaagaatatcaagccatgtctattaatcccaagcaggttaaattttttttaaaaaacgaaccaaggaggcacatcatttgaaacagctgaaaactaaagaccaagaagattttaaagacaggcagggaaaaaaaagacaaattatcctcaaagaaccagtaagaagagtggctgctttttcattagaaatgaaaaaaatggaatgtcagagaaaaatggaatgacatctttaaaatgctgaaagctaacctagaattctgtccctttatgactagttccctaactagtcataaaaaacgaaggtaaaattaaaatgttttcaggtgaagaaaaactgagtaaatttgttcccagcagtctcacactaaaagaaaccatagttccttaggttgaaaaaaaaagatcccatatgaaaacatggaaatgtagtcaagagtgggccaggcatggtggcttatgcctgtaatcccagcactttgtgaggtggaggcaggtggatcacttgaggtcaggagttcgagaccagcctggccaacatggggaaaccccgtctctactaaaaatacaaaaattagctaggcatggtggtgcatgcctataatcctagctacttgggaggctgaggcaggagaatcgcttgaacctgggaggcagaggttgcagtgagccaagattgtgccactgcactccagcctgggcaacagagccagacaccgtctcaaaaaaaaaaaaaaaaaaaaaaaaaaaagcaggtggagacattaaatcactaaatatgtggctaaacgtaaatgaatatttacagaccagacattgataatgttattgtggggcttaaaatatttgtagtctgaaaatgtgtaacaccaatagcaaaaatagtgaggcgggtaaatggaattaatgctccaagatcctagtattgtcgtggaagtggtaatagtaatcattgaaattagagagtaataattcatttctgtataatcactaaaaggattataaaatctaacaagatcaaatggcagaaaaatggaaaaataaatacttgattgagtcttaaagcagtaaagaaaaataaaaagaacaaagaacagatgggacaaacagaaaacaaataaagatttaatccaaaacagatcagaaagtacattaaatgcaaataatctaaatactttcatgtaaagagttagattcatatcaaaacagaaccgtatggcatgcttcttacaagagacacactttatatgtaaggattagtaaggcagaacataaaataatgaaaaaaaaatgcagtgtatgaaacaaccacaaaaagcaagtgttgctaagctaatgtcagacagaagagaataaggcaagaagcattattagaaatgaaggaaacatttaataatgataaagggttgtcttcattagaagatttttcaaaaaattttaaacgtgtgtctgttaagcagaaatggacagaacaaaatgaagtagacagattcacatagtggttacctatgataatgtgtttatcaataatcartagtacaagagaccaaagtatctgtgagatagaataatctgtgagatctgaataacacaaccatgacctgagtgacatatatagcccatgtacccaacagtaaccaagtacacattattttcaagtgtacatggtaggtacatttgtcaaaagagatcatgcatttggccataaagcaaacctcagcccactatcaaatataaatggtaattattaggaacataaatgtgtacatcacttagatctacatagtcataagaaaggggagagagattaaaactttgtttcaaaaattgaaaaataagataaatggatgttcctaaaataatacagtttaccaaaagtgaaataattctgtgactaattctgtatatactaaatgcattgaatctaaatttaaatttttttcacatatctccaggctcaggtggcttccctggaattcttctagatgtttaaggaaaaaataatgctagtcttactctcccagaaaacagaaagagaggaagcacttttcagtttgttttatgaaaccatcataacttgacccaaaccccaagaaagaaatgacaggaaaagaaaattgcagacctatttctgtcttatcaacatgggtttaagagttctatgtagagtattaactgtcagatccagcagtatttaaatataatttatcatgacaacatcaacttttcaagtatcaaaactggcttaatattcacatatcagcaaatcaaattcacccttaattaacaaattaaggagggaaattttatctcagtaggtaggtagaaaacatttggtgaaatttaacatcttcctattagtaacatcttaactagaataataggggacttattttatctgactatgtagcaaacatctataacaactattgaattatttaatggtgaaatactaaaatttttccccctgagattgatgcctggtatcaccacttctgttcaacatggtattggaggtcctagtcagtgcagtaaggccagaacaaaaaaaaagtaaagaaagaaggaaactatcactcacaaattattttmaatacatagaaaattcaaaataacttgcagataatttatagtaaattcatcagttatcactgtatacaaggtcagtattcaaaaattgtgtttttatgtataccaatgaatagaacatgaacatgttatgatgataccacttaaaataacttaaaaggatcagatagccaggaataaatctgacctgatgtgcaagacttctaaattaacattataaagagatatgaaaaaacttaatggaatgatataatgtattcattgattatgagactaatgttagtctatcctactaactgatctatgaattaaatgcaatttcagttaaaatatcaaataccagcagatgcgtatgtgtcagagagagaggggagagaacgggaggggagagctttcaaactgattttaaaacatatatggaaaagcatggagctaagctggatatcaagatatattataaagctataatcatttgaaacattgtataattggcacagggagaaacagagatcagttgctccagaaacagacctacatatattacattcacttgatrtacagtaaagatgacactggagtgtggctgagaaagggtgatgtgtttttttgtgggttttttttttttttttgagacagagtcttgctctgtcgccaggctggagtgcaggggcacaatctcggctcactgcaacctccgactccctggttcaagtgattctcctgcctcagcctcctgattagctgggattacaggcatgcgccaccacccccagctaatttttgtatttttagtagagatggggtttcatcatgctggccaagagggtctcgatctcctgacctcgtgatccacccgcctcatgcagggattacaggcgtgagctaccaggcctggcaggatgatgttttaatgaatgttgctaggtctagggggaaaaattaatcttgactttctatcttacaccatatacaaaaatcatttctggatgaattgtagatctaaataygagggtaaaataatgaaacttctttttttttaataatgaaacttctattagaaaacttcagagaataatgtcacaacttggaatggggggaaaatcctaaacaggatatagaaagtactaatcwtaatggaaaaattggtattttgggtcacattattgttaagaccttttgttcattaaagacaccatcaagaaggtgaaaaaccaagcctgatgaatatgtacagaatttctacaaatctgttaaaggacaagctagtagaaaagtgggcagagtgcttgaatagacacttcacagaaacacaaaaaggatatctaaatggttagatgtatgaaaaggtattcagcttcattaaccatcaggaaaattacataaaactgtactctgaggccacttgcatataccctggaatggccaaaatgaaaaatacaggtggtacaaagtactcacaaggatgtggaacagttggaactctcatactgctggcaagtctgtaaattggtgcatccacttcggtaatctgtggagactgaacatacacaaaccctatgatctgccatttccactcctagctatataccctatataattgcatacatattttcaccaaaggataagaacatttaagcagccttgttagtagtcaccaaaaactgaggaaacaacccagatttccatcaagaatctaccacaatgaatcaattgtggtatatgaatggaatgaatattggacccatcattgtgggttaatcttacaagcataacattgactaaaagacacaaaagaatatatactatataattccattcatgtgaagttcataaggcaaaattaattgtgttagaaattaggatagtgatcactgatggagaaaaggggtggaggtgcttctgcagtgtctaatgttccctttctttattgagctactaattacacaggtgtgttcactttgagaaaattcctcaaacggcacttagacggtttgtatacttttctgtacatctattacagttcagtatgtttacttctaaaatatagtgagggtaccttctgtgtactttctatatgctttaaattttccttgataaaaaggtagttaaaagagaaaactaatttgtggtattagaagcctggatagtggttatttttgagaagttagacatgctgatcaggtgaggcttcaagaggcacttaggaagtgctcataatgttctatttcttgattatgagtgctggttacgtgagttgatggactttgtggaaatttaatgagctatgattatgatttatttacttttctctatgactgttacactctagtaaaaagtttgcctaaaataagaaagtagcaaagaaagaaataatgagaagggttagacgaaataaaatttgctgattattggtaattattgaagctgggtgataagcgagggatctttatgtgttctctacttttgtgtatgtttgaaaagatccataatgataattaagataaactataggaatagaaagcagacaatttgttcctggatggggatgacagagaggagcaggagaaaggaaatatagagaataaaaggaaattttgtggtttaagataaatatattgtcttgattgtgatgatgctttcagaactaaccaaatagtcaaataatgcaaaaaacaaaaacaaacaaaaaaccccagaaaacttaggttcaacttattccaactgctgtcatctacctggaagaagaccagacactagtaacaacttaatacttgctaaatraattaatgactggggtgccatttggcatattattggtctacattttttttaactatagaaaatattgakcatgagtttcttacaggtaagttacagattatttgaaagaagtatgtacatgtaatcagaggtccacactcagggatgctctgagataagctatgtcagatgaataaggcactgaagcagcttttctggagatgaaaggcagccagccagcgttgattcccaggcttggtttattagcatcatgacctgggcaaaactttcatcacctggtgaggataatttattcctctccctagcctcatcaaggtataattgacaaatggaaattgtatatatttaaggtatacaacatgatatatgtatacattgtgaagtgattgccacagtcaaactaatgaacataaccatcacttcacataactatcttttgtgtgtgtggtgagaacgcttaagatttactctcaacaattccatgtttacaaattattaactataggtcccatgctatatatctccagaactaactcatcttacaactgaaagtttgtaacctttgaccaaaatcctcccattcccccttaccatagctcctggtgactattattctactctgtttttttaattctgcctctttagattccacctataaatgagatcatgcatgtttgtctctctgtgtctggcttatttcaactaatataatgtcctccagattcatccacattgtcacaaatgacaggctttccttttttaagctgaataatatttcattatgtacacacacaccccccacattttctttatccattcatccattgacagaygcttgggttgtttctatatcttggctattgtgaataatgctacagtgaatgttcagatatctctttaagataatgatttcagttcctttggatatatagccagaaatgaaattactggatcatatggtagttctatttttagtttttttttgtttttttaggaacctccatactgttttccataatggctctgtcagtttacaatctcggcagcagtgtgcagtggtttcttttcttcacagcttcaccaacacttgttatcatttgactttttgataatagccatcctaacaggtttgagatgacatctcatgcttttgacttgcatttccctgatgatttgtgatgttgagtacatttttatatgcctgttggaaaaatgtgtggtcttctttggaaaaatgtatattcaggtcctttgcccattttaaaagtaggctatttgtaggtttttgctattgagttgtatgagttccttttgcattttggatattagcttttcttgatgaatatatggcttgcaaatgttttttcccattccataggttatcttttcattttgttgagcatgttgaaacttttcagtttgacgtcctactcatttatttttgctttatttgcttatggttttgttgtcatatctacaaaatcattaccaagacccatgtcaaggagctttctcccatgctttcttcaaggatttttatggtttcaggtcttatgtttaagtctttaatcctttttgagttgttttttcgtgtatggtgtacaagaatagagatttaagctttaaagagagaaataagacaggtattctagattgaaatgcaaattacacctgcatttttaagatgacactttaagaaatagacctcttgcagcagaacacttcgtgttcctggaacctgtagtgcttgtttattctttttagatatttaattgacagccaaatccagaagagatagctgctgaatttgtcactaattctgagtctgattctctcgtttctttgcataaaagtagtgttaatgctctgtgctcaaattagagcacctaaaccatgtttctgaaatacagtgtatatgaaattaaagtgtaagttgcagctagtataaaaaaagcaaatcattttattgtggcagaataatagtgacatcgtatgggtgggcaaaaagccacaggaccctgattaggaaaatgattttagtcatgaaaaaagtatgctttctgagagaatggtccttcatcttttataccctagttaatttttttaaagggaagaaagccgatgtgcatttttacagttctatatgaagagtaagctgatgatgggtttcttttaaggggactcaacatagagttatcagatttggtaagtccattatgggcttaatgtagccttcactgctgagctcttattatagggcacttgttttcaggaggtagctggaaattggggggcttatatcaagttcagaaatagacatgactaatttaaaatgttagaagtcaggatactttttagtaaacattgtttttaaaaatctgttgtacgttttgggattctaactcatttgtgtttggtaagaattcactggtgcctacatatccagccattttactaattttacatacgtcatatttagatggtgtttacagtaactgctgttgctttaatttaggtcttgtactgcataggtgccatcattggaacatcaattatttagtgttaatatgcttagatgctagtaccagttgtgtaccgagtgtataactggctgatagaaaagtgagatgtggaagtgtcataaatatatggtgttcagcttattttggaattaggacaatggtttttttgttttgttttgtatttttcatgtrtacttcctagatcaactctcagatctttaatttgtgcatagggcttcctgaggatgttgctcttactagaggtaattgatcagttttcattgatggctccctcataaagtggaagtttaaaacctaatctgtggaagccacgaaacagtttccctcagccagtcatggtggctcacacatgtaatcccagcactttgggagggcgagacaggcagatcacctgaggtcaggagtttgagaccagctgggcaacatggtgaaaccctgtctctactaaaaatacaaaaaaattagcctggcctggtggtacgtccctgtaatcccagctactcaggaggctgaggcatgagaatcgcttgaacctcaggaggcagaggttgtggtgagctgaggttgcgccactgcactctagcctggttgacagagtgagactctgtctcaaaaaaaaaagttttcctgctctcatttgctgtttcatcctaagaaacttgagaaatagactactttaaatattacagtgtatataaatgtgtaatttcataactctgcaaaagaaaacccagaaaaaataattttttaaactttctttttggggagggaggagttagtgaccccaatctgttattttacaaaatgggcaaacattgccaatctttctgaagtttgaaatgcagaatttgaagtttctcactgccctgcgttctagggaaagaaaaccattctatactagaaaggtgttatttaaaaagtttgatacccagaaaaattaattatttcattagttaccataatgcctgtgagttttttgccrctttgatttaactgacattgacatgtctttgtgttagtgttgcagcttctcagtttttatattctacttcattggttgtaatttagtctcagatgatttcctataggatgtaatttcctgcatagtatatgggttctacttagcctgataaatgatctttccaacctcctggaagcactatatgccaaagatattctgatattttctaaagttttaaggaaaattattgggtatgtagttattagtccatggatttattttagtaattgtcattgtttcaccttttctcaagtttattgttcagcttaaggatattttcatttaggatatatagcccagacactgggttataattataatcaatatgtaagtatggttataattataatcagtatgtacgtataatcaatatgtaagtaatcatttgttatcaacctcctcattcctgttcttaatagctaacattttttgagctgttatactactgtgctaggcttctttcttaaattcctacttcacattaattatctcatttaacatttggctctgaggtatattctattwtttccattttgcagatgagaatataaagtcgtagaagtttaaatacatgcttatttctcacagtaagaaatgctgagaccagcattaaaactcagctcatctggctgtagaacctgtactcttaagtactattttatgttgcatcacataatggtacatgatctttttttggttagtgtaatagttatgatgcttgaaaattttattgtctaccctttgtaatttattaaatatggatgtttccttgtgttgtcaagtgtgtttattatgccatgttaactttgtcatagtctcatcattatttttcacccagattttatgaagaccctttattattaaaataattttcacatatattctgattaatacaacagtggataccattttttgagtattaagtgctttacatttgctgtcataacaaagaattgatttggggaagttttgtagaaaaaaatcagcagaaaatgattatggaggtaagaaaaaagcatggtagtttaggaatagaaagaaagccactttgattagagctcagaaagcagagtggggaattgcgaagacaggtcagacacaagaaaggtaggggccagaagaatagaggaccctgttttaatttttattcttagaacagcagaagaccaatagtatgctttaaacatgatcagatttacttaaataaacagaggctggctgtaatgtggaattagaagaagataatagatcccagagaaactactccttaggaggatattatgtgataggctagaccacaggatgatggtgtcttgacctttgggtgatgacagtgggaagtggagagaagtgaacagatttgataggtatttagtaggctgaatcagtagggcctgtcaattgtccaaatatggagagaggataaagaagaaaaaagctgtacagttctctcatttgtgcagtttagaggggagaggagtgccatttgtggcataagctgtaagttgaagattgtattagtccattctcacattgctgtaaggacatacccaagactggtaatttataaagaaaagaggtttaattgactcacagttccacatggctggggaggcatcaggaaacttgcaatcatggtggaaggggaagaggcaagtcttacgtggtggcaggtgagagaaagcgagcaagagcaggaaaattgttttagaaagcagtcagatctcgtgagaactcactatcaggagaacggcatgaggggaaatgcccccatgatccagtcacctctcacctggtccctctttgacacatggggattatggggattacaatttgagatgaaatttgggtgcggaacagagccaaaccatgtcacagtccctaagtttattgtgggatatgatgtatttgagatccttaagtgttacagaagtggatatattacataagcagtttggatatgtggttttggagatcttgagagtaattaaagctatggatagatgggcttcccttcatgccaaagagaaaaatatagaatgagataagcagaaagcttgttttgaagaactaaaacatttcacatttggaaggaagagggtgagctggaaagaccactgagaaggagcagttggagaggttgaaggagtatggatgtcatagatgccaaggcaaaagtgagtttcaagaaaaagaaagggatcactttgagttgaatgcttgttgagaggactagtaagatttctgggccaggtgcgatggctcatgcctgtaatcccagcactttgggagggcaaggcgggtagatcacttgaggtcaggagttcaagaccagcctggccaacatggtgaaaccccatctctactagtaatacaaaaataagctgggcatggtggtgcatgcctgtaatgccagctactcaggaggctgaggcaggagaatcacttaaaccagggaggtggaggttgcagtgagccgagatggcaccattgtcctccagcctgggggacaagagcgaaactccgtctcagaaaaaaaaaaacaaaaaagatttctgaagagacttggttgtattggtgacctgagtgtgatttacaagaaccattttgatatggtgggtcattgcagcagccggatggaatggtttgaagagggaaaggaaggtttgcagttgccaaaaatcagattagtatgtcaaaccatagtgagctagattatacataaatcttatgtctttataactctctcatatatagtttaccttaacagttacccatatattatagtaaaaatttttatccataaacagctgattgtgtgcaatgtcagagttaccagggagaaacatcacattgggraaacagtctcactggaaaactgttagaagagaaactttagggcccttgggtaggggaaaattatcattttgtgggacacctggagattgtttttttccttaccgtgttattgctttcctggatgtaaaaaacatttaaaatttcttgatacttttcagataagctttttgtgtcattcttgaaatcactcaagtgctgtatagatttatcttccttttccagtagagaggctttagccctcaaggggaaaaatgataaagggattttctcaataagggaatttttcatttaagtgtttttatttttctcaggaaaaatagatatcagtcattttattcttatttcaagaatcaagaaacaggtcagacgtggtagttcatgtctgtaatcacaatactttgggaggctgagttgggaggatcacttgaggccaggaattcgagaccagtctggacaccgtaacaagaccctgtctctataaaaaaaattttcttaattagctgggcatggtggtgcatgcctgtggtcctggctacttgggaggctgaagttggggaggatcacttgagcccaggagttcacggctgcagtgagctatgattgtgtcactccactccagcctgggtgccagagtgagaccctgctcttcaaaaaaaagaatcagaaacatacgaaagtacacacatcaggaataagatgtagagcccattatcactacttctttttaattgtttgagaatagtggatgagaaaaataagttaaaaaatattttctgcaagcaatatgattataaacttggaaaacccaagaggttcaactgaaaaattactgcaaataagtaaattcattaaaatagcagaaaaccataccctttgtatagccacacacacatacgcagggaatagaagatataacagaagaaaacactcttttcacaatatcaatgagaagacaagcccaggaatgaatttaagaagatgtagaaaatcccatatgaggaaatcattcaaagcactacggaggatacaaaggtttgtgaaatgggaagrcgtatcttttttcttcctaggtgaaaagagtaaacatggtaaataatatcaaattgttcataagttaacataaacacttcagagaactctcctccctctaattctagataagctaattctgaaatttatatggaaagtggtccagcaggacaaacgagaagaatgcagaaaaagcaatgaggaagattagccttaccaacaataaaggatattataaaggcttatgaattgaaacattttggttctggcttatgaacagtcacactagtggaacagatgagcaggtctagggatagacccatggaacttaattagtgtgtgattatgataaaggaatggtaagtgtgatcaagaaaagctgaacttttcaacaaatggtgttggggaaactggatagccatctgaaaaaacaaaagttttgtccatacctcacattctgcctcaagataagctccaaatatatgaggatttgtttttcatttttgttttttttgtttttgtttttgagacaagagtctcacccctttgccaggctggagtgcagtggcgcagtctcggctcactgtaacctctgcctgctccccgacaccagattcaagcaattctcctgcttcagcctcccaagtagctgggattaggcgtgtgccaccacgcttggctaagttttgtatttttagtagagacgggaaattttgtcatgttggccaagctggtctcaaactcctgacctcaggtgatccacctgcctcggcctccaagagtgctgggattataggcatgagccactgcacccggccatatgagagatttaatgtaaaaaatgaaacttaacagtttaaacttatgtgtctgaaaatatgagcagatcggagtggagaagtcttttctaaataacactcaaaatccagtatccataaaagaaaagattgatacattcaactacataaaaatgaaaatctctactagcaaacaactctacccctaccattcaagggcaggggaaaggccaggaaaaaatcctgaaactcattatagacaaaagaccaaccttcttaataaagctatttcaagtcatcaagcaaaaaacctggaactacaaaaaagtaggtggaagatacgagcagacagttcgcagaagatgaaatataagatggctccatccacctcctgctgagataatgttttttcacctattagatatgtagtcatcagaaagtttgacaacatagtgagttatagggaaatagtaacacatccatggctggtatgggagtacagattcatagcatttcctgtggagaccagtttagtaatacatttcaaaatcatgaacatatgttttatttgtccagaaattctttttatgagtgtttattccacaaatatacctgcatatatgtgaattaatacatttacaagttatccagtacaaaatcataatagcaaatgttgggaaatgatagaggattgattaaataaattgtagtatgtctttccatcagtgaaaaataaataacatccgctgtcagaaagaatgagctaattctctttctgctgctaagatctccaaaatacattgttgactgaaggaaaaagaaaagataagaacagtgaattaaatatgctatctttgtaaaagaatgagggaaaagtagaaaagattatgtattcatttttacttatgttgtgtcaagaaacctggccaggtgcatgcctgtaatcccagctactcagaaggtgggaatatcacttgagtccctgaattcgagaccagcctaggcaatatagcgagaccctgtctttaaaaaaaaaaaaaaagaaagaaagaaaaaagaaagaaactctgtaaagaaactcgcacaaacaaataaatgtagttacctttgtcggggccaaagataggaggaagacattttcctgtatactctttttaagtgttttgatttttttttaactctgtaaatacattccctaatccataaatagggatccttaagtggcaaaacttaaattttaaaaatatctagaatggctagttttaaaagaaaggaatggagatgagtataagaatgggagggaggaaaagggatatgaaaaaagatggtacagtaaaaaaggaaggaaatatgtactaaaggagaacaaragacaggaataaaaaatgagaaccaatcaaaaaataataaatgaccatggaaggtgaatttatgtttgcattcatttttgactgagttagccatcataattgctctatttagttgggaggaggattgtttttagcaacaaaagaacatttgtacaaattacttttaaggcgttaatgtttctggttttgttttggtttttggtttttggtttttttttttttttgcagacaggatcttgcacttgtcacccaggctggaatgcagtggcgcaatcacagctcactgcagcctcaacctcccaggctcaagtaatcctgctgcctgcacctctgagtagctgggaccacagacatgtgccaccacaccctgctaattttaaaaaattttttgtagatacagggtccactgtgtcacccagactggtcctgaacttctagactcaagtgatcctcccgcctgaacctctcraagtgctgggatcagtggcttgaggcascacacctggttgacttttttgttaaaggaaatgccgtagtgttgcttttagttaaataaactgttaattattggttcatctattagaatgtagcaagtaatttaaacatgggttttctccagtttgtgtatgtatgtgtgtatttattcattcagagacggtggcttgggggtgtttcgccatgttagccaggctggtcttgaactcctggctttaagtgatccgcctgcctcatcctcccaaagtgctgagatgacagacgtgaggcgctgcactcggctttctccagttaatttctttttaattaatcttgagctccttgagggaaaaaaataacttctcactttgcatagtatcaattgtattaccatgcatatttaaaaataacgttactgagatataattcacaatttcagaaaacccacccatttaaaatgtataattcattagtttttagtatgttcacagagttgtacaactatcaccactatctggtgtttagaatatttttgtcaccccccagaagaaaacctatacctgttagtagtcactccccattctccactcccttccagccctgggtcaccattaatcactttctgtcactgtggatttgcctatttggggcatgtgtgtagcctgcactttctttctttttatagttgagtaatattccattccatttttatagttggatatgtcacattttcattcacttattggttgagggacatttgggccgtttcctcttttggccattgtgaataatgccgctatgaatacttgtgcatgagtttttgtgtgaacttmacatttttagttgtcttgggtatgtgcttaggggtgaaattgctgggtcatatttaacattttcatggtctgcaaaactgttttccaaagcacttaataccattttacagttctaccagccttgtatgagggtttcaattctctacatccatgcttttgttattattattttagccatcctcgtgggtgtgaagtggtgaaatcaagtgaaatcttgtggttttgatttatatttccctgatgatcatgatggtgagcatcttttcatgtgctgattggtcatttgtatatcttctttggagaaatgcgcattcagatccattgcctatttttaaattagttgtgtgtttcccattgagttgtaagagttctctttatattctggatacacgttccttatctgatacatgatttgtaaatattttttattccattctggagttatgtcttcacttttttacaaccataccatgaagtttatcataagtgtgcaattcagtgacattaagtacatatataatgttgtgtaaccgaatagaaactctgtacccattaagcaataactctcttttcccctcttcttcagtcctgataaccactgttctactttctatcactctgaattttcctgttctagataccgcatataagcagaatcattccacatttgcccttttgtatctggcttctacatttagcgtaatgtcttcaagattcactcatgttgtagtatgtatcataatttcatttttctaggtgaataatacttcattctttgtatgtgtcacatatttctatccattcatctgttgatggacacttgggttacttctgccttttgtctattttgaataattctgtgatcagtgttggcatacaagcatctgtttgaatccatgttttcaattcttttagatatgtacctaggaatggaattgctgggtcatgtgataattctgttaaacttttcgaggaagtgccaaactcttcctcagtcccaacagcagacatatttcctaaatgtcatttcatttgtgtgtgcgttttttttcctttagacagagtctttttctgtcgcccagactagagtacagtggtgtgatctcggctcactgcaacctctgcttcccaggttcaagtgattctcctgcctcagcctcctgagtagctgggattacaggagtgtgccaccatgcctggctaatttttgtatttttagtagagacagggtttcaccatgttggccagaccggtcttgaactcctgacctcaagtgatccacccgcctctgcctcccaaagtgttgagattacaggtgtgagccacagtgcctggcctatcttttcatttttttgatagtgtcctttgaagcatgaaagttttaaattttgattaagtccaatttatttattttttgtttgcttgtgctgcttttgattttatataggaaaccattgcctaactaaggtcataaggatttattcctatattatattctaccatttttatagttttaggtctcacacttaggcctgtaatccattttcagttaacttttgtttatgatgtgagaggtgtgggagttggttggggggggtctaacttcattcttttgtatgtgggtatcaaatttgttgaaaagactattctttccccattaccttggcacctttttagaaaatcagttgaccataaatgtaaggatttacttttggactctgaattttattccttgatatgtatgtcttgtccttaagctattatcacaatatcttggttattgtggttttgtagtaaattttgaaatctggaagtataagtcctcctgcttcattcttctttttcaagatagttttggctcttttagatgcgaattttaagattagttcgtcaatttctgttttaaatctgtagatcagtttgaggagttttgccatcttaatgttaagtcttccaatccacaaatatatagaattaattgaattgtaatcaacttactgatttttctctttcattatcacttttgataaataactgtaacttctgacgttaatgagctctatcatctacattcttttttaaatttagtttaattttttttgagatggggtctcactctgtcacccaggttggagaacagtggctcgatcttggctctctacaaccttcacctcccaggcttgaacgatccttccacctcagcctcccgagtagctggaaccataagtgcacaccatcacacatggctaaatttttgtatttttagtagaaacaggtttccccatgttgcccaagctggtcttgaactcctgagctcaagcagttcacccaccacagcctcccaaagtgctgggattacaggcatgagccactgcacccagctttaccagctctatttcaaaatttgcacgtattctttcttcccctgtccaacaacattgcctgtaatctccttcccttcccatcttggttcctctggattttgttcttttgattgtgcaccatttcggcggtattcagtattgataatcagtttctcttcactggctcctctgccttcagtcaattcagtctccctgtcctaaacagtgcttattctggaatggattgcctcttaactattatttcccatctccatcttctcatttctttcacttccaaacttcctttataagtgactttctctcccagcttccattgcttcattagttaatgcattcattaccccttgaccaagtgccttaacttttcggccttcaatatttcctttctgtaaaatgagtgaattggtctggattcattgtagtaagctgtctttctagtctgaatctttggaacccttacttggagccccattgtatacaagtgagctattctgtactaattttgagtggcaagctttgagcctgttgccacatcagcagccgtccgtgtgggcctctcgagcttgaaagagcacagctcaaaagccacgggaaacgcttcagctctaaaatttggtagctctgcagtaattactgaagttacattcctgaaagttttaaacaatttacttgtggccaaattaaattctcttcttagacaccatttctcctgcacattttatagtatctaaacacttagagtactgttatttccctccccacccccaacatttttttccccttggctttaatctctctgctactcagcttaaatttcaacacttctaagaaaccattccaaatcatactagctcatagtaacattttccccttaataatccactgtaatggtcactatttatgcctttcatttggcacttaaaattatcacaaggggcaaggcgcagtggctcatgcctgtaaccccaacactctgtgagggcaaggcaggaggaggattgcttgagcctggagttcaagacaggccttgggcaacatagtgagatcccatctgtacaagaaaaaaatttttttttaattgtgtaaggtactttgaactacatcagtataatttaggcctggattctgacctaaagaaatataatctagtagaagaatagagatatgcaaaataattaaatataattatttctttttttttaatactttaagttttaggatacatgtgcacaatgtgcaggtttgttacatatgtatacatgtgccatgttggtgtgctgcacccattaactcgtcatttacattagatatatctcctaatgctatccctcccccctccccccaccccacaacagtccccggtttatgatgttccccttcctctgtccaggtgttctcattgttcaattcccacctatgagtgagaacatgcagtgtttggttttttgtccttgtgatagtttgctgagaatgatggtttccagcttcatccatgtccctacaaaggacatgaactcatccttttttatggctgcatagtattccatggtgtatatgtgccacattttcttaatccagtctatcgttgttggacatttgggttggttccaagtctttgctattgtgaatagtgcagcagtaaacaactcagtaatttgaaatttaaaaaaagtttaactcaatgattattgagttgaaagtactgagtgccatagaagaggtacagatagaattctgtggaaacttaaagatacctttcacctgggagaaaaggacagagtatcccaaaggagatgggttgggtctcaaagggaatatagtatttgaacacccaaaggtggacattcccaatcgaaggagcagcgtgaatcagggcaaaagtaggaaagcatgagatggtaggtatttcggtttgtctgaaagggttaccaagagaaagagtgaaatataaagatgtaaaagtaaatcagaatagacatagtgttgttagttgtctttttaaaatgtgtgtatcttgttttcccaattatgttataaactttgaagacaagtagtatgtcttatacttttaacctcctacaacaaggggtttggatatagtagtagtatttggtaaaaattttgttaaatgtatgaaagggagaaacagtagtttccccaacaagcattattcaaggtaacttcttgtcatacccttctgtttacttagactgtggttttatcagtaaaaactattttagagcttcatagtagtggttctttacagcttagaaatcattgcgggggccagtggcacaatggataacacacctgactatgaatcagaagattctaggagtcattaggggattttcaaaaatgggggttatgtgttatgtgtccaattaacaatactcagtttaattcattccctaaatgatatgggaagtgctggcttgagttgaggaaaagaataaatataaacaaacttaagactctaagttctttttgtattttattaaattagattttaaaggatattttcaggattcagattttatttaaccacaaatgttttaaaaaaggaattgagttaaaaaactgtctccaggaattgtgttgtattgtgcatgggtaactttttgttttttactgttatacaatattttatatgattgaaaaaaagattagaaacatcagctagtctgttcatattgctataaattcctggcactgctgttctccttggaaagagggtattacatacgcacataacaaaaagacaggaaaatggactgtgcctgtattcatccttttctttccaatagcatatgctaatccttwtcatttttataaagcaaaatatatttgacaaatgaaattggaagttacaactttcaaaagccatttattttagagattcttatggcaaagcaattcattattttacaatatttgttttgttttaaactttctatattatgtgctaggtgaaaaaccatttcgctgtgatgaatgtggtatgagattcatacaaaaatatcatatggaaaggcataagagaactcatagtggagaaaaaccttaccagtgtgaatactgtttacaggtaagagagatggcttgaaattcttctactgtaattaaattatacaataattataaattagattagaaaatattacaacttagagctatttaaggggccttctaactcttacagattagatttataatagaaaattggctcagtgaatttgtttggaattatgtatgttattgcattaatatatctttatattaattgttttgtttcactttttcttttcttggttgaccaaaaccacaaacaacccactaccatcctctgaattcaacagtatttttccagaacagatcgtgtattgaaacataaacgtatgtgccatgaaaatcatgacaaaaaactaaatasatgtgccatcaaaggtggccttctgacatctgaggaagattctggcttttctacatcaccaaaagacaactcactgccaaaaaagaaaaggcagaaaacggagaaaaaatcatctggaatggacaaagagagtgctttggacaaatctgacctgaaaaaagacaaaaatgattacttgcctctttattcttcaagtactaaagtaaaagatgagtatatggttgcagaatatgctgttgaaatgccacattcgtcagttgggggctcgcatttagaagatgcgtcaggagaaatacacccacctaagttagttctcaaaaaaattaatagtaagagaagtctgaaacagccactggagcaaaatcaaacaatttcacctttatccacatatgaagagagcaaagtttcaaagtatgcttttgaacttgtggataaacaggctttactggactcagaaggcaatgctgacattgatcaggttgataatttgcaggaggggcccagtaaacctgtgcatagtagtactaattatgatgatgccatgcagtttttgaagaagaagcggtatcttcaagcagcaagtaacaacagcagggaatatgcgctgaatgtgggtaccatagcttctcagccttctgtaacacaagcagctgtggcaagtgtcattgatgaaagtaccacggcatccatattagagtcacaggcactgaatgtggagattaagagtaatcatgacaaaaatgttattccagatgaggtactgcagactctgttggatcattattcccacaaagctaatggacagcatgagatatccttcagtgttgcagatactgaagtgacttctagcatatcaataaattcttcagaagtaccagaggtcaccccrtcagagaatgttggatcaagctcccaagcatcctcatcagataaagccaacatgttgcaggaatactccaagtttctgcagcaggctttggacagaactagccaaaatgatgcctatttgaatagcccgagccttaactttgtgactgataaccagaccctcccaaatcagccagcattctcttccatagacaagcaggtctatgccaccatgcccatcaatagctttcgatcaggaatgaattctccactaagaacaactccagataagtcccactttggactaatagttggtgattcacagcactcatttcccttttcaggtgatgagacaaaccatgcttctgccacatcaacacaggactttctggatcaagtgacttctcagaagaaagctgaggcccagcctgtccaccaagcttaccaaatgagctcctttgaacagcccttccgtgctccctatcatggatcaagagctggaatagctactcaatttagcactgccaatggacaggtgaaccttcggggaccagggacaagtgctgaattttcagaatttcccttggtgaatgtaaatgataatagagctgggatgacatcttcacctgatgccacaactggccagacttttggctaaaaaaaaaaaaaaagtgtaaataatactggcactttagaacagattaatcaagagtggggttactctgtgtaaatggagtgctgtacagatttaagagcaatgcgtaataacaagttaagctgatatgaatagcaagataatccaataactgcatttcgtttggttagtcagcattctttgaactgccttacatgttgtcacctttatagaagcaatgcattacttgttttagatcagaaacttgctattccacccacaccaagttaaaaaggaaaaaaaaaagactttcgcacaattgtttcctaactgataacattgtacattcttaggagattagtaattgtgtgaaatttactcatactgtttctaagtttttcagcatagtcattgcacttcagcagggaatctgagtatactttacagacagagtgaacttaaaagtttaatgtcaagagattatggcttaaataaattagtgtgtcctatagggggaaaaaaaccaagaaaccaccttttaaaaagaatgatatgccatatacccttgattttcattttgcattatattgacgtgtttttttgaaggaaaaaaagtaataaaaatctgatagtctaagactccactatttaaaagcctaattactttaaaaatatgcatactttcagaacttttaccaaaacacacaactgttgaagcagtcacttctctatggaagtatgcatattggtgtcagtttctttgtacagttgtacttagatattttttatgatttttcatgtgcaggtatcaaggttttgaagttttagtaaaagaaattctgtagattacattcccaagaacataatgcttacacaaaatgtatattccacgttttaaagcttaattgtattttactttacatatacacttcagttaacatagagcacttagaatctatttggtatttttgatttctcaaagtaaaaaaaaaattagatttttaggtttgatatggttgtgtcataatcatctcgtaattgacaattttaacttttggcaataaaaggaaattgggatatctttgraactgtaaaacctggtttaatctttttctttctagactcttgatagattggataattaaacagtatccagagaaactaaagaaatgggcattttaattgcatattttatcttgagttactttttaatgaacactgctcattacaactttacaaaccaaaagtgtttactaattccagtaactaccatttctttttcagctagatgagtgatcggaaaatttttgttgcatttcaaaatctaaataaactacagactttatccttataccatgaatgtttttttttaatactctgtcttaaaataatacagcatggtacaataaatagtgcttttatgtatatatacacacacacacttttctgaagaatgatggtttgagttatgcgttgggcagttttgatttttggaagttatattagttattgactctttgttacaactttttcatttttacattttaaattttctgccatcgttgtcacaatgcacatcctgatatagcaccagtgaaaatctaaaattaatacccttggaaaatgaaaatattcttaatttccattttgactcttatactggccctatagctctgcagtctttgtttcaatatagaatatgttatccatttaaattattttttcttttatttaatgttatcccaagactgttctcataaagaaagggaagaaataactatccacccttaacatccttcatttattttgaatatattggtgtttttatgataaggaatataaattatatttaatgtggtttcctgtatactttggttattaagttttgcttgaaatagtagttttcccgtttgacagctttctttgctgccaaagttttcaagaatttaagacttctttgaagtaaatatttaagttctgccattattgactcttaagattgtgtgtgttgtgttgtgcattacataattacaaaaaggcttcattcaggtgatacgttaaaaatggaactgtgctcaccctaaataggcattggtatttttctcttttggtgagagtaggcatttatttcttgagttgttttggagcctgatcaaaaattttgttcatggagaacttgatgcaattttgatacagtggagaggtttttttcggttgttttaacatcaccagcatagtttttagaatgtgactcttgctgagcatttagggtgagcttgggaaggaaggcctttgaaaatggtagttatgcaagcagactttcaggtgttgcattcctgttttcaacacatttctttaaatctacataatggcagacttttctaccaggttataagcagtttttagataagtgatactcagccagcataacttattgacttaccatttacgtatagtcatcactctcttactgtgaaattccaaatgcctaccagagttaccttgttctatcataatatgacaaacatctcaacagttttggatttccccactttggttcagaaggttatttaatttctatctgggcattaatggagaaaataagtagccttgtgtgctgcttcagattgaaacatggaggatatgagatattcttctgcaattcatgtttctcatttctcaaagtgagcacattgttctataaaaacatgctggtacacccttaaacttttgatcaatctgagtgaggtgtgcttttcctcttgggacctactcacgtttgaagattggaaacatcacgttaggcgaggcagtatctcttgaacatcttctaaagggttttttaaaaccttattctcacatatttcatttgtcttgaatatttaagtggctcttaaacgttttgggtctacatgcaaatgtggtacttaacaaggtaggaatccatcttcttagctctggctgagggtgccagccatcggtcaggtcatttttatctcaagaggcagaaggcagttatgtcaagaattgtgctcagggcaggatttcgtttccacagaggagagacacttgcagagtgccagctaggttagatcttttgccgctwctttcatttgattaatttgggtttttaaagggctgtttaaaaaaaaaaaaaaaaggccgggaaactttaaaagtaggcattactgtagtactgcatttcttagaacattttaaactagaactcatttttttttcacagtatatttacttgaagaagcactataataatcattgagaagtattttgagtctgaaatttaatttaattttccrtttcaaattgctttatttcagggaaataattttccagttgttttgctatattctgcaaataaaaaccgtgtttccttttttcacttaaactttggtaggaaacaaactaaagcagacaaacatttcttgttatgtttgttgctttctttaatccaatggataaaaaagtaaaaccctgtaaacattattttatttttttatgcaataccatgctgtaaatatggttcatcaaataaggatgtacctatgattgaatctttaattctgcacagttagagtttatatataaacgtgtcttgacaatcaaggacttttatgtgagtcttcctttatgatgtttattaatgttatgcattccatttgttttgaagtgagtaccaatgtgctaatktgtattgtctgaaagtatgtaatgtttttacagcttgtttttaagaatctgtaaatatgtacaaacaaatcacagtactgctttatgttagaaggcatatgatgttgtactgtatgtaagcaataatacatagcagtgctaactttacaagtagcatcaggaaagttctaaaaacatttcagagttattaattatccttatttcatttaataatgattatctttaatcagtttttataagcaaattccattgttcctcctattggaacgtaacactgtttacacagcataattgaagttgcaggggagacaggctaaatctgacttcatctgtactcactttcactaagcattgaatggccttaccactcttctgcaagatggaggaagaccgcaaaacttagtgcccatcacactgaaggaagggatgtggttttttttcctgcttctgtactgctacctaactttgtgatttgctttggattttaatatttgtttctgttttagattcaagcccgtaagttttgaggtgacttcagctccattgtgaaatagatagttctcttcatatttcataactacatttcaataattctaaactttctacattgatttttagatacttatttttcaagcttggtttctcagctgatcagatgaatttattcaacttcaatacaaagaaagacaaacctattatagtttcaagtgagtagatattatactgtacaggacagctatttgaacacacacatcactgctttagaaataaaaccgccaatttataaatgtatatgacctacattttataggaaaaaatgtttttaaatgctagtcatttatataatgtgctttgaaggatttgctagtccacttctgtcactttttagtacactggtatcttttatatgtaatgtatgctttttattattgtagcaaagcatttcagtagaaagaattttgcaacaatatgggggaaatttttcattgttggatttgaattatactggattttatctgtgtagtcttacttgtctttattttaatgctgtctgaagggaacttggtatccaaataaagcaggtaacctcattttacttcaagggcatactgtgtagtgctgaatttaatctgaaaatctgatgattttgaaaagaaaaacaagtttataaacattgtacagaagaaattaaatgtgtgtgatggaaatcctgatggtggagcacgttgaattttctgatatatagtgttattttcctgggatcccctatgccttctttgtatttcaactaataaaggaaaaaccctgtcattaaaactggtaagataataggatattctgattatacagtattactattcctatcccattttctgaccttttctcaatcactgtaaatttttattttctatttcctattgataattaaatatgtacataatatagacactgttgtatagaactaaatgaattgggttgctatgcttgagtgggtagtgaaatggaaatatttgatgaatactgagagttcctaaaatgctagagcaaatttccgagggaaaggggggcatcgtgtgtcttgggaaggttgcagcaggttgtttcttcaactccctaagaaatcattgggaaggactcaactgcaaactcgggatcagatacaaaatgggtctttccttcccctctcccccaaaaaataggagcactaaattttaaaatctactcaggtgacagttgctttgcaatgaaacttatcacattgaaattttcagtgttaaataaaaagagatttgtgatatttttaaatataaacttttacatcagtagtcagcagcctgacaattgaaatttggtaagtcgatatattttaaaatattttgctctccaaatagaattgtttttaaacaattgggaggttttttgtttctttaaatatgttttaattgtcattgtaaaaacaaaatcttgcttgaccctatattatgccatgaatgaattgctgagcctttataatacagtgacagcttgtttcatgcatagtcatggaacatagagatgttctttaaactgacctattgataagaggtttaatgagtttcacggctttcaacactattgtcatatagttatctttgccatttggagtttataaaaccattttatgtattgtgatactaaaggaagttgttttgctttactttaaattgaattattagactaatatttgcaaattctgcattttaaatgtggacactggctgtttgaaaaataaaatatagaatacagttttatggataattttcgagctgaatttttcacaatattctgaaccaaataacgaatggtaaatatgcaaaaatcatggtgcatagatataaccgtaaagagaaaagaatttctgtgtggaattaacagttacacaaattgggtaacaattatcagggcctttattatagctttatgtggaatgttattctaaaatgcaagagtcaaatgttactgtcattgaatattttagacttgaaacgtgtttatcatagagcgaagaaaatatgtgttcttttctttacagataagactctgttaacccactgtcagcatacgtgggatttcttttcttttttctttcattagtggagatttgttttcatccatctaccaccttgccagtaccctagcttgtgaccagcgggatgcattgtaagaaagttgtctgtggttaggagtgcagtctgggtccatggaacaaatttaaactaattggccctcgcaatgatcagtcctaggaccctggccttattattagcatggtgctttaaccaattgtacataataataccactgatagtctactaatgcatttcctagatcccagtttttcttgaatgattaggaatggtggggagaggggaggggagatattctacatgatacttctccaatcttctaaagattataagaaaaaataaaaaattgaagtcacttgaattaatgtgttgtcattgagtcttactcgacaatttatcatgcacaaagtgattatgaagattttcctgattatatgtttggattgaatttaaaaattttttttttcagaatgctggctgttctgttttatttcttctctggtgaacctgataggatataaattatattcatatgatgcataaagaatgaatggaggtgaaaagttttaagtgaactaaagctaaaatttgggtctcataattttctttcttttgtcattttcaagtgtaattaaaaggaacattttacccagacattcacacagctgcatatgcatatgtgtaagagctgggatgtgaaatgtgatattgtaaattagaatgacatttcaaagtgattttcaagtgactgggaaaactcaagtttagaaatggacttgaattgttagagaacatttgagcatttgcatatttacctactaatacagatgaacttttaaagttgtaaccttaattttccctagcttctcattcttaataaggttctgaaaataagatgttgtgtcaaggtggggaagggagccaaagaaatgccttgcccaaggtaggaactgtgttttctattgatctgagtcttactggggccgacttctttgaccctgcgttcattcagcacca

SEQ ID NO: 17575 - DNA, 29871 bp, Homo sapiens
  misc_feature (1)...(29871): n = A,T,C or G, or insertion/deletion polymorphism (see Tables 1-2)
aatacaaaatacagcgcctggcacagacctggtgcttatcaggtatttgcacaataactattttgcagaatgaacagcaggcttaaaaaagcagatgcccatctgctcattcagagcacccagctcccaagagcactacaccatcagcagaaattggaaacattccttcaccaccaaaggtgaggccagcagtgtctgtgactgcaaaacatgtacccagcatggggggatccagtggtcaccgccccattcaaggcaagcacaggtgttttcaaaaatgatctgtaaggctactaagagttaaaggtgtttctgccttaaaagcaaatgaaacaactaaaaagtcactgcccagggatttgagtcttttctttccacttctattattgagagagcctccagaagactacagctaagagggctgttattttcctactagaagagcagctgaggaaaggtaaaacagagcgagaatgatcatctatttactgtacaaccgctagtccgccactaagagaagtatgcaaacaagagcctccagaagatggctattccaccagtacatcaattaaccaaatagtgtaatgatacacacaatgtcactgacatgccagtacatcaatcagctacagagtataaaaccatgtgtggtccaaaaggaccctacaataatccccaagaatgctacgtggcacagtagctcatgtctatcagcccaactacttgggaggttgaggcaagaggatcacttgagcccaggagttcaaggctacagtgagccatgatcacaccactgcactccagccaggataataaagacctcatttttttaaaaaaaagtaaaataaaataaaaagatgctcccatgtgacagtcttacaatgcaggctagtgtctccaaagaagacttactgagctacacagaggaagctggacattaggaatcccacccagaaacatttgttaacccttacgaaatcactgattaagtttcaccagattcactgcttcaactttccaggtacccgtatttaggggggaaaaatccattcaccccaaatgaaatgattactggaccaaaattagttaacccaatcagaactacttgagtggccaagccattatcatcctataaagctggaaaggtttttgtatttctcaaaatcttatgactctcatcacaaatgagaccggaagaaatacaacgtttagcatggaagcatttgaactgtaggcacttttgctaacctacactttttttttttttttttttttgagatggagtcttgctctgtcactcaggctggagtgcaatggcgccatcttgtctcgctgcaacctctgcctcccaggttcaagtgattctcccacctcagcctcccgagtagctgggactacaggcgcacaccaccacacgcggctaatttttgtattgtatttttcgtagagacggggttttgccgtgctcgccaggctggtctcaaactcccgaccacaggtgatccgcccgcctcggcctcccaaagtgctgggattacaggcgtgagccatggcacccagccttatctacattttatttcatgaaaagagttgtgggaaaatgtgaaggctgccagtccatcattttcttggttactttggatccttctcctttgttgcaagaatcataaatattcccaattcttttacaggcaaaaatgaaacgtgtgcccaaatatgtcctttaaaaataaacattaaacattatgagggaaacaactggcattgtggaaaatgtctgtgcaccctggctaagcaactcactattgcttggattatattaatatacacaccataaagctaaggaagaacttaaatttgagcctctgcatttctgtgctgagtaagctgtagttctttcgacttatcgccttcatacttgcctgtccaaacaaaaagatctcaagaattccactgaaatagtccaaacaagagcttaaacttacaaagctgtttttcagagctcaatagtacaacaacaggaagtagaacttctgggatggggattttgctatttattttttctttcaatggccacttttaagcaagagagaaaaaagtctacaggcattacaaatcctggaagctatgaatcaggaagtgggaaatggctgatcctgaaatggccagcctgaaaatcctggctcttttatgtagtcaagtctctgaagccaggaatttcagaaatcttaggcattttgcattattttctgaatcttaaaagagctgagacttgagagaaaagagaagggccaggataaatgaaccaataaggaagcccccagtctccagctccatgcccctaccaccacacaaatcttgcccctataattacaagctcagttgggacatgctccttacaaatgacgtttgtttacaatgctgctaaggagagggggtgatagcccatggtttctgcagacagagcctgccccaggcttcagctttctcattctttcccaatgttgaatctggaatggactcgggaccctaaatatttcacaactccaaacaccctgcagttgattaaaaacaatggtcacttttgttttcaggaaagactatacctgatttttgctaagtctaagtaaaatgcaaagacccatgcaatgaacctgcatgaatgctttcagacatgcagatttggagggggacactgctctcttttgagcaaatggagatccagtaacagagcggggctcactctgcaatggctgcatttgcatcaacgtgagacaccaaacaaatgcccgcacacaggagtctactatgtggatcgagggaaaagagggcacctttatccttccaaatatgacaactcaatagaaaacttctcattccaaagtcctaagggtccctacaacaggaagctactggagcttgtgaaatatttccagttattttctacagaaattaaacatatcaattctaccggcaggtcatgtgagatgacaggtttaaaaatgtatgttgattgggggagaaaagcaaagaaaaaaaatagaagaaaataaagtcatttcctgtgtcagttgtaatttgggaggcttttttccagtgcccttctaagtaaatctgccataatcaaatgtagtcaaatataactgcaatgtgcaaaagcacagtgatgacctgagaggaaggtgccactaagaacccctgggaccagtcttctatctcttccatcagacatccactactacctccccaaaaaggctcagggttatttcataaacaccagtagcctcccatgtatttaacttagcacaaataagagaaccaatatgtaagggattttttttgctcttaagaaccaaccattcctcttaccccagcctttacagacctggaaaaccatccctgatttgcccccagcctcatcccccactacaacttaaacaaaccttcctctccagccttgcttccagccccaaaatacatttttaaagttctgatgccaagaccaccccatcaagtctagtataatccttctgatcatctaagtaccctcctccaggagacctccaagatccctctgggcaaaatgatctcttcctccaattccagggctctttcccagtgtgctcactccatcctcactcataaaagcatctggttccattccacagctgggcacaccttatcttctcaagagacaatgtaagctctttataaaacaggggctgcattttacacacctcacatacctcctgcaggtccccgaacatccaaacactccaaatttgtctctgtctccaaatcctacaaaaccaaattctctctacccagctcagctcagcatccctggggccccgatctacctcatctgcctcctctgctctagagtaaaagcaacaccagtcacccccactctgccgcccactgtagccgaatccaagtggcactctcagcccatgctcttatcagtgcactgggggcaggcctaccatctaccaagcaccagaaatgcccctccgagctttgtgcagcccccttgccaggcagacagcctccagggccaggttcggcacgggaagctagaacacggggctgactgcacagcctggggcagacacacctcagcttccacacccacctgacaaggctgcccagaggatggagggaagtcagtgtttcacccactgccctaatgggaagacagtgtttctcacccactgctcaagcctggaagcaaaaggtcccaatgttcctactcgatgacccgccctgtcatgccctgtccagatatctaaccctcacctttctctgtccatcaagcagtaagaattcatagcagccagcacatatgaccctgagggcaacgttctaacaaagccaaagaaaaggtggcacactggccttcaattcaaagcccagggtggcaagaaaagggtcactagttccctgaaaataactggcatgcaaaattcaaacaggtaattggggtggagttcatggaaaagggaagagaaaacctcacatgggtttgtatacccttcatttaagcacactgtcttcaggcagcagaggtttcaaggtgcatgctaaaaacccttgcgcaggtttcagagagcagataaaaggggctaaccaggctctcaggaagcccaatccgcacacgcacggagccgagccagtggaaaccataagcctgtctcatctgtctctaaactgctcacaggatgaacaggaaggcttgatcgatactgattttacagtcataggagtgactcatcacgaaattctacccagcttaaagctcagctgtgaacagaaacaaaacaacataatggcagggtcagatttaaaatagtaagtatgactggtaaacagttaatgctcataaacaattaacaatcaccttcccagcctcctggatttgctgggagaggaaaaagtactactgagggctctgaagcgggctgcagcagtaagtctgtcttctgtggcagccccttccaactcactgatgctggtgtcagctttacaaaaccctggagggtcacgaggagctgcttttaatagaattccacacatctgatgggtacgtgctcactgaggaggggagagaggaggaatgtacttacatggaacagagttttcagagagtgaaatttaagctctcctggagtataacttcctctatgtagctcctgcagagtttaaaataagcaacttatctgtcctaaaatgagagaaatggggtcatataaaatttctcaataattgagttcctctcaaactgcattcactttaaggaaagcactggggtgctcagaaggtgcactacacatttcaggcatttggttacagaggcgaatgtgctcagcgccatcctgaagacatgtactttcaagtactggattccatgtaaattttaatgatctgtaaccaactctcagacctggccaagaacttccatagagaatcctggtctggagatcccttcactatggcacactgctccactgttctgaactgcatgactgtgtcccctccaattcatatactgaagccccaacccccagataccttcagtggtatctgaaggtggggccttagggaggtaatcaggtttagatgaggtcctgagggtagagcccccataatggcaacaatgcccttacataaagaggaagagaccagagccccttgctctctccaccctgtgaggacacatgacatttgtcatctgcaagccaagaaatggacccttaacagaaaccaaatttggtcggcaccttgatctcagacttccagcctccagaactgtgagaaacataagtctgtggttttagccctcagtctatagtaacctgtcacagcagtctgagctaagacatccatacagccccgtaagagaaccaacccagggacgagcaacacctctcatcatctgacaccacctcctgcctgacgaccaggcaaaacaagcacatacacaaacaagcaaaaggggaggatgagagtggtcattcgggtttgctttggaggtccagagaaaatgcaagtccaacttccaggcacagaccagttgcycgcagcaggcttcctcccattggtctcagaccaaggtgagccactcccccgggcgggacagagaaagctcctctggaagccagacaagctcggccacctcgaagtcttctttggaatccagcaggtccaggcctgagccctggcgcctggttaaaccaaargatgacaaccaagcagaaaaaaatagccccagagagtatctgctggagaggcagacaggcggacctggccttcgacacacagcatgcgtgccatggtctctagcagcgcgtccctccaagcttcctggcctgtaaggcgaagcctctagcccttttctacttttaggatgctcagattcttgcctgcagaggtcaatccctttctttcaagggctcccccctctgtaatgagggagtccatttacaataaaaaaaaaattgagctgtcaaaacaaatgaaaaacttccagtataatcataatcagtgagggaatcaaacatctaaacaaatctctcttctggaaaaataagaaaatgaaaaagcaattacacgtcacatggctgattagcaataaatttcatttgtgactacrgtggcatgagagtttgactcctgacttgctttccttgaaagaaaaaaattatctgcaatactgtctcttgatatagaaaacagacccattccatctgactcagctcaaacctgcgttttttttcaaggcctctcctgacctcacagttcccccgcagtgatcccgtggtacctaggaccgccatggacaaggactggtctccttgaatttgtctccccaactattccacacatatactcgcataaacaattgagaaataagctttttaaaattgtggtaaaatatacacaacaaagaatttaacattttaacccttgttaagtgtatagttcactgacactgattcacaatgttgctcaaccaccgtaaccatccacctctagaacttttacatgttcccaaactgaaactctgtacccattaaacaccaattcctcattgctccctccccccagcctctattcaccgcccctcaccattctactttccgtctctatgaatgtgactactctacatagctcacgtaagggtaacaattatgcactgtttgtcctttcatgactggcttctttcacttcgcagagtgtcttcaaggttcacagacattgtagcacatcatagaatttccttcctttttaaggctcaatgatattccattgtatggatagaccacattttgtttatccacccgtctatggatggacccttgagttgctttcactttttggctattttgaattatttgctgccatgaacatgggtgtacaaatatctgttcgagcccctgctttcacttctttttgggcatataccccaaagtggaattgctggatcatatggcaattctatgatgaatttattgaggaagcaccatatcatcttcctgttaaaaaaaaaaaaggctgtgccattttaacagtctcaccagtaaggcacaagggttccaacatctccacatcctggcctatgcttgctatcatctggtgtttttggtaatagccatactaatgagtatgaagtaccaattgtgggtctgacttacatttcaccaatgactagtgactttcaacatcttttcatgtgcctatttgcctcaagtagtaagttttaaatcaaaagaattaacccctcctcctaagagacctctcatcacagaaagcaaacagtagtatccttacctactagcattgttaaattggttagtctgggctcaaaacacttttgttttccttgcaaataccaccataggcaatattcgcttagcaaagaccattcaagtccatctaccaagttgcctaaacaggactaaccttgaattctggtctcaggaagaccttgtgcgatccagggagcagagcaagagagcagctccttctcgcaccatcctgcatcaggcaacacactgcagctggcttcccacctgactgaagccttctcctgttctggcagccatgggccgctccagctggggatgctcatccttgcaagcagccatccacgcacaaagggcacaggttctcagggttctccacattcaatttaaaataccctaatttgtgttgcagatacttaatctaagtgtttttcagatcctgtgccctaaattttggctggaaacatagtcccactcacatccctcatgctcgtgaccaggctcttccccaggccacatgacccccaattacctccccctccttgaagaaggaagagactgaagggcgaagggacatccacagttcacattgataacgcaaatgatccatcaccatggcctcaaaagggccttggaatccaaatgacccacttactggaggaggatgcttcaaacggaggcagatgcagagtcaggagggagacagggacagaaaaggaggaagctgtgctgctatccccagtggagcgcttgtcaaactctctttacaagaaatgaagctgggttcctgccgggcgcggtggctcacgcctttaatcccagcactttgggaggccgaggtgggcggatcacaaggtcaggagatcaagaccatcctggctaacacggtgaaaccccatctctactaaaaatacaaaaattagtgtggcagcggacgcctgtagtcccagctgctggggaggctgaggcaggagaatggcgtgaacccgggaggtggagcttgcagtgagccaagattgcgccaccacactccagcctggacgacagagcgagattccatccaaaaaaaaaaaaaaaaatgaagctggttcctaattctgcagtcaaaaaaaaacggcaaatgtagctaggagcaaaacatcagaatcaatacacacccaaagggtatttttttttttaaaggaagtaaataacttctaatgcgtatttcctctatccttagcaacaatagtatcagctaactcctagtgtttataaaccctaggttctaagaaatgtgtatgtattcactcatgaagtattggtaacgatcctccaagatgggtgacactttttttttttttttttgacatggagtctcactctcgcccaggctggagtgcagtggcgcgatcttggctcactgcaacctccaacctccaacctccaacctccaacctccacctcccaggttcaagtgattctcctgcctcagcctcctgagtagctgggattacaggtgcatgccactgtgcctggctaatttttatatttttagtagagacagggtttcaccatgttagccaggctggtctcgaactcctgatttcaggtgatccgctcacctcggcctcccaaagtgctgggattacaggcatgagccaccgcactcggcctgatgggtggcattatcttccattttacagatgaggaaaggagagcagagagggtcaataacgtgccccggtacaatgcatcagtagacttctaattctccaaccctcatctcagaggggaatggtgtcakgaaacaagactggggggaaaagggagaaggcctgctttctagtcgagaaaagcggagaccgtctgaaactctacttgctccaacaggtsaacgtgattgaaaattcagaattcactctcctaatagcaggaaagtrttacaaaagcccacaggccaaatgataccaccctcccaggaagtctcttgcagaactgtgttttttaatgttatttgtcaagtgaaaacagttacagtggcagaacaggcagcacccagagagtggcactaatcgtgggctaaggatgggcaattgcttctcatcaagaaccacaatgtgtccagtcaatttacaaacataaatcaacacaagttcaaaagcaccagtagcaaagtccaggcctggatgtgaagctggcacccctctttaaacaaactgttcctcttcacttgcatggtaaggactggaaagagccctgccgcgttggccagctcttcagggtagcgggggccacygccctctcccagcctcgggaagcccaaggccactgcatcagcctggcccagcccagaaccagcctcgggcccagccggcccaactcagaaaaaggcaggggtcagtctccagcctggactcctctaaaaatcagaaagcagtgccccagcaaaygaacaacaacagcgctcacctgaaacagtttcaccttcatttttagaggagaggaacacaataggagggcgtattactccacgggttttaaccctagcccttgatgctaccaggtatccatgatgcccctaataaaggtgacagttcctycacttttctaacatccagctattctttaaaaaagttgaacactgcagtttccggagaactttgctatgtgaattgcctcactgcaggtgtgctctcccctagctctctccattccatgccttaaaagtgccaggtgtctcctcgggagctgccctgtgctaccgcccccagtcctgcagccaacctgttttgcgggtcctgcctctccatcaactgggactgctctctcgacaaaccaccccagcccacagctcctctggcaacccagcccctcacaccgaggacccatctcaccagtcacctccctcagstgggccaacctgtccagtccattcctgcttcctggtctcaggtctagagacaagacttccctccctgagcctgtcctcactgcctccctcatctataccatcactggctcacaccggggtgtctatctgtcccccaatcctgactccatcgagagaccagagcagcctccccagaacacccttctcagcgggtccactgcaatggtgcaaaggtttcagcgctcctcattctctagccagcagtcaattccttcccaccacacaaacaccggattctgacaccctctccactccatcagtgcacactgccacccacaccacacatggtcccttcctctcctggggagctgcctccttggatcttgagagtcaaatatttagggcacactaaagtcagacatcctccttaaagcttctcaagccattctgcagttccgtgaccccactgcctgcagcccacatacttctctccggtcagcatcccataacttagcactaaactcatagcatctgttactctccaccagtagttgagttttcccaactagacaacaagctcgagtaaaaaaaaaaaatcatattctttcatatgctttccatggagcagagaccactggaggccctcaaataatctagatatcagaaacagggttccatactctgtcaccactcaccttccactcccactccccttccacagatagggacatgaccttgaaccagtcagcctggttaacctaaaaacccattctcttcaggcacagagaagcaaggtggttacttagtggtttcaacaactgacctgagactcagacgtccgggttcaaacctttcactgtagatgtgcaaaaaaagaccctccttggccagccacagtggctcacatctgtaatcccagcactatgggaggccgaggtcggtggattgcttgaggccaggagtttgagaccagcctgaccaacatgcctaaaccccgtctctactagaaaaaaaaaaaattagccaggcgtggtggcacacgcctgtaatcccagcttcttgggaagctgatccacaagaattgtttgaacctgggaggaagaggttgcagtaaggcagaggttgcagtgagcggagattgcaccactgcactccagcctgggcaacagagcaagactgtctcaaaaaaaaaaaaaaaaaaaaagggccytattcaactggcagcaattccccagtgttgtggggaaggaggactggaggccccagagagagcccaccagggccacccaccatgaggaggagaaaaaaagagaaaagcatccatttattggatgctttctatttgccaggtttgctgggcagcttggatacattatctattgctaattctcattggcatccctgctagagcagtgttattccaatcacaggcagagacactgaggcctggagctccctttccaacatgcctccatgcgtgggagagagggagacagtgaattgtttgaggggacaaggcttcaaaggaagccctgcacatatgcaaaccgcacggagaagagcagagcaaagacaggccaggctgtccagctaagttcacatccagccggttcagcattcacatgagaatttcacaagatgcttttttacaagctactcttgaatattaacattccagcttcaaatgattatgtttacattnnnnnnnnnnnnnnnnnnnnccaccccactcctcggaagaggagactttaaggataatttctaaggtgttcattaagttcaggagtccccttgacaccaacctagacaagtaagctttcttctgtccagaggtcgggagctggcctcaccgtcgccctaccaggacactgtcaaaggccttcaccagcaaccaaaaccggcagggttggagagggtgcttcaatgatagagagacctgtaagaccttgctactgtccctcccaggagtgaggcaaaagcttactggcctcaccaagaaaacaatgcaaaaaatagaagccaacttccatacgtggtgattctgcttgttccaaccacatctccctcaaatctccatctctctctctgcctagtatcttgagatctgaaggctggaagggcctgtgaaatgacctaggtccaccctgtaactcaaggtcagcaggtgtgcaagtaccctacccacccaactttctgagatgccaccctggccctctgcaccaggccactccggagaccaccaggcagccgagtccagcctgcagatgcttcctcctcaggaacccagctccaggagggtttaaaagcacactacagacataaatcggtgccaatgaattattcattacatcttatctatagggaacttatggaacaaagtctccatccacagggatgaggtgatcttgacacaaggccagactcacaaattacccttccaggagttctaattttttttattcacctcaatgtgcaaaaagcctaatcaaacaatgattttaaagataattttattgctttcaagttccatgcagcagtaactggtgtgataaaatgttttggctagcagaggtgcaatgatcagatgaaaataaatttgttgtacaaagaagtgcttcaaagtgaatggcgagtatccctttaagaagtcttccgtttcttcagctcctcctatgcaccaggcactgggccacctcctgggaattcaaagataaccaaggtaccattcccctccccaatggtgggggaaagcaatatgggggagatgcccaaataggaggtatagcaagagaccacaggagctcaagtcagtgcaatcattctgcatgcagaatcaaggccagagagagggtgaaattacagctaactcttaaaggagcttgccagagggcaagctgrtagtattgtttgctattccaagcagaggggcttccacctgccaagacaaaragacacgaatgagtacagcctgaactgttcaaaatgtctgggaggaagggaggctgaagttctctctcagacagccaaacaaagatttccgaattaaaaataataaaaggcaatcatggggaaacaggtttaaggcttttgacacgtaaaactgaataaccagctatatattttgtgtaatctcagcaagaaagattctgaaaatatcaataaaacatgaaacaaaatacataaaattagctagcgaaatatagacggtgtgggacctaacacaacactggatgtatttattcttattctctgtgagtatttctggctggcgagcatcttaaccacatagaatagccaaaggggagagagaagagaatgaaagtgttactacctgtttaaatagagcaatggaaggtaaatcttgctgtatttttccaaatgaaatcagtagtgtttttttaatctctaatctcaaatattttggagctttaaatttattaaagtcctgtaaaattatcttaaaactctaactgtaaaagacacactaggtgttaacagctctgccatggagttgcagtgcgcctgtctgcatcacttaggaagaccctaattctctcaggacagctcgcactgacacagtagagtaaccttaatccaaaactgtagcccagtgatttctacagaagtctgtagtatccacattttcttgcaatcagtccccaggaagcaagccagagagtgggttgggatcgctatcttcctccttggggcactattaattcagtcacctaatatgctgaatttcccttctggccactagatggagcctatgcataggcgagatgggcaaagtgcacactggacacctctcaggtgtgagcagaaattgacaaatgacaatattaagggagaaagtgtaataaacagatctctgaaatggaaggcaaactgcagggggatgaccatcgtttactgaaaaaaaaaatcacaactgtttaataagcaacatgccatcttgttaataaacaccttagcaaaataaagttttattatacatttattgagcacctatgtgccaggttctataacatatttaaatggcaaggacaatcaaacatcaagtaagccttatatttctatccaaagaacatctctgttcgaggatgtcacaaccctaagaacagtagcagttgaagtccaagggcttaataccaggtgccaggttctattctaggcacttgacatgtgtacgaatttgatttctatgaatgtttaaagtagattctattaaaattataatttcacagatgaggaaactgaggcacaagaagattaaattatttgcctgagagcttagctastgaagagctgagattcaaaccagccactttggctccatggtcctaataaaattacaagcaaggaacaagacaaatcactgtcaaccagcaaaaccgtgggttatgaactcaaaaggagtaatgggaaagtagatctatacaagttagggaaatcccaaaaaccttcaagaaggaagaggaatttgacttggaaatgtaaagatggcatctctgacctattcaaaccacagaaaaggcatatgggggaaaggaatcacctgacttagcgtgctgccttttgaaagttatgatcttgtccctattttacagatccacctggaacttggaaattatttcaatttaaaaaacctattctatttcctcacaatttttctgactttggttttctaaacctgttagaaaaggttttcattctgttgtttagtgagaaaaggagaaatgtctcccccaaatatttttaagtctccgcatttctatcaagactcagaaaagttaataactttaggaccaaagaactaattggcagctaaggagaaactaaagctatggtgaccttcctgtgttcttaagcggcactttctgctattcagtattgaggatggaaggagaagtagcagagtagtgaagaggaaaaacattctcagctatggaaacagcagaagcaaaaacttgaagacaggcataacacagcttcctttccatcaagctaatgcacagatgctggggagtaccaggaactaacagtggatccctacagcacaggattactaaggacctgtttcattacttgattctaaggaccctggacttgatcctaggaccacaagaggcacgttctgagtatttggagctggcaagtccatcagactaagggaatggtacaggaactggttcagaggccaactcagcatgtagtcagagtcaatgcaggtctgcactggaccaggctggatcccggaataggggtcaatctgagcgatttcaagtgactcagtgagatcgaaaggcaacattcaattaatgagtctccccagaaaaggacaggctgcagaactgaaactgaacaaattccatcctgagccaatctctgttgctgaaaattttactgaggtgcatgtgagaaagaaaatcccaattgtatcacctgacgaagaaaggctaccataacaaaagttctgtacctacgactacacgatatcatgttgtgacctaacatatgcagtgaactcattatccacagaaatcagacaacagaactaagggaagcctcacagcagatctccctctgctgctactggtctctgtgttcatttgttttcgtggcaatctgtgcttctctttaaagtcctgagtctgtaagcttgtgtattatcccactaaaatgagactcagggaaattaggtaaagagaataaatacaggacaacacagataaatgtggacacaactgagagggattttacaatctagacagaattaatagctaatgacttagaaaacactttgtaagctgatgcagtcaattggatcatgggctcctacctggaatttctctccatgcttcctactttttccaggaagttatcaaaggtcactaagacgctttgaatttggggaaaactcctayaaataaattcatctctccctaattaccattagacttctgttctttaaagttctattgactaaactttggctgacttaaattggtgatgtctcatttacgtaatcaagcacatattcccaataaccaactttacagagactaaccacgactatattttttacagcagaggacaagctgaaagcaatcacaatgtatcaggaaaaatttcaagttatgctctataaaatatttatgctctaacaactatcaaaatatatttgttctcccatgtcaagagtaatttttaaagtggtatttatttttaaactgacaaataattccaaagccagtttgagaaagctagtgccatgttaaaaagaaaatggttgaacaaaagtatacaaaacagcaacaacaatgtatttcaaactygcagaatttggacgatggacggatggatggagatacacaattctgaacaaacggcattcgtattatgtaactcttactgaagtagagacctatggtattaagggggctaagactgaggagtgagataaaacaaagtttcaaactcctccccgcaagaactttctggattagcaagactactttctaaagtctttaaaatatgcaaaaaaacaaaaaaaaaatgttttccagactattaccaggtgagcaatttatttttatatatgtattttgtgtgtgtgatggagtctcgctctgtcacccaggctggagtgcagtggcatcatcttggctcactgcaacctctgcctcctgggtttcagcaattctcctgcctcagcctctcacgtagctgggattataggcacgggccaccacgcccggttaattctggtatttttagtagaaagggggtgcaccatgttggccaggctggtcttgaacttctgacctcaagtgatctgcccaccttggcctcccaaagtgctggggttacaggcaggagccgctgtgcccagccaggtgagcagtaaggtaggcccagctatcgctgcagtgtgtgatggccccatccacaggtgtgcacatcttccccatgtgactagccagccgccccactactccaaagaatgtgaatgcttcaagaccaccaaccaccaagtgagctccatggacacaaggcccaacaacttatattgcaatcgtaggtgttcatccctcaccataaaagaaactactttctgttgtggtccagtgaaaacagaagagcaatctatgagtttacaaattcttgtaggctgggggtggtggctcgcacctgtgatcccagccctccgggaggccgaggtgagtggatcgcttgagtccaacctgagcaacatagcaaaacctcgtctgtactaaaaatacaaaaaattagccaggcatggtggtgtgtgcctgtagtcccacctacttgggaggatcactggagcctgggaggtcaaggcagaatcaagccgtgatcacaccactgcattccagcctaggtgaccagagaccctgtctcaaaaaaaaaaaagaaaaaaaaatctgtagtccagggcaggaaaaagaaaaattttaagcttgcttactagtttgtttcgttttatttttttttttaataaacatggcagtaacatctatagtttgacgggtatctttaaaaacttatggtaagacattttacagtatcaaataatttctaaacctaaagaactgcatccagtaagtactcaacatgtatttactgtggaagaaaagagggagggaaaacgactatttctcagttcaagtaaggaaatatcagtttttccttaagatttgaaaataaaacataagtaaagccggcatcagtggaaaaaaagggagagaaatcttcaaaaatggtatctgggactttcaaacgagtaaaattgaccatttaaaaacttagtcttcaaaagtccaaaagtctcaaaatcaaaggtattgttaatactttgagtcaaataaaaccaaagcaatttaacaaaagaaaacatcatgccgaggaagtatgcttctcttgagataacaatctaacttgtttwaaagatcctttgtttactaaccattttatattccaaatatatgttccttcctcagaacaaatcaattcttttccagaccctcggggatgggggtgcaggcatgaggggatgtgtacatatatcaaagttttaatcttttcaaatagtggaactcagttatgcttcccaaatgtcaacaggtctcaatgtccacaaacactggggctgctaccctcccccatccccacttaaagccacatcacatctttacaaataactggaaaacctcctcttgctaagctgatgccaaacaccattttccaggagggatcagagtgcatcactcattaggcactttgttgtctctaaagtgttcagaattttccttcagaacatctcagactggaaatcaagaaactatatccgtaacatgtgtgcaactattatatatttagtacaattgagaagagctcatcccctggactcagcacctgtcctaagctggctaagaaaagcagttcaaatcaagttcgcccacaggcgcaaatacctcttccatgaactaggtctgatttttaaatgagttttgaaaacaaattggggaaaatcacaacctataaagaaatgtatcttgtatgctttacaattaaaaaacaaaaactttcaggatttgtctcctcactcttactccctcacgcttttaaaaacaccaagttatttacaaattataaaatgccctgaaattatgaatgcttcctgatttctagaaagctaactaagcaatatgtaatccagaaaacttctgaaataagttccatctttcttacaactcaaaacatgctatgcaacgttcatgtacacacctgtgactcctaatttttggaaaaaggcaactacaacactgcagtttgtaaatcacaattgccatatccaatgttataaagaagacagtgccgccagtcaagatgggttaacatcacctgtatgtcacagtctacagtgacatcccaatataacggaaagcaccaatgaggcaaaaaaggtatagggtaaaggcttctgatgaacaacactagagtcctaagtctacagaaatatttttaaaagaacctttaaaatgctaactactgtctacttgaaaactgcaccctatactgagtctgaaaaaaaatctgaatttcaagaaaggtggtttcatgcaagactctgcaggttcatgcactgagtagcacaaggtcagctttcatacagtaggtgcacaataagtgcaggctggattcagttgcttcttacagcacattcttacaaaacaaatgaaaccagatttaaaaggaaaccaccgtcccttgagggttcctcttggcaaaaactctaaggcaacaagtgaaaatgatacagttgattttcattactgccctgatcttgcaacaataggaagggcaggaaacatttttattagtaaactaagccttagacaaagaccaaaagcaaatgtaaacaacaattattctctaggtcttttcctattgaaaggccagggtaaatctggataaatgcacacagtttcaaaacaaaaatgcctttgccacattttaaaacctttcgttctgtaaggaattttaattttataaaaatcactgtatacttgaaacagtgtatcctaaaactactgcatcctaaagattctttctcctgctcagaccctggaactatgtaagaaataaaataaaactgcaaagaaaagaaacaacaatactgcattaaaatgaactgttctgttcatcctcagtccttactaccacttgtggtcaatgtggcatatcaaaaaatgagtgtttaaaacatcttaaaacagcaatgtctttctttgttggaaaacataataaaactggaaatacaaacagcccttcagactcagctcctaaactctatcctgaaaaaaaccatcatttcagattcagctgaggtttctattgtcaaaaatctgccctccaccagcatttgtgttttttaaatccagctcctcaatccctaactgaagctacatagaaccaagattctttttctcctgcttgcccatttctactgcgggattgaatccctgttgctaagcttcaattatcagtttgttgtattgctgcaactcacggatctgaaaaactcataaatgaaaagagagagagacatcagcctgtcaaatrtatgtaataattttaacgtaatttaaggtagcataacaagttattttcaacctgatcacatttctttaaaaaaaaaaaaaaagggtttattgagatataattcacataccattaaagtccccgatttaaagtayataatccaatggttttaagtatatttagagctatgcagccatcgccacaaactaattttagaacaattttcatcaccccaaaaagaaaccctgtgcccacyagcagtcactccccattccatccgcccccagcccctggcaaccactcatctaccttctgcctctatggatttgtttattctagacatttcacataaaccggatcatacgatatgtggtcttttgtgactgacttctttcactttttgtgatatttttaagcttcatctattcaaccttagcatatttcttagagttgaacttttctaatctttttcgacaaatcaaacattatgaccttttacatttcaaatcctgacacaaaccccacccttccacaaaacaccatttgcttgctatgtctctccagaggatctaaactataatttgctgtttaggttctttcagaagttctttttctgggttctccttctggtaataaaacactaacttctttaaacaccaacatttcacatacctacatttctgtgacaacaggatgcctggggtagaaagatgactgaatccttttaaggagatgggtacaataaatttaaagtgcatgctgactttttaaaaacaaaatagccctcagattatctggctatcactcagaacctccgaaccgccttcatttagatgctctgttcacattatggtgatacaaaacaaacacatccatatgactgcctctgcttcagaaactaagttttctaagataaacaacactctttctactgccatcacactcaaagaggaaactctaatctctcaatacgccagcaaaatacctgcaactgaaccaacaccctgtctttatttctccaccagacaacagctgaaagaacgccctccctgatagggctcagcagcttatttctatcagagttaagtggtctagcaccttcccsgctaaaaactgaacgcccgttcacaggcatagcttttaattctccacatttcagagatggagggaggggcaggtactgagtcagtcaagacttcagcaaaccataatcgagatttggggtgccttctgaccacccatcaggtttccaggaactaaccactgtaaagggatcctggggggaagctttggtatcatggagtaaaaacatacattaaaacaccccctccctcctgcctgtgttctcaaaaatcgccgtcttgcacaaasaatatccttcaagaagaacgctccaaaagaaaaacagcctattttaaaatgcccgactcctgcgtcggcgaaggccatccctgctgttttgaatttcagaacattaaaaacacaaaactagagaagctatacagttcaactgcataacataacaaaatggattatttctcccgtgtcttctaaaccgtacttatcttttaaagataaaaaccctyctttgtccccccagccaccacctaaacgacttagtaaagggagccggaaggctttcgcccaatcgagtccgctgaaagtttagaaaacaaagagcaggagagcccagatctgtggaaggtccggccccagtccgcgtcccactcggcagtaaacacgcgaaccacgatctgctctcgttccgtcgcggactcatttcttaccagacgtttaaggatttgtttatagaaacagcctttctgaattgccccggtgatggggccatacaacctccgctgcctcctccttccccgcctcactcgtgaaggctcagtcgtgattttttcaaagttaatcggcaccacctgcataccctcggcaaccattactcaccaacacgccctcaccgttcccagtcccagttctgcgacatttaaacttttaatcgtgttcaaattaccctaccatcttgaatgtaccagtaagccacactttcaactttttcagaagaataaaacccccacctcctccggccgtagacaccggggggagttctcgctccccgcatccccgcgcttccctactaacccccacccgacaccaccaaaacaaaagctatcagattgcaaaagacagcgaatgtggagcgacactgcttattaactacgtacaaaggaagtgcggggcggcagaagagagggcgacacgacgccgaccacaacaaaaccaaggccagggctccgcgctcgcaaaacacaacaccctccccgcgccgccgcagaccctggcgctgaaaccacagcgtacgacacctctcgccagggacgggcgtctaggtgtccccgtgaggcggcgactacaccccgcgctgcgagcacgtgtgtcggaatgcacgtcggctccgaccacacacccaccaacgcacactcggatgcggccctagtacccctccatcccccggcccgggagaaactgggagaccatcccagagccctctgaactggggacccagtggcgctccccggaagagacaagctgaggaagactcccggcctcgcacttcccggggggctgcccagagagcgcttcccctcaccccaccgcccagccccgggacgccgggggcaggtaacccaacgaggagcgggccaaagtgacgggcaaggccaggaacccgaggagcccgaggggcaaaagcacgttgggcgacgggaggcagcgacgggcgcttggagacgtgtcctggggcttcggggcctctccgcagggcacctcccccctcgagggcaactcgcaccccgcgggccgggcggctgcccgctccccactgcccggtcagccccagcagcggagacgcggtgcggcccagggtgctgtcgctgctgcctgcgcgccgcagggggatcagcgctgtgtgcggagaggctcgtgcgcacggaaggggcgaggtgcgggtcgcggggcccgggaaccgcggagcccgccccggcaccaacttccctaccgagtcctcgcgcctagccgggaaacacggctgggctgtcaggacggagaaagagaaaagcccttcccgcgcggggatgcgcggagccagggcccgcggggctccagacgaacgagcccgggtcccgggtccgctgcagcctccctcccggcagagccgccctgcgccccaccccgccgctcccgagcccgggggcccgacagctgcgacggtggcaactcgggtttcgcaaacagggcgcagcccctcggaggaaaagttcccgcagtggccgcgggcggcgggcacatactcactttctccactcgtcggccagagcgagagcgcggcggagagaaacaggagcccccacagcgaggtcggggaccctcctccggagccagacttcattccttttatttgggatgaaattcccctttctcaaaaaaaaaaaaaaaagaaaagaaaagaaaaaaaggaaatgaaaggaaacaagtctcaaactcagtcttcgctccccctccaaaaacaagggcgaaggaaacaatactccgaaggcggcgccgccggggccctccgggtgcgcggacggggcgggcggcgcggggcggcccctcagcgccggcagcagcggcccagggctcggcggagtcgggaacccgaggcgcgccggggcggactgtcggcgtcgtcggcctccattttcaaacccggagaggcaggaaggggggaaaactgcaaagaaagggggcaaagcccaaatctgcctaggcgaggaaaaacaagcccggccctggccgcgcgggaggcggccggacgcccgagcttccgccgcgggagggcgcgacgcagttcgcaagatcgccccgaagtccgggtcacaggcgaggccggcgaggggcagaaacgcggagtcaaaatgaatgagcggctccccctcctcctcctcctcctcctggctccgctcgccgccgcctcctccctcagcgccgccgccgccgcggcgagctccttcccaaatccaggacacacacaaagcggcgggccggccgcgccgcgctcagcactcccgccgcgccgcccggctctgcgccgccgcccgccccgcgccggcccccgcccggcccccgcccgccgccgcctgctctgcgcgggggctccggctcgctgaaggtcacagccgaggcgaggcgcgccgtggagctgcccccgcgcgggaggggcgtggagggcgcggggggatccggggagcggggccgagggtctgcgagcgccggccgtgggcaggctcgctggcggcgtccctctcgctctcccgcctctctcgagttcgcctggtgcgctcgctcctcctcgggttttttccctttttttttccgctcagcggagttaatgctggtaaacaagagccccagcctcgccgcgccgccgccgccgctgccacacactgggggctcgcgcgcgcgcgcgcgcgccctggcccgcgcacacgcgcccgctcgcacactcgagcggccaccgccgcagcagcggcgcgccgagggcccggcccaggccggcgcgcgcaaaaaaccggagcccgggttccccaagacgtgcggagcggagcccgggcgtggggcgcgagactgcgaggcgccgccccccatctcccgccccaccgcctcccgcgcgcacacagagacacgcgcgcgtgcccacccgctcccgcccccaccgcactgcgccggccaccccgcacgcgccctcccctcccgcccgactccaaaaacaatgcccccgccgccggtccggtctcggcggggcaggggtgggtagccagggaaaggctaggcaggggaggggtgggcaggagaggggaggggtgggcggggagtgcggggctgggagaggttcattgaaaacaacaacagcgcggctggaaagcgcgtttccccggttcttgaaaagcttcattgtttcttgcagctgttgcaaaataaataaatgcgtgcatgcggcatttttttcgctgcgtactggaaagcccgaacgtggcggaaggggcgcacctgggagaaaggggacccccccccccaggctactacgccgggcactttcacgccaggctggggtgcccgcggcgttgcgaccgtggagcccggagtttgggggctcagggggagcggagggggaagggcgcggcccgtgtggctcggcccagagtggctcgaggagagaggaccccgccgcccctcgcgggccccgcgccccggaaggggggcccagacaggcagcgccgcgtgccccgggcgcgtccccgcggcggccgccagagggcgcggcgggcgctggggagggcagcccgcggagagtcgcctccctccctccgggggaggaaatgtgggggcccgggctgggggccgactcggctgggtcgcgctggcgtggcctcccggaccagccgcccgccctgagcgctctccgcggcctcgcgcagctcagggctccaccacgtgggcggctgcggggagcggccggggcgcgtgcacgctgcgggtctccgaagctcggggggcgtgtccgggtcccggggcgccgaggagggggtggaggctggggccgggaagcctcccttggctgcggtcccgacccgggaacacgccgcatgcactcgggatcagcggctactgcggaaacccacccgcacctgtctcgggtcctcccaggcacgttcctcttgcttcgtttgctacgtaagtgactggaaaccagtaccgaccctaagtctccgcggttgttttcttgaatgtgcaggaggagaggtttccccaaagcgagactcccctaggactgccatctaatgaataaatgctgcggagaccaggtcctcaaagagggaaacagcccagcagtggcaggagagaggagtttgaaatacgtggacttttacaaacagtgattggaccatgtgtcgcccttaatgtggtccggtttcatgactcaggctaattgatgccagtaataaatttttttaagatagctaataaaagagttgtgaattgtcgagataagaagtggttgtctcaaacaatcgggtaggatggtaagaagggacctgatgtaaaggaaggtagtaggtttcttttactctctaattctaaaatacttctgcattagaacgtgtatccatcgttcgtaaataattttttaagagctgaaaacaagtcaaaagctatcataacggaaacttagccctttttttctaaagttgtttcctagatcattttcctccttggaaatttctagctcaattcagagtcagttgtatagaaagaaaataaaccttgttttacctaagaaagttattcatatgatgggatggttttgtttaactgaaattcagcttgatttttaaataaagagtttcagttttggatgttcctagatttaacagtgaaataaatttattagaatcttaaaatgtattatttaaaaattaggcactacacatgaagaattaaagtccagtctactaatttttaaatatttcttaagttctctgcatgaggttggtcttgattcctgcagatccactctggagttaaatgcaaaggaatattgatatataatttcattatacttgatttcagaatttttaatacatacttgtaagacaaaaatttagagctgatttttaaaaggctagtgctaatataaaatcttcaaatactacccaatgtatttttagtattagtaataaatatgcctgtttatttgtccccaagaacataaagaggtctatagaatttttaaatgtatataggttgttgtaggggttgtaggatttgtttttgtgtgttttttttttactaaaatgatttttatttgtgaattttttaaatgtttgtgttttcctgaagtagtaggaaatcaatcgtattaagttattttaaacagtgaagtgggagatgtatcattatatagcttaatatttagggaaaaaaaaggaacaaaaatttaggttgtctttacgctctaacttgaccacatggacaaaggaggtgatttgtatttcttcaatgattatattttacatacacaagtcaaacttattttttcaaccttgaaataaaatcatgtagacaaaaattaattggagtctttgctttatacccacattgacaatgcaccaaactttttattttataccattttactcaggtatcttataggttctccctcttttggagcagaaactgattgcttgttttcattttttaaaaacgccgtttacttgataacagtttcatctcaaattattctgctaaatgtaccagactccccaaaaaatgtaatgtatatcatatacatcaagtgcaaacgtgagaaacagcacaacaattgacaagtatcaagtaatacagtatattgtgatgtattcgcagaaaggaatgttagcagcaaaagtgaataaactacagccccacacaacatgggcagatctttgaaacacactgagtaaaaatatacaaatatcaaaaacgcacacagcgtaacaccattttgataaagctcttaaaaagcaaggaaaactttaaaagttacagaaaattttttttgctttaaataataaaataatatttttcctttgttttgcttttgttttagcaaaagaattaatgaaggatgtgaattcctttggagaggatgagaagcccataggcacatgggtttccattgtaatttggaaatgagttcactcttggattgagtgacggatttacaaatttccattttataagtatgcttaataactaacacatgttctacatatttttgtatgtataaaacattaaagaagataaataaaaatatgggagagatccatgaaagagatcattctggttttccaatgggagtcgttcagatttcgagctgtccgtataaataactcagaagcattaaagatctactaaaataacacagttaatcaaggtctgatccttaagatatttcagaagaatgtccacacatctaatatcgatgcaatttaagacaaaaatcaaaagacaaaaaatttaaaagacctcacttcacaggtaataagcttcattaagagtgcattatgtcaactgtttgacagtttcttataaggtaaaacatacaactaacttacgatccagcaagtctagccctagttatttacccaaaagaaatgaaaattccacaaaaatacttctatgggaatgtcaataggtgctttgttcataatagcaaaaactaaaacaacccaaatgtaaatcaaaaggagaatggataaacaaatcatgatatatccattcaatgcaatactgcttagcagtaaaaaggaatggactactaatccatgcaaaaacataaatgagtctccaaagcataatgtataagccaaaagagtacatactgtattagctcatttatgtaaagctcaaaaacaggcaagattgatctagagctagaaatcagaatcatggctgccctgggtgggtagagagggaaagtttcaaatgactagggagaggcataaagaactttcttgggtgatggcaatgctctatatcttgatggggtgttggctatgctagtatatgcatttagcagaaacacatcagactgtacacttaagatgggtgcacttcattctgcataattgtatctgaatgttaaattgttaagattgtattataatttagatagttgcagctgttctaaaaaaaatgttagcacaatgcttcccgtttttactattaggtgagttagtagagatgctaaactccaacatccttgcccacagctgtctacagatgtgtatactttcagtgtgtatctgcctaaggtctttccttaggggcattagctgtggaaggcatcacatggtctccacagagcaccccaagggcaggaaaaatacaagtgatgctgtagctgattcctatccccacacagccacaagcaacaagagtctcagtcttgttgaggatctgtttatactcaacttg

SEQ ID NO: 17576 - DNA, 19277 bp, Homo sapiens
cacctttcaggattgaagctcaggattggaatccagattgatgccatgtgggcaccagctgatttatgctcaagttgaatgacatttatggacaagagccacaggaaaactgacagcagagaccttgctattttatgaaggaaaatcacgtttacagtgctgacctacacatgcaaatttacggtctcaactgatcacaagcctctttgggatctcacttcatctgaggatgagctgccaccctaaattatggcaccaaagatatagttccaaatcttctgttcaggtcctatgactctgaccttgtctacttgtcagggagaataacaatgaagacaggcatatcgagctatctactcaaatcagccagggtttctcttccagcactactgatactttgaatcacaaaattatttgtctgggggggcggatgggcgggtgaggggctatcctgtgtaccgtagaatgttcagcagcatttagcaacattcttctacccactagatgccagtggcaacccccttcctccaattatgacaactcaaaatgtctccacacattgccaagtgtcccctggggagcaaggccatctccaactgagaaccacagaaatagatctttaatatattctgtcaaatttttgaaaagacccttgtctctcagtgatgaaaatgcctgattgactcatagctcaaaccgaatgggaaaggaataactaacaataaaagctacctgaattcccagcactttgggaggccaaggcaggcagatcacgaggtcaggagataaagaccaacctgggtaacacggtgaaaccctgtctctactaaaaatacaagaaaattagccaggtgtggtggcagccgcctgtagtcccagctgctcgggaggctgaggcaggagaatggcatgaacctgggaggcaaagcttgcagtgagccaagattgagccactgcactccagcctgggcgacagagtgagactccgtctcgaaaacaaaacaaaacaaaacaaaaaactacctgaatgtaccaaatagcaattgaagtttgcaaacaatgaccttgagtcatctgcttacagaaggtgtctatctgtcttttggacaaaggacttctgatgaagaggatggagtggaccatattctttaatccatgacgttatttgtccccatcaaatacaaatatctaaatgtatttatatattttcattatcactagtcctcattctcattcccctcactccccagtgggatctatcctactaatatatatccttttgtctgtgtctttgtataatgtgtactattttgaatatatcattctcatttaagtcaatagagttccgcaatcacttactcacaattcttaaacttacacagctctggacaccagaagttttctcttaaattcttaacagcgaaatctgactgaagcgacaaggggttacttggggttctttagccactcaatgtaactattcctatgttttgctgcggaactattatgcttgattatgcgatgccacctcttccttttctaaattccaagcattttgaattccaaaaacaaatctgagcccccccatttttttctttttctttctttcctttttcttttcttttaagtgagacagggtctcactctgttgcccaggttagagtacagtgacacaatcatggctcactatagccttgaccttccgggctcaggtgatcctcccacctcagcctacttggtaggtgggagtacaggcatgtgccaccatgcctgactaatttttgtattttttgtggagatggggaatccctatgttgcccaggctggtctcaaactcctgggttcaagcaatccactttccttggcttcccaaagtgcttggattacaggcatgagccactgtgcccagccccaaagggttttaattgtctacttatacattatagagagagatcttactctgttttcctgtttttactcagtattatatttttaatacatatccatgttactgcatgtacatctagtctattacttctaactgccgtagaatactccatgaagtggatccctacattccactcacccactcccccagtaatgagcagctacattgcctccagttccccatcactacaaacaatgacttaatgaacatcctcatacatgttcctttgtggacctgtatgagaatctccataggatatacacccagggttaacagctgggtcatgggtgtgaatatacttaatctggtcaaggaatgccagaatacccttcaaaacagccatgtcagcctactggcatggtgtgatataatagatcctgtagtcccccattttcccaacacttaccagtatccagtgttctcaacttgtcagtctaagaggtgtaaagagatatctcattctttttttcatttgcattttctgatataactgagcctccaggtatgctcattagtctttggggtttcttctcgttaaattgcttattcatgagctttacgcattttttactagtgtttctgtctttttcttgctgacttacaagagttccttgtttttagacattgaaaatattggttttagacactgaaaaatatcttctctcaatctgtcagctgtctgttcatttggttcatgcatagaggaaatgtgtaaaacagaaatcttcatttttatgtaatccaattgataggtattttgccttatggtttggagctttagaagttttaaaaaagtccttcccacttataagtgacaaagacagtcctctatattttcttctactactgtaacaattttacttttcacatttggtctttaattcacttccaaatggattcacctctgttgttttagattggagtccagttttatttttcatcatacgctgaacattttctctttttaaaaaaattttttgtagggagtttttgctcagactggccttgaactactgacctcaagcaattctcctgccttgacctcccaaagtgctgggattacaggtgtgagccattatgcccagcccattgagtattttctactaaatattgcatgttttcctcattgatcagggaatcatctgtattatcttatacttaatacccaaatatacaaatctatctataatttctctactctgtttcaatggtccatatgcctgatctgttgcaaagatcactactttaatttctatggctttaaattatgtccatatgtgatagggttagtcccccttttcattattcccttagcatttttacttaaggccaggaacagcagctcacgcctgtaatcccagcactttgggaggccaaggtgggtggatcacttgagcccaggagtttgagaccagcctaggcaacaaaactagactccgtctctacaaaatacaaaaataaaaattagctggacatgatggtgttgcctgtggtccaagctactcaggaggctgaagtgggaggatcactttagcccaggaggtcaaggctgcagtgagctgtgactgtgccaccactacactccagcctgggtgatacagtaaaaccatgtctcaaaaaaaatttttttaacttagtcatagattttattacatctgtattttagagtaggcttattattaagtttctgagaaaatttatttgtagcttgtattggaattacattgagcatgtgaattaacgaaaagaggcttaagctttctatatagagaaaccttccacccaagggtatagaattatttaattaaatcacactatattcttgactgaactttaaaatttttctccaaacactattctgtagttatccaagctcatgtaataatcataataactctatactgtaggtacttttattatcatcatttaacagatgaggaaactgagcccagagagataaataactcacctaagaacacacagcaagtaagtagcagaacctggattaacatagtttagtccatactcttagccattatactgcctctgtatctacagtcagttactttatagtttggctgcttctatgcatgtcatcttgtttttattacattttctgatggattgttgcagatacaaagaaaatcggctgattttttttaagttgatatgtgtattgcatgatgttgttaaattctcttcttagttctaatagtctattaattttttttctttttgtatatcaactgtaaaaagtgacagttttaccttttcttttccaatgtttaaagctctcatttctttttctttccttatagcattggccgagacctccacgacaatgctacacactgtgaagtagtgattgtgagctaagactgtcacttatagaaaaatcatgtattcctagaagaaggttttcatttcatcttagctagaggacatggagcacttcaggaaactatttcacaaaaatgtaaattagaaactgtgtctggtagccaataatccatttttaacagtggccctgtgctcatctaagcaacagaaattacttttgtataggagatggcccttccaggggagaaacagctcagttgtgatacacttgtcttcatcctgactttaagtacatttaactccacactaaacccttgtggccacaacacagctctgcacctgtcatttgctctagacaaactgctaaacgcaattgtttctgacaatggattactctgtatcccgtgggggaattctcagacagcagcattagaaggggccttagagatcaaccatttctcttattttacacacacctaaaactccctacagccgtgcttcatcagcttcgagcagatgagccacccagaaggcagctccagttattaggtcctagggcctgggtgtagtcaggccctttggaagctccaagtcagagatcaaacacatcctccccactacccacgcctagggtgactaatgcctgtgggaaaaacaactgaactaaaaagtcccacaggaacctcaaacccagcacatccaaaatggaacttctcaccatctcctccaaactcagtcctcttatacagtaatccctgtaaagctagaacaatctccattccccattctcagggccttcctctcccgctcacctgaggagctaccaagccttggcccacaagccctctgagagtccctcctgcccaccctgtgttctccatactgaataaggacttggccacaccttgtcaactcttccctctgctctactcctgacccctggatccatccttcatgctgtggctgaagggatccccccatcatgcaaattctgccacatctcccgcctaaaacccaggaagactccccactactctcagcacagaaagtacactccttagtatggcatcccctgccctcatggcatggccccatccagccctccagcctcacaccctgcaaggacacctagacccccacctccctcaacccttcatgactgcgcttctgatccctgtttcccctggctagaccctgcgtgccctcccgctggaagcggtctaatgcctgcttgtttttaacactcaggttggggcccctgcctgctcccgggagcctttgctgactcctggaccccgttgctccggctgagcgtgggctctttctctaggtctttcctcccaggactctgtgtattcatcctatcgttaaactggattctctacaagagtaataattgcagagtcagccagctctcatcccttttcaggtttcagaaaagacctgtgaacaaaacgccttgagtctgatttagtgtggcaatgccccaagggtcctgttctccctgggtgtcctgcacctggtgcaacgtcggcctggcatctagtgagccatctaaaggaacgatgatgagtgaatgatttgcctaccccttccagtactaggctggaggtcgtggttagggcccatccctacgcaggacatgcaaagtgggaggcactcctctctctacgtcggcagggggcgctgcacagctgcggggcggggtagcttagacacggggcgtccggctaaggccggggacccagggtggtgggcggggtgtcccgcccgcctgtggaccccgcgcagtaactgcgaacatttcgctttcattttgggccgagctggaggcggcggggccgtcccggaacggctgcggccgggcacccsgggagttaatccgaaagcgccgcaagccccgcgggccggccgcaccgcacgtgtcaccgagaagctgatgtagagagagacacagaaggagacagaaagcaagagaccagagtcccgggaaagtcctgccgcgcctcgggacaattataaaaatgtggycccctgggtcagcctcccagccaccgccctcacctgccgcggccacaggtctgcatccagcggctcgccctgtgtccctgcagtgccggctcagcatgtgtccagcgcgcagtgagtactcagcccgccaggtctttggctcgctcgggtgcggaggggcggctgcttgggaagagtgggtagaaactcaagtctgcctaaggagagactggaacagcagcagccgtctcctgcaaagaggaataagaataggggtctcaccgtgtgctaaatagggcatgtctcttttcatctcgaaacagcctgatgagctatcattatgcccacttcgtagaggagaaactgaggcccagcgtgggagatttcctgctttcctgcctagggtccctcagctacaaacagaaggcagatcctagccagttctaaagtcaggcttggccgggtgcaatggctcacgcctgtaatcccagcactttgggaggccaaggcggacagatctcctgaggtcaggagttcaagaccagcctgaccaacatggtgaaaccccgtctctastaacaaatacacaaattagccgagtgtggtggtgggtgcctgtaatcccatctactcsggagtctaaggcagggaaaattgcttgaactcggaggtggaggttgcagtgagccraaatcgtgccactgcactccagtctgggccacagagtgagactccgtcttaaaaaaacaaaaaaagtcaggctttctcactccactgtttttaaaacactgggtcccaagtctgactcagccacttcaccacctggtctgggtttccctgatcaaaaacatgtaggctttctctgggtgagtgttgggttcaacacccttgtccaagctcatctctagaccctcacagggagctggcttctagccctagaatagagtggygctttgtaataactcgagtcatctctcaggtgttgaaggaaaagtgttggaaatgggttgagggaggtgggtgccaagcatgaatggatgggtgaaggtggccagaatggagggaaggtggtgcaggcaggccatccaggctgaagctcctccacctgctcctcttccttccaggcctcctccttgtggctaccctggtcctcctggaccacctcagtttggccagaaacctccccgtggccactccagacccaggaatgttcccatgccttcaccactcccaaaacctgctgagggccgtcagcaacatgctccagaaggtgagcctttcctgtcstctccactgtggacctgcaccctccctgaggaaggggcctctgatcctcccctctggtacctgatggaactgcagagaaattgtggaagttcattagcagctgtcaacagcaggagagggaactttacaaatggcccaagtgttaaagagtcctagtgaaattgtgtctccagagaaagcaagagtagtaataaattataatgatgttggttttggctatgtctacactgagtaaagtggatatttgcagtgttcctgtagcctgccaacagagatagaattgtgtcaggtccacatggtttctctggcaccacaccactgatcaatcccggaaatagttacttgggtgcatactctgtgttggggggcaggggtacaaagatgaaatagccttgtccctcctgctgcccaccagcttctacttggtgacacagttccttcttggagcaacacatctcagggaggactatgacagtgcacatgcagccttcattttctagggaagagttacctaattttatttacagcttcgttcttttaggtttcatattttaatgtaaaaaacattgccgttaaaaactgctccagtagctactgctgcaaaggctaaaggctaatgttttaaaagatgtcctctgcctttctgctctctaggaattttttcttgagtattttctagcttgttgccttaggaatatcttaaaataarctcaatgccaccaagccttcttaaagggctcctttcccctttcaatctttcataatgtgctgtgcattgctcctcacaattcaattaatcttaattggacagggggctcaagtgaaaactgctttgtttcccgaagaaaggttcaaaatgggtaacttttaggtgcyccaattcatatagatttttttgtgcaaaagctgacacccctactcccagatatagtcctaagggtcaaaagattatagaaatcaatttaatgttttgtacatcatttgtcaaatttgctgtagtagaaaacaaatgaggtagatgcaagtgattcaccggccatatccagggcacaggtttgtagaatttgggctatatgtttattttttagtttgatgccattcaaaaaccaaacatttcaattaagatttcaaaattctagcttctcttgaaaagatctgaagaacaacactggactcacacctccaaatctaactctttataacctgctcagaatagtggggttgcccaggtctgtttaaacacctccgggaatagtgtattcatttcctactgctgctgtcacaaatgtagtgggtttaaatgacacaaatttattatcttacagctctgggcatcagaagtccaaaatgggtcctactgggctaaagtcaatgtgtcagcagagctgtagccctttctggaggctcttggggagaatctgttgccttgctttgtcaggtctagaggctgcccacattccttgacttgtggccccttccattgtccataccagcaatgtctggttgagtctttctcatgctgctccctctggacygaccttctaccygcttctacttttgaggwcactgcttacactggattcacccagataatccaggatcatctctctactcttagatcagctgattagcaaattgaatgtcatctgcaccttcattcctctttggcaggtcacatagctcattaccgggttccagggattgggagrtggatgtctttggaggtggagaattggtctagctaccacagaaagggattttactacttgtgcccaaacgtattctgaattttcaggccttgcttcttggctcatgctgttacctctgtctgaaatttccctcctccattgtcgacactttactcctcttaatgtgggtgtcccawctctaggaagctttgcttcccttcctgcccctcctcagaagcttcatgcccttctcaccatgtctcacctactgatgcctcctggtcatttgggcamttgtctgtctcagcagctaaacttgcaatccaggagggtatacatggtcctcttctctgtcatgttcttagtacctaatggagtgcctgccacccattaggctgttgaatggaaaaatgatcgtaatcttcaatcatacagtcctttacttcctaagatacatttcataattttacccaacggtgctttccaacacactaagatgacatctctgtgtatgtgtgtgygtstgtgcactgcaaattaaatctcagcttgtcttaagggtttgcatgtttgttatatccatcaractgtgaccttaacagttccccctttagaagttatacttgaaataggtattcatagaatacagtcactttagcaaaagaagaaacaattttcaccagaagcaagtgtcacagtgaggtgtrgaggctggttagcacaggctgttgacatgatttattgtgtttacataatgaaaaaatatgtaatccagagaaacatgccccaagcttagggagaggagggtgagagacagaatgtaaggaatctattttcttttgtattatgaagaaccagaatttcctgcaagtcaaagtgacagaggtcaagggcagccagccggagccttcctggcaccctggcttaccagccttgtggggtgccaggtgcattatcaatgttataaactgagtttctccttcattttttataggccagacaaactctagaattttacccttgcacttctgaagagattgatcatgaagatatcacaaaagataaaaccagcacagtggaggcctgtttaccattggaattaaccaaggtataaaggattttcctcccagagcatgcagtgtggttaaaaactgtgcatcaaatctcacctgcttctaraaattcacrtttctggtatccatcattatgggattttaactggtcctacttcagaagttagatttgggagaaaaattatttttaaaaaatggttttttttgcaacaatgtgaatacacttaacacttaaaaatagttcagatgctaaatattatgatatgtgtttttaccataataaaaaaaatttgagacctgaagagtcagaaagatttatactaagaattaatactttgatatatgattttttccctctagaatgagagttgcctaaattccagagagacctctttcataactgtaagtcaaaaaatgaaaagtttcagcctgtatgatgaattcatatcactgatgtctgattattttttcctctagaatgggagttgcctggcctccagaaagacctcttttatgatggtaagacacacagctctttcctcaaatgcaatgggggaaatgtttttagcccatctcaatggatacttccccatcttgtcatgtcacccaggccctgtgccttagtagtatttatgaagacttgaagatgtaccaggtggagttcaagaccatgaatgcaaagcttctgatggatcctaagaggcagatctttctrgatcaaaacatgctggcagttattgatgagctgatgcaggtaagacttcattctatcagtgagagcacctttttcatgctaaagataaccagccagggtctttgataaagagatayaaaaagaggtctggaggccttttaaaggcctgacagacctacattttcaagaagacagccttgagggtgccgtctatagggagcacaaatgtgagcagatcacattatgaaaagcagactccaaagtattcactctgtggtatcccccacactcggcaaatgtttttgtgcattttcttatgtcagcctcaaarcaaccatatgggatctgcacaaaggagggaaccaaaccttaggagagttaaaccacttgtctgaggctctgcctcttaaaatccttcaagaggatttcactacacttaccttctcactcacctctaaaggctccaggacgtgctccaggatktgcmtgcaaggggccagtttgcatatctgcaaatattgctgggaaacaagcaagattggtgcctgattatgacccattgtgaaccaaaatgtgaaccaaataaaagaatgacctatcatctggggcatctataatgttattcataggcaagaacttgctttgttatgttctgaatyaccataacacagatgctaatataaaacaaatatttatataagygagggtgactgctttggtgacgaggacatgggataaaaatatggtggcagaaatcattgtctgaaaagtaattgttttacttttattcttttcgtgtgtktgtgtgtgtgtgtgtgtgtgtgtgtgtgtgtgtgtgcatgtgccagatttcttgtttgaaaggcaatgagcttcatccaagtatcaaagaatgttagcatctagagagctgtagttgctatttcatttttaggaccaagagttgggtgatttgggtgctagaatcaattctaccagtaaccagacaactattcccaagtcacttaamccctctgtgcctcagtttcctccagtataaaatggggtgactttattctagctttcttttagactttttgtgaggaagatatgaaagtatttattcatcaagggtgcaaatgtaaggttttatattctgttatcaaatcaaagtgctaaacttgggaaattcattgccaggtttatctgacacaaatggcatgtcttcagtaaacaggcctgttactgatagtgagttctgatcaatagcaatccatcacctccctgtgctaaacagaagtgggctttttaatgtaacatatataaaattaattagatattgcagcagatgtcattttaaaggaactgtttctttctaagacacaactcccactgatgattttttctaaatagttttaagggtcttttcagagctcattgaagatgsatgtgcttggaaaatgagtatttcttttctcattctgcctggtgatctggctgagagtagatttggattgggtttaggagtggcataagggacygagttgcaggctctgagacatgtactggcttcactcatttttatgaatgaatatttgaattttggaataccatgtaagtcatgcttactgttcattctcctaggccctgaatttcaacagtgagactrtgccacaaaaatcctcccttgaagaaccggatttttataaaactaaaatcaagctctgcatacttcttcatgctttcagaattcgggcagtgactattgayagagtgaygagctatctgaatgcttcctaaaaagcgaggtccctccaaaccgttgtcatttttataaaactttgaaatgaggaaactttgataggatgtggattaagaactagggaggggraaagaaggatgggacyattacatccacatratacctctgatcaagtatttttgacatttactgtggataaattgtttttaagttttcatgaatgaattgctaagaagggaaaatatccatcctgaaggtgtttttcattcactttaatagaagggcaaatatttataagctatttctgtaccaaagtgtttgtggaaacaaacatgtaagcataacttattttaaaatatttatttatataacttggtaatcatgaaagcatctgagctaacttatatttatttatgttatatttattaaattatttatcaagtgtatttgaaaaatatttttaagtgttctaaaaataaaagtattgaattaaagtgattctgcaatttttctaatgtacttttaagtgttaaaatatacattgtgggaaaattgaaaactctgatgagacttcaacaaaattactctggaaagaatgccacaatattcttattcctttcctagtccctttcatctcattttaaagggaccctagtaagacaagatatgctttactactaaggcagccaagtgagtcatggtttttgagggtttattatttttgttcaacataagactaaaagtatgctgtgcattagaaaaatacttcatagtattcttcaaccagaaaaaaaatgtcactaagaggccttctagcctaattattctaatttttgtgaccctttgggctctgagagaaaagttgtctctaatttgcaaccagaaaatctctccatttgtttaaaactgtatagaacttttgcctgaaccacatggataattgccttactttggcttaagagatgtgctcttaatgagctaaatgttaaattccatctttttaattctctaaaccaggagtccccgatccccaggccatggagtggtactggtctgtggcctgttgggcagtgggccccacagcagtaggtgagtggcaggtgagcaagtattaccacctgagctccgcctcctgtcagatcagtggcagcattagattctcataggagtgtgaaccctattgtgaactacacatgcaagggatctaggctgcatgctccttataagaatctaagtaatgcctgataatacgaggtggaacagtttcatcccgaaactatctttgccccctgccccccgggtctgtggaaaaattgtcttccacaaaaccagcccctgctgcccaaaaggttgcggaccactgctgtaaatcatgtaaatcttaggtttcatgacttagttcattttgtactgctgtaacagaatatctgagactgggccatttgtaaagaacagtgatttatttttttactgctctggaggttgggaagttcgagaacaaggggccaacatctgatgatggcctttgtgccccatcatcatatggcggaaggtgagagagagagcaagggggtgctgaacgtgtccctttataaggaatccactcccatgataacagcattaatccattcatgagggcagagtcctcattgcctaatcacctcgtaaaggtcccacatctttatactgttacaatggcaattaaacctcaacgtgaggctgggtgcagtggctcactcctctaatcccagcactttgggaggccgaggtgggtggatcacctgatgtcgggagtttgagaccagcctagccaacatagtgaaaccccatctctattaaaaatacaaaaattagccaggtgtggtgacgaacatctgtaatcccagctactcgggaggctgaggcaggagaatctcttgaacccgggaggcagagcttgtagtgagccaagatcgcaccactgcactccagcctgggcaacagagcgagactccgtctcaaaaaaaaaaaaaaaaattcaatgtgagtttgggagggggacacaccacattcaaaccatagcaattcacctgacacaatacaatttaatgttaaggctttgataatccattcctccttaatagaaaaaggacctaaaatacaaaatattttgagtgacccctttcctcagttactcctcccaactgaatcccaatctttctccctgtaaatgtgttatctccttcccaggtcctcctgcatggcaaacattctcgtttttcaaattcttgccctattagacattcaataaaatagaaaccatcagaagctagatcccatcacctatctccttctcttgagtgattcttccacaatcttgaatggtccacaagtgcttcacagacatgggtttctttcaagtgtcgagtctggggtctcagcagctttgacagtgaggagagacgaacggggctgtagagttgcagccacccctcacttggaatggtgactactggttgtctgggcccagagatcaggagggacaagcagacggtctcttccatggactgggtttacacacaagaacacgtgtgtttcttctgttctagaaattagcatgggatatgcttcaaaaacatgactggccacagaaacagcttcatggttcattccattctttattgcatggttagtttttcactttttttaagcctgtgtctgcagtttacaagtagtgtagtatgcttgcaaccaaatcattccaatgctccccattggtctcctcttctgaaaaaggaaggtaatactagaatctacctmaaaggatcagagaaagggtaaaatggaacaactcgtgcaaagggctagcgttgcacctggcacatagtaagtgcacaataaatgtaagcacattttgaaatgtattattagtctttgggctaagcacctgcaccraatttkttacctcctctttgctgctatttcctcattgatgaaattcagaaaacggtgggacctaattaactgtgttattgtgaagattaaatgacacaatacagtgccagcacctagttattactcaacataaatttgtcacagttctcacaagacatcagaacacccgctgatgtgctgtcccccatggcactcagcatattaagtgtggtcggcacaagcggctgcctggtgtgaagtatgagggcaaaaggcagggtctctgccttccaagaacaaagggtggagagcaaagtaacttttttttttttttgagacggagtttcacttgtcacccaagctagagtgcagtggcgcgattcggctcactgcaacctccaccctccaggttcaagcgattctcctgcctccgcctcctgagtagctgggattacacgtgtccaccaccatacctagataatttttgtatttttagagacagggtttcaccatgctggctaagctggtctcaaactcctagcctcaggtgatccacccacctcggcctctcaaagtgctgggattgcaggcatgagccactgagccaggccaggagcaaagtaacttatcaaaaccaaggaccatccccctaaaaataccccccagtcaattggagattcgtttgattaacaaactactttattcaaaagaaactaaaccttgaaagtgtatctcacacctaagaatgactaaatcagagaattaacatgaaaaatatttagttgtcagctgccccattaaaggtccaggactttgggaagacagaacagttctaggacatggtctggccagacatccaaaggtaagtattgaaaaactcaagagatgtaaaagacccttagacacccaaaggaggataagaaactacagacaaaaagaaaagaacaccagctttgttgggggccagcacccacagccatcataagtcctcttctctgtgtcacactgggccattcagttattatccttatttgaggactaaacattttgggccgggcgcggtggctcacacctgtaatcctagcactttgggaggccaaagcgggcggatcacaaggtcaagagatcaagactatcctggccaacatagtgaaaccctgtctctactaaaaatacaaaaattagttgggcatggtggtgtgtgcctgtagtcccagctactcaggaggctgaggcaggagaattgcttgaacccaggaggcggaggttgcagtgagccgatatcgcaccactgcactccagcctggcaacagagcgagattccatctaaaaaaaaaaattaaaaattaaaaaatacttttggttctggctagcataatttggcttcctagtttaaagcaaactgcattacaatatgataagtaagaaaaaaatatggccgcattgtccaaaaattgaattctatgtacttgaaatattttatttaaaaaagtgaaataggatgcgtataaatgttttgaaatatatgtggtgagaacaggcacaaaaactttagttatatttatgtatctttcaattttacattaaaaatatgagtatgaattagatctatgtaatatcaaaaacagtatattaatggaatctgttttagacaaaaaaaaagtagtagcaactgctcagttgtgcttcctaaatgccaggcatgttcctaagagtttaccacaaataaacataaccatcctaataaccctttttatggatgtggaaagtgaagaaaattattgaagttgaccaggtgcggtgactcatgcctgtaatcccagcattttggaaggccgagatgaaggattgcttgagcccaggagttcaagaccagcctgggcaacatggcaaaatccccatctctacaaaaaataaaaataataaataataagattatgtaagctcacataattaacattttaagtggcctggtctcagcctgtgccagcagctatgctcatgttgaagtcactgtctaagtcaagggaatgctttccctataaccatataaatatcatcccaattatttatgtatctcccttctctctcttgctaaactgtgggaacctcagatataggcaatgtagtattacccacgtatttgtgttcccagccccaggaacttaaaaatgatacagaaacaaagggaatcttcatgagcccccacaattctcatgtcttttcctaatctagatagaaataaagaagtctcagccaggtgtggtggctcatgcctgtaatcccagcactttggggggccgaggtgggcggaccacctgaggtcaggagttcgagaccagcctggccaacatggtgaaaccctgtctctactaaaactacaaaaattagccaggtgtggtggtgtgcgcctgtagtcccagctactcagcaggctgaggcagggaattgcttgaacccaggaggcagaggttgcagtgagctgagatcgtgccactgcactccagcctgggtgacagagcaagactccgtctcaaaaaatacataaataaaaataaaatttaaaaaataagtctctagtctttgaaagaaacttattcacaattataaaaataaagagttaaaaaattgaaaatgcatatgcttacttagttcaaaataattatacatgttcataatggggaaaaatccaaattcataaacgttttgatttagttaacataatttaaatacctgtggtctgagtatatgtctatgcttcagaaacaacgtgccaataaatattccacacctaggggtgggaaagtgttttacttcccattaggttgcagatgtcttagaaacacattcctgcaccacagcttcaagaaatccaaataatgacctgatctgctggtttccaagctaccctaccaggagcaagtcagaggccctgcagggctcctcggtaagccctcgaaatccctctcccctcaatgaccccaccacagcagctccacttttgaatattttaccagtgcgtgttccaggtaagatttcctttcacaaaaggttttcgtgggtaaggaaaaatgaaaacttgctgaattactctaagcccctctctccagttgtttttataatggaaccacctgttgatttccaggcttgctcgaaaagaaaacactgctataaatgcatagagcgtcttcccttctgaaaaggaaacttgtgctagaggttacagaaaacagcaagaatgggattgcaaagaataaaggtggctgactaactctagacttcctaactgaggacttacatcaggaccagaacaaattaggtctaaatctacagtgggctccagggtggaaatggaggtctcacttaagaagcaggagaaatctcaaaactcagagcctagaatttaaccccagggcctccgtgttagcatcagcggctgcagagccaggatcaggacttctcaaatcctgacatatagacagggaggctgagaacacctgtcaaccaaaaacacatgattccagcagtgaatccctgggatcaagctcttcagcaagcagtgtgctggttcaccctaagaagg

SEQ ID NO: 17577 - DNA, 30553 bp, Homo sapiens
  misc_feature (1)...(30553): n = A,T,C or G, or insertion/deletion polymorphism (see Tables 1-2)
tggttttttttttttttttttttttttttgtagagacaaggtttcaccatgttttccaggctggtctccaactcctgggctcaagtgatccacccgcttcggcctcccaatgtgctgggattacaggcgtgagccaccatgtgcagcctcaaaagctgtcttcatcctctggatctaatagctaagttctaagtacaatcttgctacacgggccgcaggataagagaccgggcagctggcaggatggcacttcttccctcccctgcctcactttctcacccacccaccttatttcctgcagcttcaaacaaactccttgcatgtgaatcctcgttttagctacttcttctgaaggaatccaatctaaggcatcctgctaattgtgacactcacacttaaattatcaaatcgtaaagttaatcaatagttttacccttttcctgaacaatacaaggacccgagaagtatttaactctgtttactccagtcccaacttaaattttattattatgcattttaatattctttatttttccttttttttttttctggttttttagacagagtctcactgtcacgcaggctggagtgcagtggcatgatcttggctcactgcagcctcgacctcccgggctcaagcaatcctcctgcctcagcctcccaaagcactgggattataggtgtgagccactgtgcctggctattatttttcttttcaagacccataggaattgttattgttgctttaagccattgatgtttactagatttacccaaatgttacctctttctatatccttcattccttcttccttgtcagatcaccctgtgataccaattccttacaccttttaaatgtttctttaatgagaatcttccgtagtaaactcagtttgtccgaaaatgtcttcattttgtcctggttcctgaaagatatttttacaggatacagaattctgggtcattagtttccattatcacctcgaaggtctcgtccattgtcctcctctggctttccttgtcgctagaaaacatcatctctcagtcactcccttgaaggtcattttccatgcatctccagctgcattyaggacgcttttgtctttggtgttctgaagtttcaatgtggtctatctaggtgtgggtttattttgtatttttttctgcatgaggttctcaattatataaatttatatgaatttctcaattatgtgactttcattagtttagaaatttcatagccattatctcttcaaatatttcctctgctccattccatctcttctccttctggcactctaattaggctcatgttggattttcctattctagcctttatgtctcttaaccctttttccaggttttccaaatctatgtctttccaggcagcattctgtatactgtattcatatttatcttttagctcatgaagtctcgctttggttatttataatcttctgttaaacatgcatactaagtttttaatttagttgaaattaaaattcaactaaaatttgaactaaattaaaactttccttttagaacttccatttggttcttttcaaactgcttgactattctttatagttttgtgggttttgcacacattttctttctttttcttttctttagagacagggtctcactgtgttgcacaggctggagtgcagcggcatgatcacggctcactgtagcctcaacctcccatgctcacgtgattctctcacctcccaagcacctgggactacaggtgcataccaccgtttctggctaattttttatttttttgtagagacagggtctcactatttgcctaggctggtcttgaatgcctgggctcaagaattcttcagccttggcttcccaaagtgctgggattataggcatgagccaccatgcccagccttaagacatatgcagatgtaaaacataacaacaccaatacagaggatgggaggagaaatgaaaacatactgctgtaaggaggctcttacattatatgtagatgccataacatcatgtgagggtagactatgacaagttaaaaatgtatattataaatcctagagaaaacattttaaaaactacaacaagacacaattaataagctaagagtggtaataaaacagaatacgaaaacatacttgatcaatccatcagaaagcagaaaagaagtggaaatggaacaaaggtaagatgggacaaataaatagcaagatggtagatttaaacccaataatatcaatgattacattaaatagaaatgatctaaactcagattgaaaggcagagattatcagaatgtatttaaaaagtgagacacaaactataagctacctcaagaaatgaaatgttaaatataaacaccaagataggctaaaagtaatagactggaaagaaagaaaaataaaggagccaggtgtggtggctcatgcctgtaatcccagcagggaagccagggtgggaggatagcatgagcccaagagttcgagaccagccagggcaacacagtgggaccccatctacacacacacacacaaacacacacgctagccaggtggtggcacacacctgtagtcccagctactcaggaggctgaaggatcgcttgagcccaggaggtcaaggctgcagtaagctgtgatagtgtcactggactccagcctgggcaacagagtgagactctgtcagaaagaaagaaaagaaagaaaaagagagagaggaagaggaagaggaagagggagggacaaagaaagaaagaaagaaggaaaagaaagaaagaaagaaagaaagaaagaaagaaagaaagaaagaaagaaggaaaagaaagaaagaaagaaagaaggaaaagaaagaaagaaagaaagaaggaaaagaaagaaaagaaagaaagrgaaaagtgaattagaaggaaagatcagaatcaatggaataaaaaatatatacacagttgagggtaatcaatgaaaccaaaagctggttctttaaaaaactcagtaagattgataaacctctagctagactaaccaagaaaaaagaagacataaataaccttatcaggaatgaaagcaaaaatatcattatagattcagcagatattaaaagaattataaaactatgaacaactttatgccaataaacttgaaaatgtaaattaaatgaacaaatttcttgaaagacacaaattaccaaagctggaacaaaaagaaaaagaaaaatctgaatggcctcataattactaaagacattgaattaccaattaaaaacctttccacaaagaaaactccagatccagattgccttactggtgaattctagcaaacatttaaggaagaaataatactaatcctacataaacatttcaggaaacaggaggcagaaaccttcccaactcatgttatgaagctagaatgtcactactgaaaatgtggagaaatcgtatcaccaaagaaactacaatctagtttgtcaaaccctctgacaattcagctcctaaagtaatccctacaaaagccaggaggcatttgatcccatagaagaaactacgcagcctccaagaaggttcctctccagtgtcctcctagatgtggacacgaagtctaacagacaaggagaaacattccagaaaactgagccggcgctgccaggaaaggggacttcactatttatgctcaataggatttggcaagtgccacagactagagatcgggtctaaatatggggtctttgtagtatttacccaattcttactcttttgttttgttttgttttgttttgttgagacggagtttcactctttttgcccaggctggagtgcaatggcgcgatctcagctcactgaaacctccgcccgctgggttcaagcgattctcctgcctcagcctcccgagtagctgggattacaggcatgcgccaccacgctggctaattttgtatttttagtagagacgaggtttctccatgtgggccaggctggtgtctaactcccaacctcaggtgatccgcccacctcagcctcccaaagtgcagggattataggcatgagccactgcgcccggcccttaatctttctttgtatgtttgggacacataaaatatgttttagtttatacgacattggattaaactagtgtacactgagtttgttggaggatgaatgacaaaccttttataagtcactggaccacaaggatctacctctggacctgaaggagcaaattgcatataagtcagagaacctaaattttgagctggatgctgcaactagttagaacttttacagtggtctcccttaaggataaggtgagtgagttttgtatacaggaagtagagagggcatggccaaaggggcagatggtgccctaatatcaattttccagttttcccataattttagaatccctagccagcacctacacctggcctttatccattcacctgccgacgcacactcaggttgcttcctaacttggctattgtgaataatgctgcaatgaataagctggtactgatatcctccaagatattgatttcatttcctctggatatacatccagaagtgggattgctggattgcatggtagttctgttttaattttttactgtattccataatggttgtaccaatctaccttttcaccaacagtatacaagggttctcttttctccacatcctcgccaatatttgttatctcttgcctttgttttttttttttatatagtagccaaactaagaggtgtgaggtggatcgcgttgttgtcatatctcgttgtggtgtttgcatctccctgattagtgatgttgggcccctttcatatacctgttggtcatttgcatgtcttctttggagaaatgtctattcaggtcctttacacattttaaattgggttatttggtgttttgctattgagttttgtaagttccttatacattttggatattaactccttatcagatacatgatttgcaaatactttctcccgttccatgggttgttgatcgtacccctttactatcttgaaaagaaatttataacctatttttttaaattacacaatggtctaatgaagggatagagagaggagagtggcagccaggtcatgtcacatacatcacaaatccactccacattctcatcttcccatcaatgtaaaccaccaaggagtccaggcttcattcagccacccaggcacggtcataactactcccaggccttgagccaaaatacggaatcaaagattctctttgaagtgcactcatgttgataaatttgcactaacctacaattcattcttggctttgtatcctcacagtccattcctgtatgtattcccctcgccttttttttttttttttttttttttttttgagatggagtttagctctgttgctcaggctggagtgcagtggcacaatctcggcacaggctcagggggccgccatggtgtcagagaaggcctggagcaggaagtgcaaagacacacagcagagatgcagctctgtgtccactgcagttaaaggtgggctgagggcatcagccaagacaccatctcctgcccctctcagatctagtcagctacaatattgagtctactctgtcacgattcttcaaagtaaaggctagttacaactcctatgaaagccttaatacaagaggcttagcagaacaaatacaatccccactgccacagcttctcccaagtaacagatattcagcagccacctcctccttggcctcaccctcaccagcattccagcttgtctccatggcttgcctggtgacgctgcccagaccttcaccctgaggcatctgagcccttaggggctatggctgctgaaaagaccttttcattgtcattacttggcatggaagcaccaagacagacctagatgaatcctctaagtgccagatcaatgcctgcttgccccgttacgcagcagccacgctacctcctcaccgtttatcaggatcaagtatcccctcctttgtggcctgctggtccaccagtatgaggagctgagagtaacytggtggtctttgcagattcaggctcagcagaggtatccttcctgcaaccagcaggagtgccctcgtggaagcgttcctacctgggaaacaggctctaatccagcagatcctaaggctgtggagacagaatgtacaaattctacgtgtaagcactgggaatgatggtgagaagtagctaatcccaacccttgggttcctggacctgtgtctttctkcttsgatccacatgaagtatctactgggggcagagcaccatatattagactctgattcagtgtatatatcccaactcctcaggatactgtcctagaaccaggacctcagctaagcccttaagaagtcatcccatctttccagtagcctagctgcttttacgtaacgcaggatattagagaagcagtggatcccatggtcatccacacactaccatacctctttcgctataaaatggctttcttggcctgaggcgatgtgattcgtgatcccatgttggtacacggagcatgcctgaagctcctggatagtgatgctggcctgggaccctgtggatacagaagacaaacccttatccagagcaggtgtcaactccagcaaggatgaagggctgtcaccaacttgccactaagtaactagttggggtgctctagggatggtatctcagcaggggctcagcactgatcgctttcagcaggagtaatcatgagacaagccttgagaaagaaggcctgtgctggtggacrctaacctgtgctccttctgcatgacgccgccactcacagtccactgttcaagcacaggggtagccaggggcacagctgactgacatcccatccatcctgctgttcaccaactcctctgcagtattaacacaaggcagagagatgcacatattgtgtggccactcctgtaggtccatcttcccctcttgctcttttcaggtccctgaccagccagcaggacgtcacaacccagaagtycatatgcgtccctccctcaggccactactctgtccactgcctccatacaaagtggatatccacacgaactgctggaagctcagccccatggaggatttcctattgtcgtcctttagggtcaccttgaatgggactgtagtgtacctatggttcattttcagttcatatcaacacatcaaactgacctatatacgaaccagaccagaatgcttrtctgctaagggagaaatatcagtgcaaagcagatgtggggccacactgccacctcttcctgtaaataactgttacccactagacacgcttgggtccaagcccaaggctwcctttttcattgtaccatcaattgctactgagcctctgacctactgacttggaggatctgacaacacctcgcttgggcagaccctgtcgcatggtcgctgatgtcccaccagcaggtgctcggtctctacctgggtctggtagtgtgcctgatactgctctcacttggcgagtagttctctgctgcagaaggcatggtcttgtccargaactctaggacagtgtactgcaactcttccgttggagtttgccagagatgccatatagggtccttcctaccccaaataagccccccggtaacccattggatctatgcagcagggaagcccatctcccaatccaaatctttagcagagccctctttttctctgggccccactcaaagctggcagttttcccgttacccaataaaggggtcagagaggtatcctctagcgcggtgcatgctgactccaaaacacagaggtgcctcaaygctgtgcctctttcttccttgtaaggatgcaggatgcaataacttgtccctggcttgccctcaaacgctgcacccctgagaatgtcactgatatggcaggctccagaacttctgagggcttctcgctcatcctctgacatgcacggccttcttcaccatgtccaactagtatgacatcatcaatgttatatggaatatagatgataagctacctaaggactattgtgacagagaacaggagagttcagacagcaagaagcaagaccatttacagagctgtccttcccatataaatgtgaactgcttttaatcctctttaccactggcaattgaaaagaatgttcaccaagtcaataattgcattatcaagagccagaggtgcatttatyggttccagtaaagataccacacctagcacagctgtgtgatcggggacacgacttggctaagtttgtgcagggcatcatcatttacttgaatccaccaagatttagcaggagccattcaggttaattgaagggatgaaacggtaaccactgctttataagtctttgagggcgaaatacctctgcaattacacctggaatgcagcattgtttctgacttactatcttggraaggtttcagtagggtgaggagtttcaaaggtttctactttgcgcttccttacatatggtaccaaaggcctgggatcaatgtatacgctccgccctctgctaggtaaaaacatcccaagtatgcattgagaccagagaagtaaccacaggactcgggttgggaattctgcttatcatctgatttccataagcctgcaccctaatgagagggccatgatgcttcagggctcctggaaacagtgtcagctcagatcctgtatcagcccttcaaagacctagacagtcccttttccgaagtaaactagtttttttggtgtgtttgttgttgctgttcagacagtcttgctgtgttgctcaggctggagtgcagtggcgtgaacacaggtcactgcagccttgacctcctgggcttaagtgattctctcacctcagcatccagagtagctggaaccacaggcacctgccaccacgcccagctaatcttttaatttttgtaaagacaggttcttgctatgttgcccaggctggtctcaaactcctgggctcaaacgatcctcctacttcggcttcccaaagtgcagggattaaaagcgtgacccactgcccccagccagaatcagttttcttttttttttttttttttttgagactgagtctgactctgtcgctcaggctggagtgcagtggctcgcggcaacaaggcctgggttcaagggattgtcaygcctcagcctcccgtgtagctgggattacaggcacaagccaccaaacccggctaatttttgtatttttagtagcgacggggtttcgctatgttggccagggtggtctcaaactcctgacctcaagtgatctgcccgcctcggcctcccaaaatgctgggagtacaggcgtgagccaccacrcccggaccagttactttttaaagtggctctaggtccctttagggaaggattggaggaatatttcttggtatatgctcagatgctggtattgtaagatccttcctgagaggaaccaagcctccttgtcaattaatgggctctaggtctcaaaactgactcagatttaaacagaatgatcatgattttccactgcagcaaaagtgacattagccttgtgatcaccaatttttgatttctttctggttatcaaacaatactctagtcagatgccccaaagaacaccatggttcgacagacattgccacagatctctgtgggtccagcgttcctggtcgccgctctagcctggggcagaagcagaaatgcaggaggcacgcgtttaaatcaggacgccctcaatgkgaggtgcgcaggccgaggagggggctgcggcaagctgcgagtcttcactttcttcggctcttgggtttgactctgtaattggttctaggcctggaggagacgaggaggatagggggagaggggaatgaatgaagacgcgcatctcaagcggggcagcaaaagactcctcattcagaggtgcggctctaccggccagggagtccccgtgtagactgggcatttatgcaactggagtcatcggaactgtcccaagggtcacattccttcagcaaatgtttactgcgtacccaccgggtgcccgcatcccgcactctgcccgcgctgtgcggccctgcctagcgcgcgcgcctcctccaggcctcacccacgctcaggacggacgcgcgctggacggctcttccttgtcggagcgccccaggggtcggggaagagggcccggcaagggagccctcgcgccggagctgcagctgcagccgccgccccgccgccccgccggctcccacggggcagagacgcarctcctctccggtcttcccgkacgctaccgcgcccgggcagttcctcgcccgcgcacgcgccgctccgccaactgattggcctccggcgcctcggattggcccaggccgtccaacagcagccccgcccagagagagaccattggtccttgcccataggggcggggcccggcagagatctgcggaattcggccttcggaaagagcccccgggccggggcacggagagagccgagcgccgcagccgtgagccgaatagagccggagagacccgagtatgaccggagaagcccaggccggccggaagaggagccgagcgcggccggaaggaaccgagcccgtccgaagggagcggagcgcagcctggcctggggcccggtcgagcccgcgccatggcggccgaggcgacagctgtggccggaagcggggctgttggcggctgcctggccaaagacggcttgcagcagtctaagtgcccggacactaccccaaaacggcggcgcgcctcgtcgctgtcgcgtgacgccgagcgccgagcctaccaatggtgccgggagtacttgggcggggcctggcgccgagtgcagcccgaggagctgagggtttaccccgtgaggtgggaggtcaggggtcagcctctccggtgcgcggatcggggtcaggggtcagccgcggggccctcaggatgctccatgttttcgcccccctcttgcgcccgcgcctggggcggggcggggccggcctggccgggagggggccggggccgcggcaggtagggccggccgcgggctgagcgcgcctggtgtgggtctgcagcggaggcctcagcaacctgctcttccgctgctcgctcccggaccacctgcccagcgttggcgaggagccccgggaggtgcttctgcggctgtacggagccatcttgcaggtgagggggktgtgagcgccgcagcaccagtggctttagggcctgtcgcttacgcgatgcgggtagtattgttcccgttgcgcagttgaggacaccgaggttcacggtctgagtaacacctcattacaccgaagcctgggcctgtattcccagagctttgggaggctgaggcgagaggatcacttgagcacaggagttcgagaccagcctggacaacatagtgagacccccatctctaaataaaaatagaccaacgctaaagcctgtgctccagagcctccaggcaattggatcagaagtcgcagctctggtgggaggaaggcgagccctcatgtgtgtccctgtgccactttgccttggcccctttgctgtccatcctttttcagggcgtggactccctggtgctagaaagcgtgatgttcgccatacttgcggagcggtcgctggggccccagctgtacggagtcttcccagagggccggctggaacagtacatcccagtacgggcccagtcctaccctctcctccccaaggcacctccaccccctaaccctaccccagtgcccaatgtctgcctccacatccctcaccccaagtagggaatttccsccaaaaccctgacttcccctcattgccccagcccttcccactcctgccccagccccatcaccaccctgatagcttcctgggtgcagagtcggccattgaaaactcaagagcttcgagagccagtgttgtcagcagccattgccacgaagatggcgcaatttcatggcatggagatgcctttcaccaaggagccccactggctgtttgggaccatggagcggtgagtcaggagcctcctcagggctcctgtactcctgagctgaacctccatgccagcggatgtgtcgggggctctatccagccctccacttgagtggatctgatgtcatgggctgtcacagaacaggcttttaaatgcttgccagaggccacatgcagtgcctcatgcctgtaatcccagaactttgggagccgaggtgggtgaggtgggaggatcacttgagcccaggaggcggaggttgcagtgagctgagctcatgccattgcacttcagcctgggtgagagcaagactctgtctcaaaacaccaaacaaaaaaagaaaaaagaaatgattgccaaggccaggcacggtggctcatgcctgtaatcctagcacttcgggaggctgaggtgagcagattgcctgagctcaggagttcaaaaccagcctggacaacacagtgaaaccctgtctctattaaaatacaaaaaaattagccaggcatggcagcatgcacctgtagtcccagctactcgggaggctgaggcaggagaattgcttgaacccgggaggcagaggttgcagtgagccaagatcgcgccactgcactccagcctgggtgacagagcaagactccatttcaaaagaaaaaaagaaatgattgccggacaagtcacacagtgataggagcaggggtgcagtagtctggcctgaggggtagataggmgaggggtgggaaagaatagcagagccagkgtatcctattctttgggcttcaggtacctaaaacagatccaggacctgcccccaactggcctccctgagatgaacctgctggagatgtacagcctgaaggatgagatgggcaacctcaggtgagggcaggcaggacaaggctaatggtaatggtgtccgcccttccagtakttgctgagggctggtgtcagggcctggcctrttagggtggctctgatcctcctctagtcactcctgctcaggacccatgctcccatacccctgtaggaagttactagagtctaccccatcgccagtcgtcttctgccacaatgacatccaggaaggtaggagaaggcatctgagtctcctaacccaagatggaagagccagagggctctggagtgagcagaacctcaccccattcccccagggamcatcttgctgctctcagagccagaaaatgctgacagcctcatgctggtggacttcgagtacagcagttataactataggtgaggctggaaagatggcttcccatagatctgttcccayagggctcttgaaaacaggccagctgcccagggcatttggggactgaatgtccaccttattctcccaggggctttgacattgggaaccatttttgtgagtgggtttatgattatactcacgaggaatggcctttctacaaagcaaggcccacagactaccccactcaagaacagcaggtatgtgggccagaggctggggagcaggacccatcctgtgaggaaggagggaggtggagtctggaaggaatggccggaaaggatgttacctgggaaatactccacagtctccccaattcctgactcttggccattgatcgtagttgcattttattcgtcattacctggcagaggcaaagaaaggtgagaccctctcccaagaggagcagagaaaactggaagaagatttgctggtagaagtcagtcggtgaggaaggaggggcagggtggggtagggcagagcagaggaaagagggattggggaagaggcagatttatcaagctgcagggaaggtggctgtggagagtggagttaggacagtgggggagaagttaaaactgtagggattggccaacctgggtgaggggatccaagcagtgctagacatgctcttgaatgcccctccttttcctgccctccccccaggtatgctctggcatcccatttcttctggggtctgtggtccatcctccaggcatccatgtccaccatagaatttggttacttggtaagtgaccctggggatgggaatgctagctggggggctggggagcagcagcagccacacncttccaggaggcctggggagtcccgggtggctgtgggcagcctgaggtggatgtagaatgctggtcccacgtcttctcacyactgtgtggggtgggtttccttccctaggactatgcccagtctcggttccagttctacttccagcagaaggggcagctgaccagtgtccactcctcatcctgactccaccctcccactccttggatttctcctggagcctccagggcaggaccttggagggaggaacaacgagcagaaggccctggcgactgggctgagcccccaagtgaaactgaggttcaggagaccggcctgtycctgagtttgagtaggtccccatggctggcaggccaragccccgtgctgtgtatgtaacmcaataaacaagcttcttcttcsmaccctgtcctggccctgctgagcagcagcagaaagtaccaaaccgagcagtacacacaaagggactcttcagtgctctgggattgaaagtggttagcgttcatgctgccagttggggtcccccatccctccccagtcccctggctgcagcttagaataataaatactaggacttggggaggaggagagtgatgggggtatgaagacgaccctgaggtggggatgcygcccggagcaccagcgatcccagaacaggcagcagctgacacatcggtgaccttttccctacatttggctatttttagctctaawgccaccatcctcacgagactctggggccccccaggctcccagacctttgagcaaccttcaccgcacagaaacccagccgcgccctgcaattcccaccgcggaaggtgggtgggttctggttctcgccccacgtttttccccgaccccgatttgggagtaggtgtcaggttcctggtgagggcggggcgggggtggctaggcctgaaggacgtggggacacgggccagagtggctggccccacgcacggacaggagtgaacccgagctgtgagtaggggccggcacagggcggcccgcgggggtctgggccctcagccctgcacaggggcgaggacggcgctggggcccgcgcgctcgggtggggaagggcgggctcccgaaccctgcctctgtccaggccggctccacttccaggggcgcctctctcccctgcccgcgccctcgctgacgccccccaactccaggctgcccttcgccgtccttggggctcctggagctttcaaggcccaaatcccctgcaccacagtggctgtgcccacccggaaggctggcgcgaggatttggcggcggttggcctggcggggggcgcgggccgggggcagccgctagtcgcggggtggggggcgcgaggggtcgcggactggctgggggcgtctcggcgcggctggcggcggggccggcctaagcgcgcccgcgcacccatctgcccccgtcctaggtgccgaccaacccccaggatggcggaagctcaccaggccgtggccttccagttcacggtgaccccagacggggtcgacttccggctcagtcgggaggccctgaaacacgtctacctgtctgggatcaactcctggaagaaacgcctgatccgcatcaaggtgcgcacaggtgcttctcccagagcgtaggcagaggccggctgtcagctgttaagcgctttgttagggtccctcactgcctccttggctggcacttctgcccggtacaggttgtggaagtacagacaccagaggggtgcacaggatgtggtcggacacagggagctgtgggtgtggcggaggaaggagcacagcagggcatcaggagagaaagccttccaggccaagaccaggagccagttcccaagacttcacaggcaggctaacctcccgccttccggctccataagggcgcctgtttctgcccacagaatggcatcctcaggggcgtgtaccctggcagccccaccagctggctggtcgtcntcatggcaacagtgggttcctccttctgcaacgtggacatctccttggggctggtcagttgcatccagagatgcctccctcaggggtaaggagtgaaactggaagggcacaggtgccaccagggagggctgggcccagctcccaaggctgaggttcctgagctrggcagatacaggacagcagccattggcagtcacggggcagccctcccctatgacaaccattgtcttagccctacatccgctcatttgatgcagtcagacatragtgtgcccagggargttcttccccttggtgtctcccctgagacagttcacagccacccgaggctggcctcaagaggaccccctgcagccyttgcccctctccaataggtgtggcccctaccagaccccgcagacccgggcacttctcagcatggccatcttctccacgggcgtctgggtgacgggcatcttcttcttccgccaaaccctgaagctgcttctctgctaccatgggtggatgtttgagatgcatggcaagaccagcaacttgaccaggatctgggctgtgagcagcagccagtggaggggttcaggcacctgggttgagactctttggactcctttggggttctgagctagasgggagaggcagacagggcactggtgcctggtgtgtggtttgtcctggaggggctgggatggctctgagggtctcagggagttgctggttggtttccattttttccactggctcccaccccagcactctgctctgtacccccagatgtgtatccgccttctatccagccggcaccctatgctctacagcttccagacatctctgcccaagcttcctgtgcccagggtgtcagccacaattcagcgggtgagggcctcgcttgggcatcccagtgggcaggggaggttggattcaggagatgtttccaaatataaggttctgtgcaaagagtggccttaagggcttgagaataatggggctgggtgaggagrgagaggtgggaagaggattaagatagaggcagcccttgccatctggccccacggtgatgataactggctggacagtacctagagtctgtgcgccccttgttggatgatgaggaatattaccgcatggagttgctggccaaagaattccaggacaagactgcccccaggctgcagaaatacctggtgctcaagtcatggtgggcaagtaactatgtaagttcctgcccctgggctcactgtcacctgccatgtgtcctggctgcacccgccccagctctaaccttccacctccccacaggtgagtgactggtgggaagagtacatctaccttcgaggcaggagccctctcatggtgaacagcaactattatgtcatggtatgaactagagcccccaggtccccgcacgtgctcagctctgtcccagctccaaggcaagggatctggaggacagcccagagctctagtagcagcttccgtgggcaagtgggggttatggagtgaggcctgagggaaagggaagagagagaggagatcctagaagagtccagaagcagcttaggggcaatggggatcctaaggatgaggagagtggagaccgccagcctgccaccgcttctcagagtcccggggtcactgcccctgcccagctcgggctctgtcacctctttccttggtttcctcactggcctcctggccatgggttcccagctgtcctgacaccataaccagggaattgtctagaacgtgtcttgctttgtgtccctctgcagagccggacagcagaatggaggccaggctgctgcttttagagctcaggaagtcagtctgcctctgccccatrtaactggcccttctgagtctctgggtctcccagccacctgggctgtatggcatgcctcttctctcctttcccacggtccaaagcacacttgacttgccagagcctactggaattctcctccataagctgtccttccaggaacttacacacaacttgcccatagcagaggttttaaactgctttttagtggtagaacccctttatcaaagcaaaagaagtagaatayaagcacataaaatagcttataaaaaggcagctcgggccgggtgcagtggctcacgcctgtaatcccagcactttgggaggccgaggcaggtggatcacaaggtcaggagatcgagagcatcctaacacggtgaaaccccgtctctaccaaaaatacaaaaaattagccgggcgtggtggtgggcgtctgtagtcccagctactcgggaggctgaggcaggcaaatggcgtgaacccgggaggtggagcttgaaatgagccgagatcgcaccactgcactccagcctgggtgacaagagcgagactctatctcagaaaaataaataaataaaaatttaaaaataaaaataaataaacaaataaaaaggaagctcagagccaggcgtggtggtgcatgactctaatccctgcaactcaggaggctgcagcaggaggatcacttagggcgagtaatttgaggctgcagtgagccatgcttgttccgctgcactccagcctgggcgacagagcaagaccctaactctaaaaaataaagaataaagcagctcaggctgaagctggagcagagggttactgcgatcagttgtgcatttctggaggttcaccccggcagcatgtgcaggatgtactggaagagggagacagaacacctcaggcccccgaatagattggtccttgggtcagcaagactcaggtgacayccagacagaggcccccaccccgcgggctctgttcctctgtaggaccttgtgctcatcaagaatacagacgtgcaggcagcccgcctgggaaacatcatccacgccatgatcatgtatcgccgtaaactggaccgtgaagaaatcaagcctgtgagttgcgtcagggttgaaggtgggatgggaggggagacctgagtctgagccatgctgggccttccctcaggtgatggcactgggcatagtgcctatgtgctcctaccagatggagaggatgttcaacaccactcggatcccggncaaggacacaggtaactgagccccctcgctgctacctgtgggccatctggctggctcgctgccctcctgcctgctcatcaccaagcgtccccagtgtctcagggtcctgaaactgtgaacagtagtcaattgtgacagatactagacatccattgtttacaggcatgatgctggcgcagggaccccacagggcccagagcagagcccctcccctccggggctcactgcgcatggtgaagggagtcctgctgcagcccaaagcttaggacagacccggcgctgccatggagccggcagaggaggggaggggcgcacccaggggtctggcagaggcagcagccttccctgcttctgacactgtatccttaggcggtttgcacaaccctctagtgcgtcgtttcctcttctgtgaaatactttataggattgttggtgttgcgtgagagagagtggaagcacccagcacagggcctggtttaggacacacggatcccatccagggggcaggaaggcccaggcagaggccgagcaaaacagggtctgcaggggtcacctagtgcatgggaggtgggcccttcccaggatgtagctgggggccccgcctcagcttgcccgtggcctgtatcacagatgtgctacagcacctctcagacagccggcacgtggctgtctaccacaagggacgcttcttcaagctgtggctctatgagggcgcccgtctgctcaagcctcaggatctggagatgcagttccagaggatcctggacgacccctccccacctcagcctggggaggagaagctggcagccctcactgcaggaggaaggtattggcctcyrggragggactgtccccaccctgagttcagggctccgtgaggagaggagcgtggccctgcctgccaccctggaactggaggctggaggcacaactaggggaggggcattggtggtcatggcagcaggacagccagcataacctacctctgacgggtggcagccaggtgaagtgtgcagagggtggggacaccctccaaaatagcttggcaccccccacctccaggcccagcctggcacacacacccccacctccaggcgcagcctggcacgcaccccaacacctccaggcccagcctggcacccccacatctccaggtccagcgtggtaccccccatctccaggtccagcctggcaccccacccccatctccaggtccagccaggccctcagagkcaccctcatcccaagtccacgtgcccactgcttaccctgccccatgcttcagggtggagtgggcgcaggcacgccaggccttctttagctctggaaagaataaggctgccttggaggccatcgagcgtgccgctttcttcgtggccctggatgaggaatcctactsctatgaccccgaagatgaggccagcctyagcctctatggcaaggccctgctacatggcaactgctacaacaggtacggcagccccagccccacaggttacagcttaaggttaaaagttagggttatggttagaggattaaagataaaagaaggtagggttatgagctgggtgcagtggcacacacctgtgatcctagcactttgggggccaaggcaggtggatcacttgagtgcaggagctcaagaccagcctgggcaacrgagcgagaccccttcataaaagtagttaggattgtgattagtggttgggtagggctagtggctagggttaaaagctagggtttgggttatagaatagggttaaaagccgggcatggtggcaggcacctgtaatcccagctagtcggaaggctgacgcaggagaagcccttgaaccygggaggttatgggaagctaagatcacaccactgcactccagcctgggcaacagagcaagattccatctcaatttaaaaaaaaagtgagagaaaaagagagagagaatagggttagtaattagggttaaaggttggggttgcaggtcaggcwcctctggacattcccagctttggttcttcatgtgtctactcttcctgcaggtggtttgacaaatccttcactctcatttccttcaagaatggccagttgggtctcaatgcagagcatgcgtgggcagatgctcccatcattgggcacctctgggaggtaatagccttgcagagggaacctgcagggcaggctgtaggggatgaggccagcctctcagtctcatcctctccctgcagtttgtcctgggcacagacagcttccacctgggctacacggagaccgggcactgcctgggcaaaccgaaccctgcgctcgcacctcctacacggctgcagtgggacattccaaaacaggtgggttggaagctcccaragcaggtgtgagaccacaaagcagcaggtgggtacagccccgacgaggcctgagcctcctcctcccctgctggcctyactgcctggcccagccctcgggaaggcacagggcacgtctcaggatacctgtagagtccaaactggcttcagggaggacagagaccacccaccgcccctggggccatctgtgtttagagacagccatgagatggaggaggcactcacaggcccctggagcattttcagcacttccctcttacccacaaagctgagcccggcctctgggggctgattctccctcagactgtcttttgcgtaccctcctcctgaagatgtcttggccggctgtgccctttctccaccarctaaacgtcatgcctcctagacatgacccagagtcctgcttggagagccctaccctcagctgacccttcccatgtcttggcagtgccaggcggtcatcnagagttcctaccaggtggccaaggcgttggcagacgacgtggagttgtactgcttccagttcctgccctttggcaaaggcctcatcaagaagtgccggaccagccctgatgcctttgtgcagatcgcgctgcagctggctcacttccgggtaggagccccgcctcccgctgctgagagggcagggtggtaccagggtccacctgccagattcacccctctgtatatcccaggacaggggtaagttctgcctgacctatgaggcctcaatgaccagaatgttccgggagggacggactgagactgtgcgttcctgtaccagcgagtccacagcctttgtgcaggccatgatggaggggtcccacacagtaagtgtcctctgcccatgtgggggtcacagtcgtcgggtgaggtgccccctctgcctcctgtctgcctggagggccagggctactcttcacccctttacttctgccccgcagaaagcagacctgcgagatctcttccagaaggctgctaagaagcaccagaatatgtaccgcctggccatgaccggggcagggatcgacaggcacctcttctgcctttacttggtctmcaagtacctaggagtcagctctcctttccttgctgaggtcagcaccgttgttgggtgtgtcctttgtcccactgccctcctacacgcagggcttgggccatctcatgatggagcacggcctgttttcctggcttgctcccctgargctccctggagtgctgggccagctttcccgcccacaccccacctgggcctgtggtcctgggactgagcaggagcaacatcctctttgtggtgttggtgtccttgtgacagggaacagacaaatatatgatctgtcaggtggtgacagcactactgagactagtgaggctatgtgggggagaggcagagcagagggagggctgggcagctcacacaagccttatgtggcatgatgcacaggggaccacggggtggtggccagggagctcctgcaccctcagcagaacygtgtctggctcagagtaggtcgcagacaccacgtgttggacaggtgctttgggtatgtggcctctgaccagctgyggcctccattgcaggtgctctcggaaccctggcgtctctccaccagccagatcccccaatcccagatccgcatgttcgacccagagcagcaccccaatcacctgggcgctggaggtggctttggccctgtgagtgctcctgaagggggtgggtgggcagcaccagggccctgagggtttcagtggcgagtgcaggccctgaggtcagacgagaggcaggagcaccttgcttagaggagagcataaccccagacctgcatggaagcagaatgttagctatggactcaggcagccaagcacctgggacccacccatcccaaatacctccctgctgaagcatgaccgtggtttccggggtactgaagcatgactgtggggctggtttccagggtactgggyagtgcactgggtgcttctgaagtctacttatccaagagagtgcagctgtctcccacagaaaccttcacatgggctagcttgtcagaaggctagagaaccctctggagagagacggagtgatctagagaataagccccctgagggaaactgggaggtcccagatcccttggcggggtctgggcagcattctttggttttcacagtttcctgggggtggtcctcaggaaaaatgcagtgtctagggctggggcccgttcctgcaactcttgtgggaagaacaagtacaatatcagcttggctttcagatcttcaaggtttgatttatgccttyttcacccttcttgttgccctcaggtagcagatgatggctatggagtttcctacatgattgcaggcgagaacacgatcttcttccacatctccagcaagttctcaagctcagagacggtgagtctcctgccacagctcaggcctgaggaaggggtgccacctggggctgcccaggaacacaggtgtctttggctggggaggcatccttgcttgtgggaacagaggggtgggtacatatctgaaggtgcatctgaactcttggctcccacagaacgcccagcgctttggaaaccacatccgcaaagccctgctggacattgctgatcttttccaagttcccaaggcctacagctgaaggttggagaaatgccagctgccctttcgtccccacactgtggaggaagggacctgtggcagctcacaggcakgaggggtggccgtgcacaggtgcccaggctccaaggacagctccggcagcaggtcctcgctgggcagatgctgctccctgagggcccaggtggtggaggtggggttggagcaggaagggaattttgatttttttttttcttgatagatactaataaaaataaggctgtgtaattttctctcagcccttaggtacctgtgttttgtytgggaactcggaggccctccccctcccccakctcaraccacagaggtggcaagagaagggctgaagctggaagactgttcatgagggacttgtgtgacctgctttgaaatgtgtgactctgctgagtgacgtaggctctgagatagctgtccacgcccacgtgtttgcttggaataaatacttgcctcagaaccttcacctgttccctggggccatttctgtttgtctgtctgctggagagtgagcccacctcctcccatgcaggggcatgtgtgaggcacccctcttggctgaggcacaaccctgcacgggccccgcagcttcttgtcagcatggaaaggggctgcaggcccaggcctgaagtcttgaggcgccaggtggtcatgtctgcaagagggcacgcaggatgacctgtagcaacagacactccttcactgaggttggctcggctgctaaaatcatgttaagagtaaatacaaaataattattctttgtttttaaggcggagtttcgctcttgttgcccaggctggagtgcagtggcacgatctcgactcactacaacctctgcctcctgggttcaagcgattctcgtacctcagctcctgagtagctgggacaacaggcgcccgccatcacgcccggctaattttttgtatttttagtagaggcagggttttaccatgttggccaggctggtctcgaattcctgacctcaggtgatccacctgcctcagcctcccaacgtgcagggattataggtgtgagccaccgcacccagccataaaaaataatttttatgaaaagtataagtaggccctcaattactgtaattgaagtgaattagattcagttctggaccttcatttaggaaccagtgtcttcatctgtttttgtttttttcttttttttcccatgagatagggtctcactatgttgcccaggctggtctcgaactcctgagcttaagtgatcctcccacctcgactttccaaagtgctaggatttcaggcgtgagccaccgtgcccggccaggaaccagtgtctgttgaacacccaccatagacttggccctgtgctggggattcagtggtaaacaaggtcctattcctgcccatgtcgaattcactgctgggtgaggcaggtgtggtcaggggacagagcagctggcaggaaaccaggaggcttttgggataatccacttaccaagtacaggcatgggttgcttaatgaaggggatacattctgagaagtgcattgttaggcgattttgttgtgcaaagattctagagtgcatttacacaaaggtagatggtgcagcctactacagacctgggctatgctgcttaccctgttgctcctaggccgcatgcctttacaacatgttaccatactgaatactgtaggcaactgtaatacaatgggaagtctttgtgtatctaaacttgtctaaacatagaaaaggtatagtaaaaatgttatataaaagattaaaaatggcacccttatggccaggtgcagtggctcacgcctgtgatcccagcaccttgggaggccgaggcaggtggatcacgaggtcagaagatcgagaccatcctggctaacacggtgaaacagtgtctctactaaacaaaatacaaaaactagccaggcatggtggcgggcgcccgtagtcctagctgcttgggaggctgaggcaggaggatggcgtgaacccaggaggcggagcttgcactgagccaagatggcaccactgcactccagcctgggcaacagagcgagactccgtctcaaaaaaaaaaaaatggtacccttatataagacacttataagacaccatgggctgggcgcagtggctcacgcttgtaatctcagcactttgggaggccaaggcaggtggatcacaaggtcaggagatcaagaccacggtgaaaccctgtctctactaaaaatacaaaaaattagccaggtgtggtggtgggtgcttgtagtcccagctactgggagaggctgaggcaggagaatggcgtgaacctgggaggtggagcttgcagtgagccaagatcgcgccactgcactccagcctgggcgacagagcaagactccgtctcaaaaaaaaaaaaaagaggaaaagtaagtggagagacaaaaggagaggtgggtggcaatttcagacagtggcaaaagcaagccttcctgattggggtcctttgaccacaggcctgaaggagacgaggagcaagtcatgtccctcatgtccctcatgttccgtacctaagggcagagtattcctggctgaaggaacagcaagagccaaagctttgcgagcggtgtctgctgtgatgaaggatgtggctagtgtggagtcagggatgggaagagcaagcggggcagctagatcggggtaacaagggcctcgtaggccagattctggattttctgaatgacgggggaagctgttgggctttgaacagagggtggcataatctgtcctaattttaagggatcactggctaaccagggtggcgttagaacaaagtaggacgcagtaacagtggaagcaaggagacccgctggagaagtgctcctggtggtggtggagctggaagaaatgagcggcttaaactaaggcagtgccataggaaagtagaattaaggagcttggaatgtcaaacgtaggactgacaagtctaatcaggaggaatcaaagataactcatattttctatattgggtgattgggtgattaaattaggtctttaaatgttgaatttgacttgcctataagaaatagctgtgaaaatgtctcagactcttgaaaatataaatgaaaagctaaggagagatctaggctccttctaacagttttgaagacagttaaaaccttgaaagtgcatgagaggattcccagggcagaggctcctcacctccttcaagtcttcatgagctataagagtatgcctcttggggccgggcgcggtggctcacacctgtaatcccagcactttgggaggccgaggcgggcagatcacgaggtcaggagatcgagaccatcctggctaatacagcaaaaccctgcctctactaaaaatacaaaaattagccgggtgtggtggcacgtgcctgtagtcccagctactcgggaggctgaggcaggagaatcgcttgaacccaggagatggaggttgcagtgagctaagatggtgccactgtactccagcctgggagaccgagactctgtctcaaaaaaaaaaaaaaaaaagagtacacctctgcctgcaaaatgttacattccatatcagagcgttcttcagcttccaaaagtatttccagagacctctacctgtttgggtgccagtaagcctcccctgggaaggtgcctgcgttttggtagtcttctggggacatcagctcaccccgtcctgagatagcagtraacagagtttccaacaagctagctttcaattaacatcaaaattcagcattaaagttcttttatctcatttgttctgggttaaaatagtgagatgaggaacaacagtggtaaaccagggtataaacctctggagactgctgggcatggtagctcacgcctgtaatgcctgtgctttgggaggtcttgagcccaggagttcgagaccagcctgggtggcgcagtgagaccccatctctacaaaattaaaaaaaaaaaattagccaggcgtggtggcacttgcctgtggccccagctactctggaggctgagttgggaggattacttgagcctgagagattgaggctgcagtgagccatgattgacccactgcattccagcctaggtgacagagcaacaccctgtcttaaaaaaataaataaacctctgatgacaacccaaaccccaattagttccccatgtcccataggtctgcaggtctgcattaataaaagctagcagccataacataaatcctgaaacctcatggctcaacccaatagaagctggactgttggtcagataaaatccagttggctgagatgagggctctgctccatactgttattcaaggatctatggtgacagaggccctgccttcagcaggtagtactcaagctgccttgggcatcaacatcataagtacgtggggagagaaagagggggccacctgtgggaggctttgatggcctcaacctcaaagtgatacacagcatttccctccacaccctctggctaaagacttgtatttcaagagaatctgagaagtagagtctagctgtgtgtccagggcgtaaaggaaacatttagtgacagttggtctcagatacacaagggcatgggaagaccagcctgacatcttcctgggcttcatggcctggagtttgcagggtagcccacctccagctcctgagcagggtactcaagagcctgcacattccagctcaactgatctttcccgagtcttctctgtcccttaccaagaaccctgagcccagaacacactcgccattccccaaaggaggcaggctgagccacaccttcgcctttgccctagatgggccttctgcctggaatcctgtgccctttctcctactctctcggaagctgtcttccttagccatcagaattattcctgattcgggccaagcacagtggctcacacctgtaatcccagcactttgggagtccgaggcgggtggatcacctgaggacaggagttcgagaccagcctggccaacatagcgaaacccggtctctactaaaaatacaaaaactagctgggcgttgtggcatgtgcttgtaatcccagctactagggaggctgaggcaggagaatcacttgaacctgggaggcggaggttgcagtgagccgagatcgtgccactgcactccagcctgggcaacagagcaagactccgtctcaaaaaaaaaaaaaaagaattattccctattcatgtttctctgggctgctgtaacagaaatcggctctgggctgtataagcaaatggaagtatgaagagcagctcacaggtggaaagggatggccagaaaaccgggttcaaccggggcaggaacctggcagctggcggagggagtgtggcccaggcagcagcctcctcaataaacaagcgaatgctcactccttgcccagaactgtctggctcaaccccagccatttttcctcctctgcaatcaggctgctaagaatcagaatccctgagagaaaattcagggggtctaaggtttgtcaggattctcaaacacaaggtgttcaaaatcaaagttaaccttccaagctagcttctcccactcttccacatctctgccagtggtatcaccccggccattagccccttgcttctttctccctccctcccacattaccaagccctgtcaagtcgaccttggaatggctttgaccctgtccaccactcagccaaacaacagcaacggccggccccgtcgccacccgcctcggcagccagagaccttttaactctgccactcgcctacttaccacccttctagggtgcccacgtccctctgaaaaaaaaggctgagctcagactggcctctggtcagcctcctcccagccagagctttctgtcactgcccttctaggtgttgagtggctctgcttccagttcttgcctggagaccaggagcgcccgggagaccccagcactttccagcccacatagacctgcgtgcacctctgcctcgtctccctgagcccgggctgcctcctctgtaagatacatgccacataatgtccgccacacatgatcgctgtgacagtggaaatagctgggcgttcagcgactcattcgacaaatgtttaccagcacctttggtaccgggcgctgtcctggacactggggacacagcaggcaaacggggccctgcgtataaatccttaagctcaagaaggaggtgggggcaaaactgtcaggccgggaagctcttcatctccgcaggattctccctcaacctcaggacgtccccagcaccgcacctgccagtcccagactcggacgccgcagacctgtgggagcagcgcggaatgccccgccccttttccsgaggacacccaatgagggcgagaggtcacttccggggmggsttcgctaacggaaagggcggggcatccctctcgaggagcggccttgttcctcaagcggccgctgggggcgccagagcaggaccggagcgcgggccaagctgga

SEQ ID NO: 17578 - DNA, 27875 bp, Homo sapiens
  misc_feature (1)...(27875): n = A,T,C or G, or insertion/deletion polymorphism (see Tables 1-2)
ccagcctattattaagccaaggctgacttctcgattgtttattccatgtataggagccccttgaagacatctgagagttcacgccacaggctgtgtttgagcacagggctctgcctgggtgggccagatggaggtcagtgacatgagggagctgggtacattgggagctgcccaggggtctggcaggagaccaggaggcaggggctgtaccaagaggacgggccagaggcagaggaagctgtgctgtgagtttccagggtgggcagtgacctctgattgataacctgaccccaaatggaaacctggacggtgccctgactgctgtctctgctgctgttctcttcccaggatggaggccaggggcatcagatgcaccttccctcctccgtcccaacccagggcctccagctaccctccccctggcctcactctgcagaggagcctcttctaacctgcccacctcatctctccttctccccttgcccactctggcccttccgtcctttcctgaggccaagaagtgggagcaggagggaagtgagggaccggctccaccaccgaccttggagtgtggagctgacaggtccaccgggctgtgccaggcctgaggctcctctgtgatcaggcagtgggcaacaccaagccaggcctcttcagagagaatgctgaggacggggcaggagggtgcccagggagccacgccgtggcggagcctgactgtgctctgggcggcccactgcctggggcaggggagacaatcccatcctcatgcctcctgggaaagcagcaccaggcacacagccaagcacaaaagacgcctttattggtgcccagatctaaagggcaggatgggctggtgtgaaratgacgtggaagatgacagtgcttcccctyttcccctgggagtcagcctcttcccctctggcacggggcctagggttgggggctctagactcagacccccacagcccagggcaggggaagggtcttgagcttggtcgtgttttcctcctgggccaatcacagaggcaatagtgggagtcctggggaggggcatggctggcgtgggggtggggcctggagccctcaatgcagcaccctgcaaaccccaggggcagccccccaacctgtgcctggccctgcagggtcagctaaggcacagtggctgggtcctgtcctgccggaggccagagcactcccggcgacctggccctctcaggacgtgcagctgggagaacacagctacttctttcgccgggtggtcctcgaactactggagcaggggttgggggctgcggtggcctgttcggaggcagctccggagtctttctgggaggctggcctgcgcttctccccgctgactggtgccagcggggaggaccggagagaacagggtgctagcagggcctgcacaaatctgacagcccccacggccatgaggagcccccagagcagggcgggggcctccaggggagacagctgagagcgagtccagtggagggcctgggccagggtgctgttggcgctgcgggtgcgaggtgggcttttctcctgtgggagggagggagggagggaggttggggaagtgcttactgggtttaccccgggaggctggggtcacccctgccacctcccccagcctggctgacacccccttacctgtagtccaaactgcctgagcagcgtctccagcgtggggtcccccagggacacggatgggaagaactcctccacccactggcgccgccaccactggctgcagcaggacccgatgttcagaagctggaggcaccccgggctccataccccatcgccagtgcccagccttacccctgctcctcagctcctcacgctccacatccccccctggtgcccggccttacccctgcaccccgggctccacaccccacccggtgcccagccttacccctgcaccccgggctccacaccccccccagtgcccggccttacccctgcaccccaggctccacaccccaccccggtgcccggccttacccctgcaccccgggctccacaccccccccagtgcccggccttacccctgcaccccgggctccacacccccccccggtgcccggccttacccctgcaccccgggctccacaccccccggtgcccggccttacccctgcaccccgggctccacaccccacccggtgcccagccttacccctgctccccaggctgggagaaccagtacttgtagcgctgggctcggacgtaggtgggcggctgcttgtggaagggatacctggccacttggctctggacaaggcggatcactgcagcgagaggcatcagcgtggcccccacagtacccgccctgcccctcccctccccaccccgctccaccccagcccactccacaccccccaagcccgctccgcacctggctccttgccctgmagcagrcgcaagaccaggcttgtgaaccacgggctgtgcgtgtgtgggcccagggctgcaaaccacatctgccagtccaggcgtggctgrtggggcaccacaaccgggggcggccggctcaggttcccaggcttgtacatgaactcgatctcctgccaggcaggccgaggtcagctgggcccgctgacctgggccccaccaccctgcccgccctgggagggctcaccrtccagtggtggccgtcgtaactgccctccagcaccacctcaggccgtccaccaagcccagtcatgcggcggaagaggccgtaggagttggccagctgtaggtgctccacggcaccaaacaggcggtgggccccggtccagaggcgcccgtgggtcccgggctccacgtaggagtacggcacctggagacargtgggaggttctcagggctgccctgcccccagcccatcccccagccctgcagcgctacccaccaggctaatcaggaacaaggccacggtcgcagtgcccacaagggacagttggactacagcactgagcttccgtagccagccccgcacctgggtccacctgtgggcaaggacccaaggtcgtcaggccggccctgcacacctgtgccccctccctgcttcctgggccatgtacctccacagggcactcagcagctcccagaccagggaggccacacccagccacacagtgggcagcgtcagtgtcttcagccactgagaaaactggtggaaggtgaaagctggtggasgaggggggtgtgaggactggyccgcccctgccctctggcccccccaggtcggcactcactggttctggagtggatggtgcgctgctgccagtcaacctccaggccaaagtagtgcacagtgccataggccagaagcccgtagacggctagttccagcagcagcgacagggtggccagcagggccttgggccaggctgtggggcaggacagtcatgggtcagcagagggtccccagccagggggctggggtgcagctagagtgggagtcctgtgggggtgttggaggggagaacccctgggagggcagggggctggacaagtgacacgcacaggtggccgtcttcttgcggctgccrtggccaggctcagcagccaggtgctggtcgtccarcagcgcagtggtaagcaccagcgtcatcaggttgaaraarttgtagttgccggtgatgataatcaggacctgcagcagcacctgggggcggcccgctctcagtgctcccggagactgacgcctggccccgtggcaggcacccacctccaccctgcagggtgcatccctctgctacaaggccttcccaacagcggttgccagctgtccccgggagccacgctgtccccaacagggcacgctgagcagcgctgaaggccgagccctgtctgcctctctctgacagctgcggccctcacccacctgcgagtagaaagcagccaagcgcaggcgtcgaatgggggcgaagaacaggggcggcacagcgatctcaattaggaaggtggccaccacgctgagcttgtgcagccagaccggcaggtggtgtgcgaaccaggcggcgggcgtgggcaggcactgggtctcgtagtggtaggtgagggctgcaggcgagggcaggagtcagggctggccgagcccccagactaccccaggtccagaccgggcccctcaccagtgagcccccaccacgcagggcagcggctggtcagcttgaccacgcctgaggcgaacatgaggcggaacagcagccatcgcaccagccagaaggggaggtcttcgtggggcagggcccctgcctgcctgccctggggggcctccttgcggtgggaggctggcctcagcggggccaccagcacggccaggaagccagtctctagcagcagggagtccctatggggagagcaaatagcaccaagagcccctccccacacagctgcttccctcggaaagtcctcccaggaagggcagagccctcccccaccccctacccagcctcccacagccccaggcccagccgtcactcaccactggaaataaaggaacacctggcccacctgcggagagaggggctgtcagggagcgggtgtgtctgtggactcaggtaaggtagaggcaggggtgggtggtgggggttggagatagagtgagctggtcacaggtcccacttgcctggcaggctgacaggtaggcggcccaaagcagcaagtagatgacrgggtggcgcagtgggctcagcagcagggctcccagggccactagtgcacccagcaggctcagcagctccaggccctgggccgtgtccagccccagtctcggcgcttcccacagcagcgtcggggtctcccacagctgctgccagcgccccttgccctgaggccgcagcgtcctccttgcaggtaggatgccctcggggccatacaggcctgtgggagggcatgtcatggccaggccctggacagcccttgcagactagactacctctgagtcagggcctgcagatcccccagcctaggtcagagcatgcggatacctccatccctaggtcagagtctgcagtccctccagagcccgtcccccaggtcgggacctgtcaaaaccccgtcccagggctagaggcctgctcaactacctgagtcagggcctcccacccagcagagcccactgccctcttccaggtctcagcccgatctcctacctgtcccaccaggtctgggaggaagcctctctcccacctctctcagagttctgtcccccaccccaggtcagagtccagagccttacgggaaatggatcaccgcacaccttcctacccccacagcggcctgcaggacacgaaccgccgccccctaccccacgccaaggcctggccctcactcccaaccccggactgcgtgagtgccgggcacagagaaaagaggacatagggtcccgcgccgaggctgggggtgtcccaccctgggtgccttcacctgggatttgcgtgtagagggaagcgaaagcaaacatgaagacggccgccacgccctggaggaagagctgccgcgggagccgggagcccgccatgtccgctacgcggcccgctagagcagggcccgccctccgcgtccgcccgcccgcggcagccccaggccccgcctcctcaccgccccgcccgcccaatccgtggcagccccaagccccgcctcctcggcccgcccgcccgcccgcggcagtcccaggccccgcctcctcaccgccccgcccgcccaacccgtggcagccccaagccccgcctcctcggcccgtccgcccgcccgcggctgccccaggccccgcctcctcaccgccccgcccccccaacccgtggcagcccccaagccccgcctcctcggcccgctcgcccgcggcagctccaggccccgccccaccccgccccgcccgacccacggcggccccaaaagccctcccgtccaaactggtggcagcccaaagctccgcccaccccccccctcccggaggcttcgaccccgccccgcgactcttccggtgagctcccgctgcgcggcgccggggttcgcctctctggcttttgcccacgttacgtcatagacatgcgcgcgacgccgcgcctacgcattttcctgggcgggaacagcaaaatggcgccagaactagtggygggctgaggacgccgtacccctcggaaggcagccctgcggtccctttgccgcccgttccctcccggacatggaggacgtggaggcgcgcttcgcccacctcttgcagcccatccgcgacctcaccaagaactgggaggtggacgtggcggcccagctgggcgagtatctggaggaggtaagggcggcgggggagtgacgcggggtgggccggcgggtggggctgcggggcgggggctccgggcccggggctgtgggcgccccaccgyctccacgcctatggctatctggcgctctggccgcgcaggtcctcgggctccctgcttcttttcaaactccatctctgcctccccaaatcatcccttgttggattagcgtggacctgtcattgcaggtttctacccgtcagcgagccgtgaatgattgagtgggtggtgaccagccgtttctctaacgtagtggaatagactagaaagcattattgcttttattgcagttattgcgagcatgcttgtgtgtttgagaggtctggatcacgatgtcagaggaattttttatcttggattttcaaaccaatttcaagctattgccatgctctatcctgttagcgattagtgtttcttccatgtttgacagccctgtctagacctgtgttaagctgtctgctccatatttgcgcttcatttttactcctcagcccagctcagtctggcgtccacgacacttaaatgtttcttgtcttgatcagcagtgatctccattctaccaaatccaagggacataagtcagcatttgttggactggccactcctttctttttgaaacatggtggtaggattttttttccctatttcattgcctgatttttcttttctatccagtctctaagtgttgagttcctcaggatggggcctaggtcatcttctgatgcatttaccctgaagtgtcatttatttctatgattttaaatattgcctgtattaggacaactaccagatctgcagctccatcctagatctttcctccaaatctactttacatatccagctgctctcttgacatctagtgggtgtcacgcaaacatctcatttaacatatttaaagtggaactcttcatttttctgcttaaaccccagcttttcccatctcggaaaatgacaccgctgttcaaccaaaagcaaaagctaaatgtggctatagtgaagccccatgcttaacactcagttcatccatgaattccatcagttataccaccggaatatcacttgaattcatctgttgtccattttatttggtctaggccaccattgtctctggcctggatttgtgtaaaaccttcctatttgggttcccttatccctgtttttgtcccgtccaattcgtgctccaaccagcagcaagtgtgactcttaaaaattaaaatctggccacagcactgttttctgcctaaaatcaacccctcagtggctttccattatgcccagaataaaacccaaatttccttctctgaacctggctctgctctccattttagcctcattttgggctgttttgtatcttgttcttttgaaccagtcaacctatggcccctccaagctttttcttggtggaagrtcttcatgctttctgcccccacttgggaatcttcttttttgkttttatttatttatttatatattttgagacggagtctcactctgagacggaagtgcagtggcgcgatctgagctcactgcaagctccgcctcctgggttcacatcattctgcctcagcctctgcagtagctgggactacaggcgcccgcctccacgcccaactaatttttttgtattttagtagagacagggtttcaccgtgttagccaggatggtctcgatctcctgacctcgtgatccgcctgccttggcctcccaaagtgctgggattacaggcgtgagccaccgcgcccggcctcttttttgtttttaaataaagagggacttcatatggcaaggaaaaggagaaaaaaaaaatcagagaggaggatcttactgtgttgcccaggctggtctcaaactgctgtgctcaagcagtcctcctgcctcagcttctcaggtagctgggactatagctgtgcaccaccacacctggctgggaatattctttcaatgactgagtttgttttcttttctttttttgagatggagtcttgctctgttgcccgggctggagtacaatggcagaatcttggctcactgcaacctccgactcccaggttcaagcaattctcctgccttggcctcccgagtagctgggattacaggcatgcaccaccacgtccagttaatttttgtatttttagtagagatgggtttcgccacattggccaggctggtctcaaactcctgacctcaggtgatccagccagctctgcctctttccaaagtgctgggattacagacgtgagccaccacgcctggctgactgagtccttttcattcttaaggtcttagtgtaaatgtcagctgaccaccctatctaaaatagtcctctccatctcagcaccttacacactttagaatgtttatcataaaccatttaaattttttttttttttgagatggagtcttactctgtcgcccaggctggagtgcagtggcatgatctcagctcactgcaagctctgccttctgggttcacgccattttcctgcctcagcttcccgagtagctgggactacaggcacctgccaccacacccggctaatgttttgtatttttagtagagacggggttttaccrtgttagccaggatggtctcgatctcctgacctggtgatccgcccgtgtcggtgtcccaaagtgctgggattacaggcatgagccaccgcgcccagccaaaaaaaattttatttatttatatgttttttttttgagatggagtctcactctgtcacccaggctggagtgcagtggtgcaatctcagcttgctgcagcctccaccttctgggttcaagcagttctcctgcctcagcctcttttttttttttttttttttttgagacggagtctcactctgtcgcccaggctggagtgcagtggtgcaatctcggctcactgcaagctccacctcctgggttcacaccattctcctgcctcagcctcccgagtagctgggactactggcacccgccaccacgcccggctaattttttgtatttttttagtagagacggggtttcaccgtgttagccaggatggtctcgatctcctgacctcatgatccacccgcctcggcctcccaaagtgctgggattacaggcctgagccaccgcgtccgatcctgcctcagcctcttgagtagccgggattacaggcgcctgccaccacgcctggctaatttttttttttttcttgagacagagtcttgccctgtggcccaagttggagtgcagtggcacaatctcggctcactgcaagctccatctcctgggttcgcgccattctcctacttcagcctcctcagtagctgggattacaggcgcccgccaccacgcctggctaatttttttgtatttttcagtagagacagggtttcaccatgttagccaggatggtcttggtctcctgacctcgtgatccacccgcctcggcctcccaaaatgctgggattacaggtgtgagccaccgtgcctggccccagctaatttttgtatttttagtagagatggggtttcaccatgttggccaggctggtcttgaactcttgacctcgtgatccgcccacctcatcctttgaaagtgctgggattgcaggtgtgagccactgcgactggccacaagccattcttcaactcatttacctgtttgtggcctgtctccaccctagaatgtgaattctgccagggcagggaccatacttatgccctcttttgtctgcttagtagagtgcctggcacataggtgtggacgttaaagtgtttgttaaatgcacatgtgatctgatgaccaaacttctctgctctcatgcatagttggctgagaaaatacggggaactgtgctgggcagagctcctgtggattcaggttttcacatcaagcagggtccatgaggacacctgttcacttggtaaatctccttcctggcttggtcagctcccttcctgctttcttatgtctgctcttccaaacctctgcagcttgaagtcctgatttcctggtttctagtattatctttttccttctgtcattttccacacactaccatgatgttctttttcttttttttgtcctttgtttttttttttttgttttttttttttagataggttcttgccctgttgcccaggctagagtgcagtggtgcaatcatggctcactgcagcctcgatctcccaggctcaagtgatcctcccatctcccaagtagctgggactgcaggcatgtgccaccgcacctggctaattttttgtatttttggtagagatggggtgtcactgtgttgcccaggctgttctcaaactcccaagctcaagtgatccacctgccttggcctcccagagtgctgggattataggtgtgagccattgcactggccagaatgttcttctagtactgtcatgatcctactctcttttatccatttatttattcattgttgttagttgtgaattgtgtgccaagaaccatgttaaactttgaaaaaatagtgccaagcaaagcaaatgataatccccactatggtaggacttcctctgtcatgggaagacgggtccaagagagtaaccgcatgggggtgtaataaatatgcatttggtgtttacttgtgttaagcacctgttttatgtgctttacacatatgaatgcagagtcctcacaaaaaccttgttagtagaggcgttagagatgtactctgaatgatagtggttcctggcagatcagaatccagcctccacccctgcgtgtgactttgtgtagtcagaaactgatggccaggcgaggtggctaacgcctgtgatcccagcactttggggggccaaggtggctcacgcctgtgatcccagcagtttggggggccaaggtggctcacgcctgtgatcccagcactttggggagccgaggtggctcacgcctgtgatcccagcactttggggggccgaggtggctcacgcctgtgatcccagcacttagggaggccgaggtggctcacgcctgtgatcccagcacttagggaggccgaggtggcttacgcctgtaatgctagcactttgggaggccgaggcaggaggatcatttgaggtcaggagttcgagatgagtctgaccagcatggtgaaaacctgtctctgctaaaagtacaaaaaaaattagccaggtatggtggtgcatgcctgtagtcccagttacttgggaggctgaggcaggaaaatcacttgaacctgggaggcaggggttgcagtgagccgagattgtgccactgcactccagcctggacaacagagcgagagactgtctcaaaaacaaaaaccaaaaccaaccaaccaaccgaaaaaatcaccagaaacttataagggatttgaaagaaaatgtatggtcctgtggagagtttggggggcttagtttgtttgagatgaaagcagttacttatttatggtgagctaaagaatgtttagctccaggtggaggaaacctggtgttggaaggattggagtttttacaaaaattagccgggcgcctataatcccagctactcaggaagcttaggcagggagaattacttgaacccaggaggcggaggttgcagtgagctgagattgcgcccctgcattccagcttgggtgacagagtgagactccgtctcaaacaaaacaaaacaaaacaaaacagaaggttccragttgggaccatagagcagaggagggcaggcagctggagagggaggctggccagcatggaggcctccctctggctccgtttaggattttgggtttttcctgccactgttaggaaaaacccaaaatcctaaacagaggcactgagcagagcgtggagagtggacgggaggggagtgaagggcaggaggagccctgtcagtgcagaggtgaaaggggaggtggtggggccagaatgggggtgactgtggagaggaacccctgggtttctgggcaggtgggttgggggctatttggagttcagtgtggatgcattcagtatgaatcttggtgaagccatccaagcgatgtttgaagaaggcagctgaacatgtgggtttgggctcagatggcaggtccaacctggggaggtgagaagacaagtgaagcccagtagtgtcttgggagtgggcaagccagccaggctgagggtcactggagagaagggccacttctgcagctcagcttccaggccgccatctcctccatgttcccttctttctggaccagctcttcaggtcctgaacacccccgaggtccttacactccgtagacgaccatgctgctgtttcctctcccttcctcccagatctgacaaacaccctttatccttcaagagctaatggaagtgactccccttggggatggcttcccagcctctgccactccttcgtgctaccatggtgcctaaaatcttgcctctccccagcacgcgccatgctttggccatgtttagatcatgctcattttcctgaagagacgtgtccagtctctgctagctgccttcacgttcccttcatctgtctggtgagcctctgcgtttttcaggcttagctttgacattatctatgcatgtgttcatcaaatatttactggacaccagtgtcaggcactgaacagaaggctggaattacactaatgctgctcacacagttcactaagggacacgatcacactaagggagcggcacagaggccccaggaatggaggggctctgaaaaagagtttgcgtggggacagctgggggtcggtgttccaggcagatggaaatgcaaaattgaagagctggaaagacacctaggggcttcaaagtgtcgtttgtggctgggcacggtggtgcatgcctgtgatcccagtgctttgggaggctgaggcaggaggatcactggaggccaggagtttgagaccaacctgggcaacatagagaaaccctgtctctacaaaaacattttttttttgagacggagtctcgctctgtcgcccaggctggagtgcagtggcgcgatctcggctcactgcaagctccgcctcccaggttcatgccattctcctgcctcagcctcccgagtagctgggactacaggcgcccgccaccacgcccagctaattttttgtatttttagtagagacgaggtttcaccgtgttagccaggatggtctcgatctcctgacctcatgatctgcccgcctcggcctcccaaagtgctgggattacaggtgtgagccaccgcacccggccttttttttttttttttttttaaagtgtcatttgctgagaaggaatacaggagatgagccagcgttggggaagatgttgggtaaagtatggaagtaaagtgtttggggacatttgaatgtactctgtggacagctatgaatgcagccccagagctaaggagagagagctggtcgggttgggtttggggctcattggcttatggttggcagcttgggcatgggatgaaggaatgtgcatggcggggggtggagcgcctggcgcactgacgtttaaggggtgacagaggagctggggctccgggaggctgaggggagcagaggaaggatggcgactcacctgtaactgtttcctgagttctctgctcagaggatggagacctcagcattttatctctgcctttcctacccctgaggttcccttttcttctctgtgtcggggatcttcctgctggagtctgtcagcctctggcgccttgtggagggagccgctgtgctgccctggttgtttgtaracagtgtgccctgggggccttccacttccaaaacaggtttttgttatagraagtagggggaaacacagagacctgtctctgccccgaaataccagggacaaccggtgagcccacagcakagctagagctgcccgtctcgggaggtgctgggcagagaccaaagatgggtggggctgccctggaagaagygagtgcagactgggccttggattccccctgtctttgtgttgtttcttgcagctggatcagatctgcatttcttttgacgaaggcaagaccacaatgaacttcaytgaggcagcgttgttgatccagggctctgcctgcgtctacagtaagaaggtgggccctgcttgacgctggtcttggcattttggtggccagtgggaccacagtsggctctccttctggggcaggtgcagtggtcgtccygtctgtgacctacctccctctctcctcaggtctcagccaattcctcagcaccttccaacaccaagaacaatttttaatttaaaatcgcacagccaggcagggagggtcttttgkgctgttgggctctgttgtcttgggggaatgacacctgctgtgtgcacttggacacagcccagggtgccacctgcacccaccttccccttccccgtcccctacttgtgggtgcctcattgtcagcacctagaaagtccacaaccaccaccctcacggtggggcctctgttctgtggaggagaaggacaggaagtgagtgacgggctctgtcctgcaggycccgtggcggcaggagctgggacagggcagggccaggacaggaggaggggctggggtgatgctggcgggagcacacgggcggaggagcagcagggctgcaggccgtcggcagagtgggtgccaagcacgaggggcctcnccaccaaggaccgtgtgatgaggcacactgtgggaaccacagtgctgtcagggtcacacgttgagaaggccacgctcgcggctgcgtggaccatagagggcagaggagagatgtgggtggcctcagctggtaaagtaattctcatgagattcctggtttgatttgagaattatttttggaaccaaaattggtggtttcttgtactggaggtttggtggtggtggccaggcctcgtgggggcaccgatggatagctgggaaggccttgggggtgggcccctcctttctgggtcctcactgcctgcatctggtcaccaggtggaatacctctactcactcgtctaccaggcccttgatttcatctctggaaagaggtgagttctgcagccactcactgtgctgccctgcatgtggccagggaggcccctgcagctcctgggatgcccacgggatgtgcttctctctcaggcgggccaagcagctctcttcggtgcaggaggacagggccaatggggttgccagctccggggtcccccaggaggcagagaatgaggtgagtttctttggcatgtggtccccgcccactgtgtgtttgcctgggctcygcccccacgagctctgtctccctccagttcctgtcgctggatgacttccctgactcccggactaacgtggatctcaagaatgatcagacgcccagtgtgagtcctggcctggcccctcttaggctggggtgaggtcagcactttccctggggctgtgttgagctgatggggtgtgggaaggtgtcattgccccatgtgggtcctgttctccactggagtggaagggtgcctggctcacccacccttggcctccatgcaggaggtcctcatcatccccctcctgcccatggccctggtggcccctgatgaaatggagaagaacaacaatcccctgtacaggtagggatctgagcccagcgacggggagggaggcctgcctgggaagggtctctacagcaggcgtgtttttgccagcacagccgtcagggtgaggtcctggccagccggaaggatttcaggatgaacacgtgcgttccccaccccagaggggccttcatgttggagccagarggcatgtcccccatggaaccagcgggcgtttcccccatgccagggacccagaakggtgagggcttggatgcggggggcttggtgggaaggaagggagggtcttctggttggactcttgtggggtgccctgtgcttgccacctctggtcttgggagctccctgtctctgggtgcctgctctagtctagacaggttggctggtgctcatcccacccatctgctgygccttgattacaagttaacatggtctcagtgccagagacctggtgcctggctcagggccctgctgtctccccccagcccaaggcctggagtctgctggtctctgccctcctgctggccccttggagaggcttgttgaacaccgggcagggaccatcttggagaggggctgggctgaccttgtctgatccctgtctctcccagacaccgggaggactgaggagcagccaatggaagtttcygtgtgcaggagccctgtcccagcactcggcttctcccaggagccaggtgagaagagagctccccggtgggactggcagggcagccaaagaggggaccagggaggcagcacccagtggacagggctccaaggggctgctctyagctgccagcctcatgccccttctgtggcccatgggagtgaggcctcgccccggggaagcagccacagcccccggtgagcctcagcccatcttggttcactgactgccctctgactgccctcctgggtctcctctctgggcagatgtggatggctgcatttaaagaggaacatttgctaagaaataaaatgaaccaagcagagcayagagcacaggagcacgacgaggatggtgcaaggcacccgccaaatcctctgggctccrtgactaaagctgagggaggaagtagccatcagggtccctttggtgccgtctggtctcggcactccttggagctgatcactctcttgctccctgcctaggcccctstccagaasgcccgatgcccctgggtgggggcgaggacgaggatgcagaggaggcagtagagcttcctgaggcctcggcccccaaggccgctctggagcccaaggagtycaggagcccgcagcaggtgggacccacatggaggcctgcagaacctgagctgtgaactggcaaccctggctctggggccgagtcaccttgcacaaggaggacagtggtatggccttggccccagaccactggtctggggcagaagcccacctgtcttgcagcccgtcctgcaaccagcccttttgaagagcagcttctgtgttcctcccctctctgagcagaactgatgctcctcagagtagtgggctggcgtccaaggatttgagccctgtcgagctcacggcaacctgggatggccgccggttgccaaggcgcctctctgcagtcgggctggtaggagggagtgtctggaggccattgctgcctccctcaacccccggggtcaactgtacccagcctagagccaagaaatccttcctttttattcattaaaacaaaatcaacctgatgcatacagaggaaatgttaacgtttcttcactctagttggtagatggcatggatatttgtcatattctattcatttttcctagttttgaagaagagtaccccgtgaccactgtttgtgttttctgtttgttttttgagatggagttttgctctgtcccccaggctggagtgcagtggtgcgatcttggctcactgcaagctccgcctccygggttcacgccattctcctccctcagcctcccaagtagctgggactacaggcgcccgccaccatgcctggctaattttttgtatttttagtagagacggggtttcaccatgttggccaggatggtctcaatctcctgacttcgtgatctgcccgtcttggcctcccaaagcactgggattacaggcgtgagccaccacgcccggcccactgtttgtgttttaaagtttttcttagggtttttgttttaatacccccagagagtactagcagggtttatttttatcttattttatttatttatttttgagacagggtcttgctctgttgcccaggctagagtgcagtggcctgatcttggctcattgcagccttgactctctctaggctcaggtgatccttccacctcagcctcccgagtagctgggactacaggcgtgtaccaccacacccggctaatttttgtattttttgtagagacggggtctcactgcattgcccaggctggtcttgaactcctgggctcaagtgatctacccgccttggcctctcaaagcactgggattataggcgtgagccactgtgtccggtccctgtaggttttttttttttttttggacggagtcttgttcttttgcccaggctggagtgcagtggtgtgatatcggctcactgcaacctctgcctcctgggttcaagcgattctcctgcctcggcctcccgagtaggtgggattacaggtgtgcgccaccacacccggctaattttttttgcatttttagtagaggcgggggtttcaccatgttggccaggctggtctcaaactcttgacctcgggtgatctgcccgccttggcctcccaaagtgctgggattacaggcatgagccaccacgcccgacccttgtagggttcttgatgttaacccaaggtggagttcctggggtacccagagccttgaggggagaaagaggagaagtggggaccctgtgactgtctttgcagagtgctgccctgcccaggaggtacatgctgcgggagcgggagggggccccagagcctgcatcctgcgtgaaggtaggagtgttggggccctgacccccggcagggagggatgggcggattcgaggactggctgcctgcccatcatgctcttgctcctgctggcctgtggtgttcccagcctgtggccctttgcacttgctctcttaaagaccccytcatgcgactctgggctcccaccctctctctagtgttcccctctgtgatccaggatttgagtgtggtcggctctgccccaggctgtcactgcacttgttgcctgggctttgggaaggcggctgtgcaccccctactcctctgggagggtggctgtgtaccccctactcctttgggagggtggctgtgaaccccctactcctcctttgggagggtggctgtgcaccccctactcctcctttgggagcgcggctgtgtaccccctactcttcctttgggagggtggctgtgcatcccctactcctttgggagggacggctgtgcaccccctacttctccagcgccttcttgtgctctgtgcccaggagactccagaccyctggcagagcctggacccctttgactccttggagtctaagcccttcaagaaaggtaattgggtggaaggtacctccactcaggtacccctggctgggtttcctggggcatgaggtrggggggtgggagtgggctttgcaccctgatcccccagcggctctaagacagtccctgtttgcccccaggtaggccttactctgtgcccccctgtgtggaggaggctctgggacagaagcgcaagaggaagggcgctgccaagctgcaggacttccaccagtggtacctggctgcctgtgagtgggtgtggtgtgcactccggaccactgggagctgggggctgggccagggccagtggaggaggatcagcacccttttcccaatgctgtgggcagctcttggcctggctggtgctgagcatgttctttcacagatgcagaccatgccgacagcaggcggcttcggcgaaagggtccgtcctttgcaggtgaggctgaagtcctcggggaagacagttttactctccttcccctacctcttcccccacctggtgtcacccaaagccttgggtggactggcacggggcctgggaaggacgagggagccctcacaaggcctttgtctgcagacatggaggtcctgtactggacacacgtgaaggagcagttggaaactctccggaagctgcagaggagggaggyaagtcccagctggtcagctgtgatctaggaccccgtggtggccctgatgggaggtgacagtgcccctcacagatgctttctctggacaggtggctgagcagtggctgcggcctgcagaggaggaccacctggaggattccctggaagacctgggggcagcaggtgggtgcctgccagggggtggggtggggcttggcacctgccgactagctgcctgcgtgctgttcactctcccacctcccagcagatgactttctagagcctgaggagtacatggagcccgagggagcagaccccagggaagccgctgaccttggtaggtgggcagcgggctaggagtgctgaggggccactggagctgggggcaggggagagcgtggccccttagctgcccagctcacagctaccccttcccagacgcagtgccgatgtccctgagctacgaggagctggttcgaaggaatgtggtaggcctgggttagagggrgacggggaggggagggggacaggtgagcggtgcccaggcccctgcttgggaggcagtagctcctgctgatcctcccctaggagctcttcatcgccacctcccagaagtttgtccaggagacagagctgagccagcgcatcagggactgggaggacacagtgcagcctctgctccaggagcaggtgaggcggggccgctgggaaccagagctgtgtgccacgggtctgtccagggccttgcctctctccgcagccaacatgcccctcccctgtgcaggagcagcatgtgccctttgacatccacacctatggggaccagctggtctcacggttcccccagctcaatgagtggtgtccctttgcggagctggtggctggccagccggccttcgaggtgtgtcgttccatgctggcctccctgcagctggtgagtagcctgggatacgtgggagggggagacggtccccagaccctgctgatgtgccacccctgcaggccaatgactacacagtggagataacccagcagcccgggctggagatggccgtggacaccatgtccctgagactgctcacgcaccagcgagcgcacaagcgcttccagacctacgctgccccctccatggcccagccctgagtggggagcaccgaggcaggggtgggggaatgtgtactgaggagccgtgygtctgctcctggctggcccggcctaataaagcagtgttgccatctcatcttccccctaaaaacccttttatgtacacctgcgcagagaagagggctgcctggcctccctgggccgctggtacagatcacacacacacacagattaaacgcagcccgtttaatgatggggcccagactgcagtggctcaagacaggacactgcggaaagccgccatgtgccgccgcacactgtctgagatctgctcagccgatctgctccggccgtagtaatccgtgaagaggccgtcagggttgagcaggtagatggcaatgragtggtccacgatgtagtcctggtcctcatccttggggcckgcattgtagtacacgcggtaactgtgactagcctgggcaacctgtttggtrgagccggtcagacccaacagtcttgggtggaagtcctggacgtagcgggccatggcttcaacgtcgtcccrctcggggtccacagtgatgaagacaggctgcactggaggcaaaccaggctctgcttccagctgccgcaccacctgcaccagcttctccagctygtctgggcagatgtcagggcagtgagtgaagccaaagtacatcagcacccactggccccggaagtcagccttgcagcgagcccggcctctrtgatccagcaggtggaagtcgccctggcccacagctgcctggcgcagggcttctgttcrcttttgctgctgcagcctctccttctcagccctcagggccagccaggccccaccgagtccagccccgaacaggcctgtgatcagcagccgggttcgaagcccagggccctrgggctggccctgcccacctgtctctgcagggccctgccttgacaaaagccaggacctcagatgcagggcctggcctcccagggtcccagggaggacccgaggcttgagctgagagagcctgtgccaagctgtggggctccgagtcagcagcagcatggatctgatgctcctggaaacaagcacaggcgtcaggagccagaagggaaggcccaggacagtgcctgggctgcccctgcgacttgagaccagccacccatctgaaggacccagcccacgttcaggcttaacaggcatttgcagctgctcacctgagctcagaactccacctccaccaaacatccacacctgggcaaccacacctgtcactcctgtcctctacctgggatcaccagcctgtcaccgcaccctgccctgcacctgcacctcagcaaggtgaacctcttgctgacggaaagcattccaagtgcatgccttgcctgaactaaccacgttatctatttgcaataaacccatttcttaaaaggaggtgggtaactctctggcttgcaatccccgagagcaaccgattcctccaacactttcctgttacctccagccacttcaaccaaccgcggccttcctccacactcccagcagaaaacctgcacgacctacccccggagctcagactctgcccgccggctgtgtttaacctctcctggcagagacgcacgacacttccacccgccacaaaaccccaccctcctcacatccaggcttcccagcagctcctccgggctcacagccgacgccctgcctttgcgttggtgacctttgagcctttcccacgggcccccgcagaaggtttgctaggtggaggtctcaggactcccggtcactgccccctcctgctgagggcaccctcccgaggactcactgcacccccgcccgggcggttctgggtttgtgccctccccagcaaggccagcgccctcgtggccagaaaggttccaggaccactcgaagcgccgcgcgagcgcgttataactgtgcttggccgcgagaacaccggtgcctgctgggagcctcccacgggcgccccagcctcgctccggcctccagcgcgccctggggtgtgccccgccagccccgcgcagtagccggagctgggaaactaccccggagtccagcgagtcctcagggctacctcctcccctcccagccccggcgtccgcacctcgcggcggggccgcgcgtcagtggaccaagcacgagaggaagcgccgacctccagctccctgsgctctgccccgccggctcagggaaagcgggcgccacacgctcacaggcagggcgcaggcgtccccggagctgcgcatgcgcacacgggcgcagccgctgacaggctctcagcgcgtgcgcggaaggcggagcccgccgggggtcacgtgttcatcgagacggcccccgcctccgcagccctggatccttccgctcccgcccaagcactgacaaggtttcgcggcaaaggagctttattgctgcggcggcagaacgagctctgcgaagggcragggggcggcraatggcgygcggtcggagagtacgagcgcctcctgcagggcgcggctctgcgggccgctgagcgcggggccgtcccggtgcacgcggagccagggggtccctgcagagcgaggggctgttagaggccgcgcggccggagctgggcgggggtgcggggccagcagggcgggggcggcgctcaccacggcgcagcctctgwcccacgtcgaccagcagctctgcgcccacccccaggcggagcggctccccagcgcggctgcgcccggccccgagctcgtgcagcaccagcgccagcggcagcgcccggaccagctccacggtgcctgcggggagaggggctgagaggcgcgggctcgggaaggggcggggcctcgggaagggaaggggatggcggaggcggaaggacggggactcccccgacgctcaccatctgcgggcgccagcagctcctcctgctcccgggcgcgaggcagcagctgccggcgttctgcgggacttcccgagcacagggctcgggccagaccgggatccacgccctgcgccgccagcatccgctcgaagcggccaagggccgagccgtcgtccagcgccgcggccacccgggcagcgccctgrgcctgagtccccgcgtgtccgctgagccagagcagggcgccccctgcgggcggggacgggtcttaggcgcggccgggtcggggcggccccagcgggaagcaccccccgccgcctccgctcccctacaccccgtccccctcaccgagcgtggtgaccaggtcccttaagtctggcgggcctgcgccgtccatgcagagcagcgcckyctccacctccagggcgtggcccacgcagcgacccaggggcttgtccatggcggtcagcgctgccgcgacccgaagccctaggctggctcccacgccaacctgcggagaggaggctcagcgtggaccccccatggcggggccttctgcagccggttcttggtcgaactccagcccctgctgcaccctgggttgccagccccccagcatgaagtcagggaaggattggggtggggaagagacacgagtgaagtgcgacacctcgccatggggccaggaggaacttgtacttggtctggggcaggaacgccacagagggcttccccaggtccaggccgggccagccttgacctctaaagtcacagcaggttaggaagccgtgaaggagggagggacttcgggcagaagagggtgggactggggttaggcaggactgctgagtggagggaggcagtggggacgggaggggtgaagggtaggctgggcccgcatcaagacgcttgcccagggaaaggccacaccgctcaccagcgtctttgccagctcccgggcctgctcctggttggggaagacggcggcccctccgaacttaacgtccaccaccagagcggacagcccctccacgagtytcttactgagaatggaggctttgggggaggcagaggaggttggagacaatggagaacctggagcttcttgggagagttcggggatgccgactttggggtcaggggccctgagcattgagggtcaagtcccttattatgggggtggcagcacctggtgggttgagtatcaggccaccccacatggtggtggtcaggcatcttgtgatgggggtaggggggcacacggtcaggtgacgggtaactcctaacgagaggcccttgacttgagtttggaggtcaggagcctgtgaacatgcagaagcaggccatggagtcaggtcacctgtgatgagtggcaggctgtccacggtggctgtcacatctctggctgcatataggattccgtccgcaggaaccagctgctcactctgacccacgatacagcagcccgcctggtccagcagcacttgcatctggtcagacatcccctgttctcagtgacttatggtaaatgacttagcagctttttttttttttttttttttttctgtgaagagtcttcctctgttgcccaggctggagtgcagttggcacaatttcggctcattgtgacctctgcctcctgggcttaagtgatcctcccacctcagcttcccagtagctgggactacaggtgcgcaccaccacacgcggcttttttttttcttcttttttttgtagagatcaagtttcactatattacccaggctgatctccaactgggctcctctgcctcccagagtgctgggacagggtctcactctgttgcccaggctggagtgcagtggcatcgtcccggctcactgcagcctagacctcccaggctcaagtgatcctcctgcctcagcctcctgagtagctggaaccacatgcgtgcaccaccacacgcagcgaactattttgtagagatggggttttgccgtgttatccaggctggttttgaactcctgggttcaagggatctgccctcttcggcctccccaagtgctaggactacaggtgtgagccaccgtgccccgccagccatctgtgattttgaccaacttcccattttatgatcctaatcaaagttccactgatgatttcggcccaggcccagtgactcatgagtaaccttgaccagtgttctcattagtgaccctaatgatccaccagtgatcttttagtgattctggccagggtctssatcatcaacctggattaatgactgatccgtggcgccccgtacctgctctgggctctggatgacattgaatccaggaatagactccagcttatccaaggtgcytcctgtgtgccccagaccacgtcygctgatcattggcacctggtggtcagggatgctgagtaccctgcacagtacccctcccccacctctgtgcatcccttcaccttccctggctaggagtgcagctggatttggaaagtatttaagcagctataggggtgcccagctggtgagggaatggaaaggaagttttcttggttgagaagtgtcagtaggggaggaggttggtacctgtccttggggaaacaaggcttggggcagagggagggaagtcctcagctcctcccttgggggagctgtctggggacccaaggggaaaggggtctgaattccatcagtggatctttttcctgctccaaggggcctggtctggagccagaggggccccaagcgctgtgctggggaacggggtggggagaactgtgctggggagcagggtggggagaagccttggtagggtcttggaggctttgggccaggcttgaggttgggagctgcctgtggatggactggttgctgcatgtgcggtataggctcccgtctggaaaggaggtggtttctaaccttgcagccacatgccgccagggcaggtgcgaggaccaggctgaccttgtcacccacaccccctgtggaatgcttgtccacaagctgctggcgccaggcctctggccactccagctgctgtcccgactgagccagggcctgggtcagcaccgaggtctcctccagatccatgccccgaagtcggatggccatcagcatggcccctggtatgtgggggtacgcgtgagggtggcagcccacagcggtggggcaccctggggccggtgctggtagtggggcaccgtcgcacccccagggacccaaagtctctcgggctgacctcccagtcggggtcaggaacgcccaaccctccccacgcaccgatctgtgcrccctgcgcgctcccattcaccacagcggccacgaagcccctsatgtccgcttcgctcaggcggcctccgtctcgcttcatgcggatcagctccgggagctgcttgggctctggcgaagggtcgggaagtccctggctcccttccccggagaagtcaccaggcgcgggtggggccccggttcccggggtcatcaaggctgccatcgctccgggcctgcggggatgcctgacacgtccggggtctgcggcctcccggcgtcggtgtctgagccacgtgctcctgtcccgacccctttcccgtgtctctccggtgtccgcccctcggtcccgtgtctgtgtcgccctcgtccgtgtctgcctcccgcttccccgcctcgcgacttgagccccgcccgtacctgcttagggcgctgccctcgcccgcttgctccggatcccagcccaggtacccggcctcgcccgcgggtcgggaccgtagggttcagggttcgcgcacagcggtccactgccggcggcg

SEQ ID NO: 17579 - DNA, 18131 bp, Homo sapiens
cttgagagatctttcaaacccagtaaccactaagagtactacaaaaccaatctggggtttactcaagctattaggatataagaagatagtgagtataaatgaaatcacagtgaatccccaagtcctaattttagccgattattttcatttcctttaccaccaaccccccacctttttttcttttataattggagtggtaaaaataattagcaaattgactttccccttcctaacctgaaatgaaaatatccaaggatgtggtacccttagacatttgaatattcagccactgaataattgagagcttataatacataattcttagattatgtgtagagttgtgagtttttagactcaatcaggtaaaaaataataagccgtttggttccagacactcatggaaatactgacagggcagaaattcaatatgtgagtattagaataattagtatctgattttaatctaaaataccatctattcagtagaaatgataatgaaagagggtttatataacagctgaaatttaaaatccatagcgttctctgtgtttaatatgtaaactaatttttcctgagaacatagtatatgataggcacagtgttcaataacttattggtataggctcattgaatcatcgcaataatgatacaagataattcctgtaaattacccatattttacagatgaggaagctgaggatcagagaagttaaaaaatgtcatccaagatcacatatccagaagctgcagagccaggacttgaactcatgtctgtctgactccagccatgcttttaatcactctgctgggctcattagtacctatcaggcctatgattgtgtccttagtgattagcactttccccagagctggaaatgagatgcgagagaaataaaaatgcttgagatctaaactgaaatgcagaaattctctattatctactaggtacaaaggaggccttgactaggtgctttgtgtgtgttgaggttgtaagtgctgtggaaatagaatttggaggaagacagacagaattacacatgattgactataataaatacaaacctatatgatacaacatgttattgctgtacataagataacgggaaaaataagtactgaatgagaatgagaagacgaagatttcaatctagtttttgccacataccaaatgtagcactagatcaatgagggtctcaacaggcaacagggggttcaaataaaagattcaatgaaagaactactttgagaaatattaagaagggttaggggtggaggttcgtaatgcacccagacactagcaacagtggaagctgatagcacccctaggatggaaagattcttactctttttttaagattctttaagattctttaagaatctagggtaagattcttactcttaccctaggggaggtaagagtaagaatgggcatcatagaacaagggccaccaaacaagagctgtacttgtggagaggtactgttactaccagacacatggccctgaacctgggagagggcagggaagaaagacctggacttccaccttgtgctttctgatgtgctgggaacttccaatgctaagccctcagaagccaccctgacagggaactaatgagacattttctacaggggtctgtcccaggtggagcttggatctgaggaaaggggatggagaatcaccttcggcaagtcacttttcctctctaaatttcagtttgctcatccctcgtttattgcctaccatattatcaataatataaatagttggccttataatttttacttcgaatttttttgaaaaacctcaaatttacaaagaatttgtaagaatagtaccatgaatacacacatattcttcacctagattcaccaattgttaaaattccatcactgctgtttaattctttttatctttctctgctaacacagacacatatttttgctgaaccttctgagagtacttgctgacattctgacacttaaacctcgaatacctaagtattatctataaacaaggatggttctctacataaccccagtacgatgatcacattcaggaaattaaacattaaggcaatgctattatgaaatataggctatactcaaatttcccccagtttctcagtaatctgctttgtattatttttttcaatcaataataacacattaaattctgtcatcatgtctctattttctcctttaatctagaatggttttccaggcttttccctttttaatcttttgtgatgttaacatttttgaagaatctaggccagttattttgcagaatatggatttgtctgattatttcttcatgcttagattcagttaaaacaattttggcaataactacacaaagttgttgtgtccttctcagtgtattgtatctggaggtaccctatgtcagaacactccatcacagtaatcttcagttgggatcacttggttaaagcagtatctgctagatttatcaattatcttttccctattgtaattatcaagtaatctgtggggtggtatatgtgaatatatcttttctcaccaagattcttttacccagcattttttttacaaccatttgaattttcttgctatgacagaattagtttcataagagcataattaaggaatctggtaagaygtctttgaaagttctaattacaaccctcatctcttcttatgttaaactgtcttcattcatttacctacctatttaacaaatgtttaaagaatgctcgttttgtggcttggcctgtgacattttcatcagtggcttcatagttgcctaaactaatgtctcttcctgtgctccagaatcctattggcaactattttccatggatgccataaactcaacatactcagatgaaagctgtcatttcactttctcacctgctcttcctgttatttattccagtaaattgcacctctgtcttctcattgaccctataataagaaaggcctatttattgagtggctatctgttacaataggccttttatacatgttacatgcattatctcatttaatcttttcaataatcttgagaattagatgccattatctggaggacattgggctttgagccccaggtcaacagtaagcaagtccccatgctaggatacaaatccagttatcttgggcttcaaaatctttgctttagcatagtgataaaggtatcactggcttcaaatcctggctctgccacttcctacgggtgattgggtaagtcaccttaactttcaatgccttgatttccttctttataaaatgggaaaaatggtaactcttgtcttgtagggttgttatggacttgaaagaaacaaaacttgctgggcgcggtggctcacgcctgtaatcccagcgctttgggaggccgaggcgggtagatcacctgaggtcaggaatttgagactagcctggtcaacatggcgaaaccccatctctactaaaataatacaaaaaattagctgggcgtggtggtgggtgcctgcaatcccagctacttgggaggctgaggcaggagaatcacttgaacccaggaggcagaggttgcagtgagccgagatcgcgccactgcactccaacctgggaaacaagagtgaaactctgtctcaaaaaaataaaaaagaaaagaaagaaaacttgacatttgaataatttctgcagcaccacagtacttctcaaaccataattctggtgtcattcattctaaacttctccttccactcactgattgtggactagtcccatagggacctcgtcttcacagctgtcattaccttagtttagaccaggggttggcaaaccatggcccacaggccaaatccagacttcacctattttcgtaaatgaagttttattggaatgcacacacacccatttgtttacatataatatatggcttctttcattctaaaatgacagagttgagtagtggcaacagagaccccaccgtttgcaaatcataacatatttactattttgcccccttcagaaagctttccaaatcctggtgcctggcgtattccaatagtcttcttcccagtcttcctggttacatttctccctgaacccatcctccccatccctaaaatttcccccaaatgtgaactcagtcataccagtttgctccttatgtttcattggcccttgctgctaagagcatccgcttgcaccttctgctcatccccagacaagctttgtcctgtgaccataatgaactcttcatgccgtttccaactttagcccatgttattcttcttgtctgaatatccacccttttctctgttctcaataataagttcaggcttttcgtcttctgagaagccctttctgacttccacaggctgaaccactggcttctgctcctctacataatacttcaattccagcattgatctcactctatcatgatcatgggtttagctgtctgtccctgccactgctgtgtgttcctcttgagggcaggaacatttgtttttcactttttaaaaaacctctgttgcccagtctggcattaggaagtgcccattaggttgttattgcttgttggcgcttgagctggggcttgaaggtttctataatgtgtagcagtgtatagaaaacaggcaggtcagaaaaggcttctgtgcatcacaccaacatggcacatgtatacatatgtaacaaatctgcatgttgtgcacatgtaccctaaaacttaaagtataataataataaaatttaaaaaaaaaaaagaagaggcttcctggaggagatgacagctgagctaagtcctggaggatgagaaggagtataaaataagataataggagaaaaaaggcagtaggaacagcatgggtaaaggtgatgaggcctgaaagaggcacgtggaaggaaagacaaatgcaggaagggggaatgggagggaatgctggggtacaggccaaagagggaggcatttggtgagtattctgcagagtctcctctgctgtgctgaggtgtggacaatgggaaaccatggacggactggagtaggcaaatgtcatattccctgttacaactgtctgtttgcatgtcagccttctagaagccccttaaggtatcaactatgtttttgttttgtcatcattcaatcctaagtgcacagaattccgggcatattacaggttccccataaatgtttctttctttattaaaatgtatgaaaactctccagatttaaggaaggtcctcaatgtttcaaattctttttgttagatcattggtcctgtctacagctgtcacaaatttaaggactctggttatatttaatcttcacttttgaattttctgcttgaaaaatttgtattagaaaaaaaagtctatccttttatggacggctctaatctcttgaatcatttgggttggcttttctttggaccttcttcaactctgttttgtctctgttgagttaaggcttttaagaacacctgaattctttccttctgcaaaaccagaggcagcttcttttccgcctattttcagtttatttcttgtgattttagtttttttctcttaaccaaatgctaaatggatttaggagaaataaacttatttgtaaagctgtcaagggaccattagaaggatggtgcttcacagatagaatacagtttttattaatgatgcctagacaaatcctgccattagcccaagggctcagaaagttagcagcctagtagttttggagatgtcaatgaaatgaattggactggatggttaaggatgcccagaagattgaataaaattgggatttaggaggacccttgtactccaggaaattctccaagtctccacttagttatccagatcctyaaagtgaacatgaagcttcagtttcaaattgaatayattttccatccatggattggcttgttttgttcagttgagtgcttgaggttgtcttttcgacgtaacagctaaacccacggcttcctttctcgtaaaaccaaaacaaaaaggctttctattcaagtgccttctgtgtgtgcacatgtgtaatacatatctgggatcaaagctatctatataaagtccttgattctgtgtgggttcaaacacatttcaaagcttcaggatcctgaaaggttttgctctacttcctgaagacctgaacaccgctcccataaagccatggcttgccttggatttcagcggcacaaggctcagctgaacctggctrccaggacctggccctgcactctcctgttttttcttctcttcatccctgtcttctgcaaaggtgagtgagacttttggagcatgaagatggaggaggtgtttctcctacctgggtttcatttgtttcagcagtcaarggcagtgatttatagcaaagccagaagttaaaggtaaaactccaatctggcttggctggctctgtattccagggccagcagggagcagttgggcggcagcaaataaggcaaagagatagctcagaacagagcgccaggtatttagtaggggcttcatgaatgcatgtgagttggtttagtagagagacacaggcaatttcagacccttctatgagactggaagtgatttaagagggaaaggatagccatagtcctgaatacatttgagctgggtttcaggatgagctcacaagttcctttaaaaaaaattgacttaagcaaatcctgggaagagtttttttgctatacaattcaaggttttaaggtcctcggattcatatactttataaatgaattagccagcttgtttaaaatgtagggaaattgtgggaagaatgccttctttacttaattcaaggttttaaggttctcttaatcaattctactagctaattagccaattatttaaaaataaaagtttgaaattgccaaaaaaaaaagacaaggaaaaggaaagaaagaaagccaccagtctgtttggcatacaatacttaattgttgcctgacctacgtgtgggtttcagatgcagatcctcagttttcagctcttcagagactgacaccaggtttgttacacggcttaaaatgatgagtatatccattgaatctcaaccttatctctctctagaccttcttggytaagaaaccatgtagtttgtatgaagtaggtactcaaaagatatttgatgatttaatttttactggagaagaaatattcatatatgttttcttatttttacatgttttaaatatgtaaagattaaataaacactcttagaagtatttaaatttcctaaagtaaatttatctcaaccagtaacaggaccctcccaatactggaaagttgagtgtgaccgcatttagtggtgatragtgtgagcttgcttggggagagggcaggacatttaggatttcttaagcttagagtcaatacaataaagattattgagtgctcacttgggtgggctataatcactgctcacaggagttcatgaaccacaagtaaaagagtgaggagatatgattagctcacaaataactttaatacagagcagaaagtaatgaactactgcaatggagttatcacagtgctaaggatgctcagagggcatctctgataggcagaggtgagggtragggaaggaagctgtagtctagctagctagagctgctggaatagacatgacaatggctgctgccaaactgttttctcttctgaggacagatgtcccgtgcaagtggcttggtggaagggactagtgtctctaatatagggtgatttataagcaggaaagtgtgtcctagaaattcagaccagagtgatagattggaattggatcatgggggactcattgaatgttatttattgtatttgtttttgcgatcagtgttagtaaagtgtcaaagggattgagcagatgagtgacatcatgcaacacaagttttgagtttcacttgtcagactgactggagaggggcctggttagttacaggaaggtaatttggcatgcagccactatttttgagttgatgcaagyctctctgtatggagagctggtctcctttatcctgtgggaaaagagaacaaaggagcatgggagtgttcaagggaaggagaaataaagggcagagaggcagcggtggtgtcaggggaagcccacaggagttaacagcagggttgcctcaacctagagaggaagcgacctggtgccctcggctctgtggcttccttcatctaacaacatcttccactctacaacaatgccagggaaggcggaggctggtacagtgcatcaagacacagctactcctgggtgacagaggttcagggccagctcactaagtaggcagaagtttttgacatatactttgagagataaagcaagattctgtacctcaaccttcagaatttcccctaccactcattatagttccggagctatatagctcctatcattctatcataaccttagaataccagagaacatatcatctcatctaattatctcttactatatgtgaaaaaaatgaaggacatgggggaagtgtgacttgccccaaatcacatatttcatggtagagccaggtcttctgtttgtcatatcagtgttcttcctgccacaaccatcttgaagaatctatttctcagtaagaaaatatctttatggagagtagctggaaaacagttgagagatggaggggaggctgggggtgtggagaggggaaggggtaagtgatagattcgttgaaggggggagaaaaggccgtggggatgaagctagaaggcagaagggcttgcctgggcttggccatgaaggagcatgagttcactgagttccctttggcttttccatgctagcaatgcacgtggcccagcctgctgtggtactggccagcagccgaggcatsgccagctttgtgtgtgagtatgcatctccaggcaaagccactgaggtccgggtgacagtgcttcggcaggctgacagccaggtgactgaagtctgtgcggcaacctacatgayggggaatgagttgaccttcctagatgattccatctgcacgggcacctccagtggaaatcaagtgaacctcactatccaaggactgagggccatggacacgggactctacatctgcaaggtggagctcatgtacccaccgccatactacctgggcataggcaacggaacccagatttatgtaattggtgagcaaagccatttcactgagttgacacctgttgcattgcagtcttctatgcacaaaaacagttttgttccttaatttcaggaggtttacttttaggactgtggacattctctttaagagttctgtaccacatggtagccttgcttattgtgggtggcaaccttaatagcattctgactgtaaaataaaatgatttggggaagttggggctctcgctctggagtgctaaccatcatgacgtttgatctgtacttttgatatgatatgatgctcctggggaagtagtcccaaatagccaaacctattggtgggctacccatgcaatttaggggtggacctcaaggcctggaagctctaatgtccttttttcaccaatgttggggagtagagccctagagtttaaaactgtctcagggaggctctgctttgttttctgttgcagatccagaaccgtgcccagattctgacttcctcctctggatccttgcagcagttagttcggggttgtttttttatagctttctcctcacagctgtttctttgagcaaaatggtgagtgtggtgctgatggtgcaccatgtctgatggggatacctttagtggtatcaactggccaaaagatgatgttgagtttagtgttcttgagatgagatgaggcaataaatgaagaggaaggacagtggtaaagaacgcactagaaccgtaggcattggcatttgaggtttcagaatgactaatattttagatgaatttgtttgacattgaatgttcatgtgcttctgagcagggtttcaatttgagtaaccgttgcaataacatggggcagctgttttgctctttgtcttcatgacaactgtacttaagctaacagccctgaaacatgagattaggctgggcagaatgctgctagagaggaccacttggatggtctttattctccttctccatgtccctctccatcacctggaagtcacctctgggtgccactctggtgccttccttgtcgaagctgtagctgctcacatgacacctatccctrttatccagtttgcttgactgggacgttttgccttccccttcagccaggaagtgaaagtcccagtttttatttatcacaggtgttggtattggtggtagaagaggtagaattatggaatcaggcctcctgtcaggatttctttttgacagtccctctcagacacctctgcctaaggccagctttgccattrcaaactctcccttctccctctctcccttcttctcttcctcttccttcttctcgctctttctctctctctctttctccctctctgtctcttatacacatacacaaagatatactctattccaacatcctctacccaacctgacagagatgtcctttgctgtaggttcagcagtggggatgagaaatacagctctcaaacaggataactaaagcttattatcttatcaagcttgttcccttgcagacaagattgatcaattatcataggctttctgggtgttctttctgaagctttctcaaagtctctttctcctatcttccattcaaggcaaatgattgccatttaacatcaaaatcacagttatttatctaaaataaattttaatagctgaatcaagaaaatctcctgaggtttataattctgtatgctgtgaacattcatttttaaccagctagggacccaatatgtgttgagttctattatggttagaagtggcttccgtattcctcagtagtaattactgtttctttttgtgtttgacagctaaagaaaagaagccctcttacaacaggggtctatgtgaaaatgcccccaacagagccagaatgtgaaaagcaatttcagccttattttattcccatcaattgagaaaccattatgaagaagagagtccatatttcaatttccaagagctgaggcaattctaacttttttgctatccagctatttttatttgtttgtgcatttggggggaattcatctctctttaatataaagttggatgcggaacccaaattacgtgtactacaatttaaagcaaaggagtagaaagacagagctgggatgtttctgtcacatcagctccactttcagtgaaagcatcacttgggattaatatggggatgcagcattatgatgtgggtcaaggaattaagttagggaatggcacagcccaaagaaggaaaaggcagggagcgagggagaagactatattgtacacaccttatatttacgtatgagacgtttatagccgaaatgatcttttcaagttaaattttatgccttttatttcttaaacaaatgtatgattacatcaaggcttcaaaaatactcacatggctatgttttagccagtgatgctaaaggttgtattgcatatatacatatatatatatattttaatttgatagtattgtgcatagagccacgtatgtttttgtgtatttgttaatggtttgaatataaacactatatggcagtgtctttccaccttgggtcccagggaagttttgtggaggagctcaggacactaatacaccaggtagaacacaaggtcatttgctaactagcttggaaactggatgaggtcatagcagtgcttgattgcgtggaattgtgctgagttggtgttgacatgtgctttggggcttttacaccagttcctttcaatggtttgcaaggaagccacagctggtggtatctgagttgacttgacagaacactgtcttgaagacaatggcttactccaggagacccacaggtatgaccttctaggaagctccagttcgatgggcccaattcttacaaacatgtggttaatgccatggacagaagaaggcagcaggtggcagaatggggtgcatgaaggtttctgaaaattaacactgcttgtgtttttaactcaatattttccatgaaaatgcaacaacatgtataatatttttaattaaataaaaatctgtggtggtcgttttccggagttgtctttatcatccttgcatttgaatattgtgtttaaatttttgattgattcattcagtatctggtggagtctccaatattagaaatactggaaacaaactgaaaaaccacaaaaggacaaataatgcttcatgagtcagctttgcaccagccattacctgcaagtcattcttggaaggtatccatcctctttccttttgatttcttcaccactatttgggatataacgtgggttaacacagacatagcagtcctttataaatcaattggcatgctgtttaacacaggttcttcacctcccctttcttaccgcctgctttctcagctcaactatcacaggcattacagttgtcatggcaaccccaatgttggcaaccacgtcccttgcagccattttgatctgccttcctgaaatatagagcttttccctgtggcttccaaatgaactattttgcaaatgtggggaaaacacacacctgtggtcctatgttgctatcagctggcacacctaggcctggcacactaagccctctgtgattcttgcttaaccaatgtatagtctcagcacatttggtttccacttaaggtttcctatttttgacctccacatcctgttattgtcttttgcagtgattctcagtgtggtcagggaccacctgtaactgaatccactgggtcacttactaaaaacaccaattcacacttattcccagatgcgttgaatcagaatctttgagtggtggggccaggagtttgtatttccaaaaatcttcccagtgcttcttatacccatcaagttttgagaatcactgcttaggcaactctgtctgtgtctcttcctctgtctctcccccttgctcattctcttgcttgctcttgctctctttctctctttcttgccccagcaagtgctaacaaacacacaagacagcacatagtaagcatttcaaaaggggttgttaaataaaaacgaataggtctttcaaagtaaggtaatgattattacctagaatgagctccttttctgtggaagactgtgcttcttgctctctaggcctttggatggtagccatgaagaaaaacaccaatcaggagcctcagtggatagtatatcatttccactcctctaaacatctttagagagattactctttttcatagttgatgggcagatctgagtgacagagagtgccttacacaagtgatgccctccaggtacctttcagacacccttagataatggactactttatataagcttaatatttcctctgctattgcctaaaattctaccatttgttgttcactgagataagacttgccctcttcattcagtctcaatcttataaaaataaaataccctttagctcaaaaaagcttcccctatggcagaagaattgtacaagaaagactatgacccggggttccgctgaaaggggagaaagcaaatatgagggtaagggagtgcatctgggcaccaaatgaaagcctcttctaattcccatgtcatttatgagagaagattctatgtctgtagtactcagagaggtgaactgcccccaaatcagaggaccaactgtcacatgggattccaaccttcatcatcatctccatttctgggatcagggtcctggggcagctccaagcccaaataatccatgaacccaaaaggggcttggcctaccatgcagggggagcctgggcgttgcaaccctcctccttggaaccacttgtcacaggcaagactgtggatgacaagggagccggatagagtggccaggggctccagagtcagttcctcctccaacatggctcctagcacacgcctctgctcatgtctcttcttcagcatggtactcgcattcctgctacttcccatttcttcatttctcacctccaaatattataatccttcattgtcacacccatcaagactaatcccaaattttgcctccaccgtcagatttgctgacactttaagctcgtggatttctcctcttttgtttcatagctatacttggtttcacctctaataatttcaagcatgcatgtcttttctacctagttagatcaggaacttctccaagacagggataatcacaactttaggcacacagtagatgctccaataaatgaattgaggagttggggaactaggacatccaggaccgttttccatacagaacccatctgtgttttcttaggcagtcccagcttaatctctttcccatttgatcatcagaactttgtgcaggtctactcatcttttggcttaaaccttaaagactctggactgtgagttccagctgcctactctgtcccactcattctactttgatcttaatccagtcttacttccaatctttttctttctttgttgaattcttatttttattctttttctcttttgaattgttggttgttgctaaaattgactatatttttatacccagtctgagccttcttccgtatccacagttaatagttcattcaacttagttgggactgagctcgtgaaacattgatgtcactgtgttgttaactggagcaaagccagttgagaagttcaagactttataaatttagttattcttttgggagttctcaaagcaaaggagaacatggctttctccggaaagttattcccattgccttacttgttgtttgcacctggttagagccatgactcaggctccttagaaaccttgttttatttcatatatatatattttttctcatctcaggtcaattttttctgttcagtccagaaacatgacacaccctattggtaaaaagggaggaaaatttattctttcctcttttatgtttccttggctacatgctgggataggggctcatggtaagtttgccagattcaaccaaaaaacgccacaaaaacaagaaaacaggatgccctgtattttatctgacaacgctatcagcaggaaagcttatgcttctaatgcagtgtgaataaaaagtgtactagaggctgggtgcagtggctcacacctgtaatcccagcactttaagagctgaggtggacaaatcacttgaggtcaggagtttgagaccagcctggccaacatggtgaaaccctgtgtctactaaaaatatgaaaattagccgggtatggtggcaggtgcctgtagtcccagctattcgggaggctgaggcaggagaatcgcttgaaccgggaggcagaggttgcagtgagcaagatcacgccactgtactccagcctgggtgacagggcaaggctccatctcagaaaaaaaaaaaaagaaaaagaaaaagaaaagaaaagtgtactagagacccctcttcagaagtttctgagcaagaacaacttgagactgtgaccactgttccaactgtaacacaatctcctgttctcacttccaggcacatgtgggattgatgctatgtcactggaagctaatgagacctgcagaagaggtagctatttctcttctaagcaattttcttagaggaagttaacccatcctgctgcatattgcaaggaacttgacattcagacccttcttggaaatctgctttcatgggcacactctatgttcttgcatttatttcgtacaataatcatctgaagcatttggaaaaagtgcagattgaagttcctctgaaccagaacttctcacttataaggtctgaggcagggcctggggattttaattcttcagagagcctttaggccatagttcataagctctgatctaactcaggattctaccatcatagatgattagcaaaggatattggaaatgatcctcagattttagaagaacataaggctcggagactttagggaccttgtccaaggtcctatggcgaggcaggacttgaactaggctaagaagtcagatctccaggttttcacatcagggctctgcagagggtggcactgtgcacctttctgaccaggggctgtcctttccaggctgcttctaggacgtccctgctaccactccaggccacccacagaaaacccacttttccatccatctccatcccaagtactcctgttacatctcggtgtgattatcaccactgttgctgctccaatgttggcttcatcttttctctttctcctgtacccttccagaggacttaggagaagcatctcaggtgacccagcctgttcttagcaatcctacagaaaaatgctgcaggtggacaacacaaagcaaaacgctgccaataaacagtctgtcagcaaagccggcagtacactgagaaagctcctattgccactggaagtcgtggaacaacccattgagatgatacatgctcttttaatcacacacagtcaagttactatagcaactaacagtgtttcagaaacatggtattaatcacacaaagtaatactatctatttggacaaaaagaagcagcttcctctgagaggaattgtaagaaatatatttcaggggatgatcgcaaattttagaagataacacagatgacttctcatgagcagcactttcctgaaggacatcatcacctttttcttcctgcttgtcattttcttcctgcttccaccttgtcatgttagccgtgcagcatgcatcccactggtagcttttctcttcaccttgctgaaaatgagtttttctggccaggtgcggtggctcatgcctgtaatcccagcactttgggaggcccaggcgggcggacctcttgaggtcaggagttcgagaccagcctggccaacatggtgaaaccctgtctctactaaaaaaaaaaaaaaaaaaaaaaaaaaaaaattacctgggtgtggtggtgggctcctgtaatccccgctactcgggtggctgaggcaggagaattgcttgaacctgggaggcagaggttgcagtgagccaagatcatgccactgcactcccacctgggcaacagagtgagactctgtctccttctttgtagttagcgtgcaactcaaacatagtctctactctcctgtgagcacctttttgcccctggcattatggtaaaccatagcagtatgttaaggacaggaaatatggatttgtaaatgaagactagccttgtattcctttcctattgaggaagctgattcactaagatatagttcatgaattccttgtcctgaatgaagagggaaaggaaaccaacttatgaagcctcaaatactgcacaaatggatgtacattagctaaagcaattcccacagtaactctgtggaagaggttctgccatcatctccattttataaacgaggaaattaagttccgaaaggtttaattacttgcccaaagccaaacagctagtaagttgcagaatcaggattaggacacatgtttaattccaaagaccatgttcttttcgaatgaccatatctgacttctgggggttactggcaaatggaaaagagcaaaatggaaggtgaatggggattgaagtattggagaagtaatgcatgtattacaggggttacaaatgggtgttgatatcagccaatgtttttttggacaaatattttaaaaagctttctgaaggtgcttattttgagattgtcaccagcagcagctctctcctgtaaccagagaggaaaacaggaagttgaagacattcaaagatggaccactggctccaatccacagttttagcagtaactagctgctttcccatttactggcgctgaagtcagcgctgcaatattgctggcttgcatgcctttctggccctaaggtatcataggttctctcacactgatgcttggctcagagatgggggaaaatggaaatcattaacacagccagtgagaagctctgatcttcatgacacctgcagcatgctccttgcgaagagggtgattctccatttgaaacaggctagagatacaggacataatgaacaatggaagtcagtgggagctaccttgcattcatatttgtgaactttggaatggggctagtttctaaaagggtaataaccagcctggagcaga

SEQ ID NO: 17580 - DNA, 54039 bp, Homo sapiens
agaagcagctcctattataatctcccttccagcctcagggccagggatttgagagcagactccaactaagctggtctactcattcttcctctctcctaggaccctctgctatgctcttgaacagggaaaatcctatgaaggaaggaaacagatttggttcggaaactactcccttattgcaatcagctttgtctctgtcaggatcatggtgtgtgtgtgagaggtggatgagacagttaggtaggtgactagataggtgcataggtaggtagataaaattccttagcagcaagcaggtaattctgaaggcagggactcagggatgggtctggatatccattccatgggaggatttctggctcacaggacacggtaccaacggtctttggtcttatacttcagtcaatattaggaatggaacaacaaagaaaactactaaattggaccaaataagagctataaaggagatgtttctaaaggattgtggtttcttataatgtcaaactaggttccctcctaagttccacaccctacagaccattttcctcccaagtttcacattgcaagrtttgaagaggaggcagattggagagttttacgttacatggttacatggaagggaggggctgtctgggttttggttagcctgggaggctttgcgaatatcactcagtactcccattgcttcctgtaaatacaaaggaatccaatggcttccaaaaagagagactctatacaaactaaccattccaccaacatttatcaaggccttggctttgtatgtggcaagcactgtattaagctctggggaatacagcgagtcaatacagagcagtcactcaaagaacccagtcgggtagaggaggcagcccagtcaccagctgtcctcacccaggagaagtgctatgatgactgccacttaccacctgtggcaccaagggcaagccactcaacttctctgtgccttgcttttagcacctgtaagtggagacaatagtagtgcctctccccttggaaggatgtgaggattaaatgaatgaatgtactaaagttcttagatcaacgtaagactcaaagaaagtgccataaaagagtttgtgagccaggcacagtggttcacgcctgtaatctcaacactttgggaggccaaggcaggcagatcacttgaacccaggcgttccagaccagccagggcaacatggcaatatctcatctctagtaaatatacaaaaaattagccgggtatggaggctcacacctgtagttccagctacttgagaggctgagatgggaggatcacttgagcccgggaggtcaagcctgcagtgagctgagattgcactactgtactccagcctgagcaacagagtgagacccttccctaaagaagagcttccacttattggtggtgatattgttattgtggtggttactattgggagaaagcttccctaaccctatgctttcctgaccagaaagccctctcagtggaggttactcactctgaataccaatgaagcaggagctggtcaaatggctgaggggatgagagaagggggagggagaggagagagaatgaggggagggaataggacatagggagtggcacacagaggcacagaggtgtggtggaacacagaaggtatgaaagcagaaattggtggaattcaatcatggaagggaattggaagaggagaatctggaagaaagagttaaggatagttcataagggataaatcataaaaggtctaaagtattatgcaggccaggtgtggtggctcacacctgtaatctcagcacttttggaggctgtggcaggtggataacttgaggtcagaagttcaagaccaggctggccaatgtggtgaaacccagtctatactaaaaatacaaaaattagttgggcatggtggcgcatgcctataatcccagctactcgggaggctgaggcaggagaatcacttgaacctggcaagtggaggttacagtgagttgagatcacaccaccgcactccagcctgggagacagagctagactctgtctcaaaaataaaaaataaaataaaaataaagtatcacgcaaagattttggatttttaaaaaccaatttatagaaaaatcttttccagaaatttgtgaagtgcttactactatgtattgtcaaagtttaactaaacaaggaaacagaaaaatgtgctcaatggtcagtttctgatactaagaatggagaacaaagtggaaggtcccatagggacctagatctggctgtaggtccatggagttgtgttgactgtgactgatttcccatagcttcttttctcagaacctgaagtggctcccctccacccacatggcataataatagcctacattcctaatggcatcaagactgtggtacagtctcctacaatcctccctaatcccatttgtccttacagtcagagccctgacatttggttctggtgtccaccactctctagccagccagaactcaggggacaaattctgattagcttaaaccattcacataattctatcccctttcctattgattggctgaggtatcaatgcgcccttgccacaattctggccagagacataaggggacccagaagacctttgggaaagtcttcctctctctgaaaaagaaacacacaagatggcatggactcttcttcctctgtgtgtcgtgttggtgtttgacacctggaattctgtaccttctagagtcatctaacataatatcttacatagtacggtgagataagtttttgttccattgaaaactgaagatttataacaacttcctgtgaaatatgtagggtggttgttatcatttggtagattaggaagccaaaagaaatgaaggggcatatatgaggcctaaagaatgtgcagaaataaacctaggtctcatgaatgtgtgtgtttctacaataccaggatgcttctcttaaatcttaccaaatacagaccaaaaaatatcaggcacagcttcataaaggtttgcctttgtgctcggacaacaaagcaaggtatgaaggtgaactaaactgtcagattagattaaaatgcctttttgcatttttatcacaatgtataaatcatctgaagctgagctaaaaaaaaatatgacaagatgatcatgttttttcaagatgaaagattccctcgagtctgagtgacatagctactccaacagtaaataaccaataacagagttcccagccagtatgcccaaagcggtgaggtccttggggatgcacccgttgtctcacgctttgaggagcttcctcagttcaccccagtgtgccatacacatgtcaccactatttacatgtggcaacacatgaaatacgtatgggaagcacacacttgtctggccatgtctctccctgtctctcacactgctatctttctcagactctccatttcagtgaactgatctgttcactgtcccacagatgccttctggcttgaggacttgcccctgtgattcctcttgccttgaatcctggaccttcccctgcacatttaaaacaaaaattttcaaatctcacccaaagtgaactcctccagtaaactgttggcttgcataatgaaagttgcatcacacaattaaaccgcttggactgcatatgctaacgcattgcacatgttattctttcctctgcatgttctgtctctccaagtagaccataaataatctctctgaaggctgttggaaagagccttcctcaaaacaaataatttttaatgtctattgatcactgatacttcctactgtgttcttattttctaaactgttctatcttgtcattgctgtgaccactgatatgatatagaaggtcagagcctttgattgtgttttttttcccaaccaaaatgatttctgtgtccacagattcacagaagggaaaaatattattaaaatgggatattaatgaggactgaaggtcttctaaatattctggggatataaaatattcttactcgtaaaggatgcctctacacggaggaagtatccacagaggaaggaaatctttgccattacttcttactgggaacatttactacagatagtcaaattttagtggctatattaagatttggggaagagcagggtacttttaatctcaagccaccaataaacctgacatatttgccagtttagtcataaaacagaaaatcctttgcctaatcaaacttagcttaatagttccttcagaagcaggcagggccaagaggctgagtctcgtgtttctggaataatgtggcatgtgtgtgtgtatgtgcagtgccagattgggacttggccccctggaagtgactgagccaggacagggaagggatctattgaatggtctggggaacagggctggccaagctcatggtccctctgaggtcagccctcccaccctcaaacctcctcccactccacccacccccaggaaccctcccacacactctgggtaaaacacagcttggcaagctctcacatcatggcttggtggctacagtgtgttgatcttccctcaggaccaaccaagaaagctagccttggtgcttctaaagctgccagcctcctaagggagtattcctatataggaatatactttgagaagctgataagacccctctaaatatttgggaggcagcctttgaattaaattatttgcctgctgatgtcaactattagagtgctatttaaaagttaaaacccaagaggcatatgtaaaaggaaataagtcaaatcaatcatttatctcaatatcagagtaattcagaggaactcttaattacatacctccaagagacttgtgaggtcaactccattctatctgctgcccttgaagctcagctggagtccctcaacaccccgattggaggatgaactctagcatagggaattctgagatggagggagggggcgctggttcaggatgcttggaggttctagaaagaactgaggtcacctggaagatacaacgctactctaaaaatgattcaggatggcttttctatgcattctctactcccataggaatcaggggccacctcccaggatggaatctgcctgatgctgtaacagtgttcagctccccaatttccccatgataacaggcaacctccttctgttttgtctacagttaattaatcagtcattgctgacagtaaggctccatcctcaacacaggatattttctgaagcattaatttttgtttcaatagttgatccttgtttggaatataatgtgttacaatgyagtggtacttagtattaaaatcaaaatacctttttattcatctttcaattttaatacttttagcatttcaaccattatttgaagggttacttactgcagtatgtcacatttatatacacacatgcacatgctgcagtgctttcagtttgagccagtgatattttaggccccaaatgctctgaaaaaatagagaaagctctcaccaagctaaggaagtgagcttgcagaccatgcctttaaaaattttcagcttgataacttagtcctcaagatgactaggtttctcttcccccacccctcagttagcatgtgcgaacaaggattcttttgaattcccaggaggggaatgagtttaatttgactggtaaaagtcttcctaataggatacctaatactgtggctcttagaactagctacaaaaatatttcatatgtttatgtctcataatgggtaattttggtttggatttatgtcattttgtctcagtatcacaatttttgaaaaattagttcaaagagaaaaaaaaaagaaaagaaaaaccatggtaaacattgctcagtctcatactcctaccctctctatgctaaaacaggaaatgcatttctgacacttttaaaatgagcaatcacacgtataatcaacttggttaaaacttccttcctggtaactgcaacacttcctctgcatctggatatgaagggagccccagaaaagcggaagaatttagacgcacactgggtaggtttgaatttgttttgttttcaaaaattaaacaaatgatccttcagcatcatcgcctccgctgctttatcaggtattgcttccttctattttttgctctttgtggggtctgactcggaatagtggcacttccttctcggctagattatctgaaactgttgtcggttcttgagatgatactaccaccgaatgtctgtgtttcattgtctagtccaacctgtattgtggatatctacaacgttccggcaatagttttgcaggtgcatcacatttttgtttttgttttgggaggaaaagggagggcacggcagccaggcttcatattcctacaagtgcatgcttcaagattactgtacttacagtgtttccaacatcttctcataaaaggggaaagcttcatagcctcaaccatgaaggaaaccagtgagtattagtcagcctgttttcctctgcatcttataagatcgtttggtatcactgaggcagaagttattgctgtgtatttatatgctgcctaaatttggacatgttttatttcaagttagtgtcaatatcaaygtatcttacagttctcttctttgttagttattctataatgtagcaaaagaccaaaatgaatgttttaagccacaagagacagttctttgggacrgttggtttcacttactaagtataacttcatattttaagagagggaatattggttttaaaagttaagccaagatttgaacataagwttggatcaaatgaaatttgtctttcttatcttcttatcaagctctcctttttggtatacatcaaatgctccactatttcttaaggaaataatgtagttttaagtctaacattagttatttaagagagtaaacgatattttctgaaacattaattttttgtttcaataattgattcgtttagaatataatgtattacaatgtagtgatactaaacattgaaagcaaaatacctaatctttcagtkttaatacctttcaaatttcaattattatttgaaggatttcctattgcagtatgtcctatttatacrtaagtgctttgtgaagggtaggtacttactgaattttgtggaaagagtgagtaggttaatgagaataaatttgtgaatttgtgttacaaaaatgaaaatattagagcaaaaaagaagttaaatgattgggggtcttaacagaaggtcactggagtccagaaatcctgccttccatcctgtagctcctccattattaagtagagacagatcaaatgaatttwaattaattaattawacaatgttaaaattacctaaatgttcctattgggagagtacagccttgggtgactcttctaagatactgccctaatatagcagtgacagccagaatgctgacaaattccatgattcaaaattttacatatctgcaaatggttttgactgtaactttactaattccgatatgttttagctttacaaatgaaatgacttgctttcctaattagaaagaaaaaatgaaaccaagaggcaggaaatttattagggagtagatcctaggtccaggcagtttgaaaacaggcaacgtgaagcaaggctgggtgaggtgtctgggttccaagaagtgtgagacttaacaaagaggaagtaagttaaaggcctgttttcaaagtgagattttttggcatctcgtgttgcaccttgtaaactgggacttgaaccttaactgtactattttagtaatctatatgtttcagtatgtttaagaacaatgtccattctgagccattataatgtgtcatgcgctgtgctggatgagtgttttacctacctctttaaaattttcaaagtatacaaaagtagaacgaccaataagcccccatatacctgtcacccatattgaacaagtattactttatttaactctccctctggggcattcattactaaccagtttgagagatgagaaacaggctcagagattaagcagcccaaatcacccagaaagtaagtggctgggccaggactcaccggcccgactccaaagcccacgctctgaagggctgtagtgcttccagtttaaaatacttggtccctctgggtccctgtgcacatgtacgccgcctatacctcctcttccctcatctcaccagaaaatataaggggaaagtgcctttcttgtgacaaatccctgtgtccctccgctcccaggtcgcatagggcatggagctggagaactataaacagcccgtggtgctgagagaggacaactgycgaaggcgccggaggatgaagccgcgcagtgctgcggccagcctgtcctccatggagctcatccccatcgagttcgtgctgcccaccagccagcgcaaatgcaagagccccgaaacggcgctgctgcacgtggccggccacggcaacgtggagcagatgaaggcccaggtgtggctgcgagcgctggagaccagcgtggcggcggacttctaccaccggctgggaccgcatcacttcctcctgctctatcagaagaaggggcagtggtacgagatctacgacaagtaccaggtggtgcagactctggactgcctgcgctactggaaggccacgcaccggagcccgggccagatccacctggtgcagcggcacccgccctccgaggagtcccaagccttccagcggcagctcacggcgctgattggctatgacgtcactgacgtcagcaacgtgcacgacgatgagctggagttcacgcgccgtggcttggtgaccccgcgcatggcggaggtggccagccgcgaccccaagctctacgccatgcacccgtgggtgacgtccaagcccctcccggagtacctgtggaagaagattgccaacaactgcatcttcatcgtcattcaccgcagcaccaccagccagaccattaaggtctcacccgacgacacccccggcgccatcctgcagagcttcttcaccaagatggccaagaagaaatctctgatggatattcccgaaagccaaagcgaacaggattttgtgctgcgcgtctgtggccgggatgagtacctggtgggcgaaacgcccatcaaaaacttccagtgggtgaggcactgcctcaagaacggagaagagattcacgtggtactggacacgcctccagacccggccctagacgaggtgaggaaggaagagtggccrctggtggaygactgcaygggagtcaccggctaccatgagcagcttaccatccacggcaaggaccacgagagtgtgttcaccgtgtccctgtgggactgckaccgcaagttcagggtcaagatcagaggcattgatatccccgtcctgcctcggaacaccgacctcacagtttttgtagaggcaaacatccagcatgggcaacaagtcctttgccaaaggagaaccagccccaaacccttcacagaggaggtgctgtggaatgtgtggcttgagttcagtatcaaaatcaaagacttgcccaaaggggctctactgaacctccagatctactgcggtaaagctccagcactgtmcagcaaggcctctgcagagtcccccagttctgagtccaagggcaaagttcagcttctctattatgtgaacctgctgctgatagaccaccgtttcctcctgcgccgtggagaatacgtcctccacatgtggcagatatctgggaagggagaagaccaaggaagcttcaatgctgacaaactcacgtctgcaactaacccagacaaggagaactcaatgtccatctccattcttctggacarttactgccacccgatagccctgcctaagcatcagcccacccctgacccggaaggggaccgggttcgagcagaaatgcccaaccagcttcgcaagcaattggaggcgatcatagccactgatccacttaaccctctcacagcagaggacaaagaattgctctggcattttagatacgaaagccttaagcacccaaaagcatatcctaagctatttagttcagtgaaatggggacagcaagaaattgtggccaaaacataccaattgttggccagaagggaagtctgggatcaaagtgctttggatgttgggttaacaatgcagctcctggactgcaacttctcagatgaaaatgtaagagccrttgcagttcagaaactggagagcttggaggacgatgatgttctgcattaccttctacaattggtccaggtaggggatgttggtgttatcaatggaagccttctcaaaaggaattgatttgcatatgcacaggcactccattcrgttgtcatcaaatgccctttgttcagagcttcatcatcggcaaaagtagatatgatgaagctgcctcaaaaagtagtaaactgttccatgtacatttttactgtctcggagggtttgctgacaagggttttgcagacattagtacttcacgtttttaggagaattggccctgtgggaatactttgttctcatttattattttaatgatagattgcacttactgaatgctttcttgtgccaaggctccaagtgactgacatgctttcagtgtattatctcatttaactcttccaataactatgatggaggtcaaattgacatttgcactttttacatgaggaaactgaggtacaaagaggctaagtaatgtgcccaaggtcacatactttgaaagaggtagaccagaattcaaacccaggaggtctccctccagatcctgctcttttcactaccccaaatccttcacaaatccaccaccatatccttcatcagtctggtgtcaggattctggggctagagataaaaggtcttattctctgtgtatgtctgttacagttcacagaataatatctcatatctgggtagagtcttgaaagctcctctctgcagataggtacaggactgtatgtatttctgctccgtttctcatgatgttccctggggtcctgagaggacaagtgatttttctaaggtttagttaagaagttaaagaaagaagggggaacagttcccctgctcactttagcagttctcaacttatattgtactgcttgacaagggaaaagaagtaaaggaatttgaatagaaatgctattttagagcacagccttcattcattaattcaacaacatgtactgagaagactggcattaaatgagtacacacacaaatagatgtttaataccaaattgtgacaaatactttagggaaaactataccgtattatgagaaaacagtccaggggtccaagggacacttaattttgattaagagaccccgggacagttctgagtaagtgacatttgacctgagatctttaggattagccagactaaattttacacactaaactatctaatcactatccgtatttataggaagttctggagttttctgataagcattttggatagcctcaacttaaactctcaatcttcaccttcctgttagatacttgaaacattacatttggctttgttttcatccattaaatatattcagtagttttttcactagttgagatatttgtataacactaaagaattttagaawaattaaagaatcttcagttttctagctctccataacagaaacaacatgaaaaaaacttggatgagctctgttgcaaaccccaaggctaacaggaattatttttcattgtcatgttcacaagtaaactttaaagagctggaaaatgaataatgttctttttagaaatgtgttaaatgaaagaggtcaatacataatattaacattgaatttgtggtcttaaatctgaagaagaatagtcatttgtaaaactacttgagacattttcagctatggctaaatgactcattcctgatcaaaatggtctcctagttgagatctgcactgtctttacagaagtgaaacctgaagaaggtcagaaagactcacatctggcttagaaacttaaaacattgcgaaaatgagtactggtggctaaaagaccacattctcagaattaaggcctttgatgcagctacagtggcacctatttgaccatacttttgaaaagcatttttgtaaacacttgtataattgaaacatgatgaagccactagtgatcatgtccaaactggaaaaccagaggaagaattataaatccttccaagaagcctccagttcctaaaatataaactagaatgtgaatttcttccgttccttaggaaaaaaggatacaccatttctattcataaagtgtatactctgagatatttaatattaagtctttcttcatgtttacatatgacatctatcctctaactttatatatgcttttataataatctgaacaatgtttgttagtgttgctgcttttaaaattatgaactatttcaaacttacagaaaagcacagagaacaatgaaayacctatgcactcacaagatttaattgtgttttttacattttatcagttcttcctcatcagtaatggagctgtactaagtcaatattctctaacatcagccaagtgatatgaaaattactaaacactaaaaatgaagatcaaattatacttaagaaaacataaaatcagggacttttggacagaaagctctgtacacaccacagtgtggcagagggtagtgattgctctgtgtggattgatctagagccactgtttacttgtagttaaggacctgtgagacagttcagtgacttgccagtgagatgccgaaaagggaagctatagggcttttaggatctttccatctaacaaatatttttctccttacgtgtattatactatatctccactgtccattttctttctcacattctctcttaccttccactttatagattggttacagtgtctccatcttccccctctacccctccaacaaaaccagtaagacctaattagagcaaattccctcacctcttcacctttgaatttatcagcagcacatgactgtgagtcaaaagtttcatcctctaatcccagttatgtcatcggctgctctatgatcttaagcaagtggttcagtctggtcctaagtgtcctctaacagacaggattaaacttaagtgactgttaagattttcatctttctagccgtgaagacccagtaaagcagagcaccagttcttctccatttccttttccctgattcaacgacatagagtacagtcctacaaatgccaatgtgttcttcctttaggctgtgaaatttgaaccataccatgatagygcccttgccagatttctgctgaagcgtggtttaagagtaagtacttccattttgataatagcgtgaaattttaagttgccaagaattaactggtagacctaaagcattagtcataataatttcaactttcttgtacctgccctcagaacaaaagaattggtcactttttgttttggttcttgagaagtgagatagcccagtccagacactatcagcagaggttcgctgtgattctggaagcctatctgaggggctgtggcacagccatgctgcacgactttacccaacaagtccaagtaatcgagatgttacaaaaagtcacccttgatattaaatcgctctctgctgaaaagtatgacgtcagttcccaaggtacggtggctatattttctgtgttctctttccaaatgccttcatctccaaatgccattgttcctataattctttttcttcctggaatccaagttgcatcctcctgaaggcaccaagaacacatttttgagttttctgtctgcatggagtaaacaaatttaaagttctccttttacaagttcataatttttaactatatatttacatattcttaactgaaaaattaagcagcattatgcagatgtaagatgtagtttttaagaacagttgcatacacaaagattagatatttccaaatctttacctttttcttcacatctctgaatatgcacatacagttttcaagtttacagtcttataaaatgatgaayttttgagaggctattttaattttttggcatttcttcatctatatatctcagagtgatatatagagatacattcattcttccctatctggggtcctacatctgtaaattcaaccaagcatggatagaaaacatttgggaaaaaaattgcatctgcattgaacatgtacagactttttttcctgtcattattccctaaacagtacagtgtaacaactatttgcatagcatttacattgtatcagatattataggtatctagagatgatttacagtatatgggaggaagtgcataggtcatatgcaaatactataccattttatatcaggggcttgagcattcatggattatgatatctgcaggaggtcctggaaccaatccttacagacagcaagagacgactctgtatctgtgtgtgtgtgtgtgtgcataaaggtaataaacacacacacacacacaccaccttctctctcaagctgtttccaatatcttattcctaccctaagaaaacctgcccctgccctaggaaaattaatcactccttctctgtatttctgtagattttgattgatactacattaaattaaagtctttaacatatcttcctggtctggtaaactgtatcaaccttgaatctagagaatatctctttttcatttttatatacctagacctagcactatggctcattacatagacacttcatgtactcaaccagtattttaaactcctgaatatttaaaatttctttctccctttgattcttacaatgcttcctcctaaaaatgatgatggtaataataatattttatttgcattttaagaaaggaaaacatttgtactgaccctcattctgtcagtcatccagtaatttttaattcacatattttgcctttagaattttaaggctgtcacatccatcttctctacttctctacagaacctaacttcctcttctgaaaagaaattacagaaccctaaccaaattccatgtattattttcttaaaatgtctgttcctcaaatcagatggtagtttaaagtttaatgtgctggaaagaaaactacagtattaattccttagcatcaccctcagagcatacttctctacttggattgtgttggtgtctatgtgttatcccacatatattcacatatttctgtcccctgttgtagtatgtgtacatggttatgttgctcaccttaagcccaatgtatcttgccacctcatatggttagctcctcaaaggcagggcccacccacatttctcctgctctacaccagaacaaatatatagaatgctatgaataaatgtgttctcaggaaatgtaatagataatattgatgatttctggaactcacataactcttgtgtacttttgacaattacagttatttcacaacttaaacaaaagcttgaaaacctgcagaattctcaactccccgaaagctttagagttccatatgatcctggactgaaagcaggagcgctggcagtaggtatcacttggatgtctccatgtggtctttatgtcttgaagatgtctaacgtgcttgctggggcccagtacttaaaagctaatgtttatgcagagacagggaagctggagagtctctggatgggtttctcataagcccttgtctaatcactggttatgaaagcctcaataccagataatttcccttccatattttttaaaatcagcttgagatattctttgtatacaataaaaattgtccatttaaaatgtagaattcagggaacaggcgcggtagctcacgcctgtaatcccagcactttgggaggccgaggcaggcagatcacgaggtcaggagttcaagaccagcctggccaacaaggtgaaaccccgtctctactaaaaaatacaaaagaaaattagccaggcatggtggtgcattcctgtaatcccagcaactcgggaggctgaggcaggagaattgcttgaactaggacctaggaggtggaggttgcagtgagccaagatcacgccactacactccagcctgggtgacagagcaagactccgtctcaaaaaaaaaaaaaaaagtagaattcagtgagttttgagaaatgtatacaattatataaccaccgccacaatcaagatctagaacatttccatagacatgttacagaaaaagttctgtcatgtcccattgcagttagtcctttttctcctcccattctctgtgataatgcaacagatctactttctatcataaaatgccttttctagacttttattaagaggaatcatatagtatatagttttatatctgaattattttactttccataatgcttttaagattcattcatgttattgtatgtatcagtaatttgtttctttttatgacttagtagtagtcccttgtatggmtataccacagtttgttttccattcattttttgagtaaatgtttaacagtggggtagttgggtcagatggtgtgtgtgtgtaattttacaagataccatttttccaaagtggttataccatttaaattccagcaatgtatacgatgagttctagttgtttcacatcctagcaagcacttgttatcatcagttttttttttgttttttttttttttttgagacggagtctcgctctgttgcccaggccggactgcggactgcagtggcgcaatctcggctcactgcaagctccgcttcccgggttcacgccattctcctgcctcagcctcccragtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggcctatcatcagtctttttaaacttagccattcaaatgagtatgaagtggtatctcactrttgtttttatttgcatttccataataaggttgagtgtctttctatgtgctcattttccattagagtacattcttctgaaaattttctattcaaatatttcaccagttttttaggtgggttgccttctttttttttttttgagacagagtctcgctctgtcgcccagggtggagtgcagaggcacgatctcggctcactgcaagctcctcctcccaggttcatgccattctcctgcctcagcctcccaagtagctgggactacaggtgcccgccaccacacccagctaattttttttttttttttgtatttttagttgagatggggtttcaccgtgttagccaggatggtctcaatctcctgacctcgtgatccacctgcctcggcctcccaaagtgctgggattacaggtgtgagccaccgcacctggaccttagttttagttatgagagttacttatataaactggatacaaattctttatcagatatacattttacagatattttctgttagtctgtggcttgcctttttattttcttagaggtgtctttcaaagcagaagctttaaattttgattaagtcaaatttgcaactttttcttaaatggtttgtgcttttagtgtcttatctaagaaatctgtctaggactagcacagtgtctcacacctgtaattccagcactgtgggaagccaaggcgggaggatcacttgaggcaaggagtatgagaccagactgggcaacatggcgagactccatctctacaaaaaataaaaaaaaatagccgggcatggtggcacgtgccatagtccccactacttggaaggctgtggtgggaggatcacttgagctcaggrgtttgatactgcagtgagctgtgtttgtgccactgcattccaacctgggctacagagcgagaccctgtttcaaaagaaatgaaaaagaaatctatctaatccagtgcctcagcctggggtaatccctctgtctgccaagggacatttggcaatgtctgaagacattgttgatggttataactgggagaatgctattggcatctagtgggtagaggccagggatgctgccaaataccctgcagggtacaggatagtcccccagaaccaacactatccaccccaaaatggcaacagtgccaaggttaagaaattctggtttaactcaatgtggcagatattttttcttagaagggttatggttttaattcttacattgaagtctgcaatccaatttgagttaatttttgtgtacagtgtgaggtgaaggtcagagttcatttttaaatatgaatatccagatttttcagcaccatgtgttgaaaagactgttttgttttgttttgttttgttttgtttttcctggagaactaccttggcacctttgtcaagtatcaactgaccgtatatgtgtgggtctacacctagattctctgttctgttccactgatctaaatgtctgtccttacatcaataccacacattcttgattatgtttaaataacaaagcacttcatatacgtgtgcttatacaggcaacagtatacttccattaaccccygcatcctttgcattatttttattatgatttcaacttctatatatgttataaatggcacaataagttactatttttgccctaaacagttaaaaaatagacttaacagacttaatagatgaaataatttttaactattcacctacatatttaccatttttggtactctttattgccttatatcggtccacatttccttgagcttctaacatcttttctactgcaagtttgctgacaataaattctttcagcttttgtttatctgaaacactttttattctgctttcatttttgaaaaatattttccctgaatatggaattctagattgactggtttttttctttcagtaacatttttttctggcttgcatattttctgatgatgagtcttatctttgattgtgtctgcataatacgtctttttccccaggctgtttttaagattcttttttatttctggttttcagcaatttgattatgatgtaccctggtatgggtttcctttgtgtttaggctgctggagtctatggagctccttgaatttgtgagtttatagtctatcaaatttggaaatttttcaaccaattttttatgttgcctcttttctctcctctctgagacttcagttacagtaatttagactgctggactctgggctcagtctggatttccttcctctgtgctgtagcctagaaacagcccccaggcagtaatctggggcaattacagggctcacttcatttgtcttccttttcttggggatcacggacctacactgcctgttcaatgtctgaaaagagttttatatattttgcatagttttctagttgtttatggcaggacggcaactcccgtagcagcgaagccacatgagaagatgaggaagttcttcccctgaatgtttaattttatatacaattaccagcaaactggccctatagtaaaagcacacactatccactgtccattatttaaagattggtaggaattatgacatattaatacagtttcaaattgtgtttgcttctttaaatgactacatcacaattttgatctgtggtgaactcacctttgcctgaaacacctaccttttttatgtttaagtgagtaactgccaagccacatttcccctgccttgaatttatttagatgtatgaggtttagggggagggcgtgttgtacctaaatgccagattttccatttatttctgttaaatttcatctgcttagatgtagcctattgcatctgattctgcaataatagtttttttgacattgtggtagcattagaattcttttttcaaattaaatctcagaaggcggacaaatataatagccaggttgctgtctattaaagaggatgtgggagtgtcagagctctgtgtgcgtggggagggtgagatctgccatacctcttaggcacttccaaagactcttgtggttctttggagcacagtttgagaggcactggtttaagagttgtgaattcgctctcacatggcatttccagatttgctcaaaacaacttctgtatttttacccaaatattgaaaatcattctccaactaggactttgtccttgttgtttatagtgatgttttgcaagagaatttgtgtctccaccatgtatattcsttattcattgtgtgtggggaayatgtgactgcttccttacagattgaaaaatgtaaagtaatggcctccaagaaaaaaccactatggcttgagtttaaatgtgccgatcctacagccctatcaaatgaaacaattggaattatctttaaacatggtgatgatctgcgccaagacatgcttattttacaggtatgctaattttaagattgttttcaattatctgaaaacaattctatattacatcaaaaacatgctttctcctrctggctctattcccastctcttctttcaagtgatgaattgtgatcaaatattacatcatagagagttttcacttggggaatttggctgcagactattagatatgcaatctaatgagcattatggttctgtccaagttgcatatctaacactcccaagtagccagatatacctccctcacctaatgtcttttttatacaccccattctaagcttgataacatagaaaatagccatatttatccccagcactcacttcattcctgcccatagacatgtctgcacatctctaggcactcttttagatacatctcctctgatgcacataaacaaatcaagcaaatgattttatgggaaggagaaagatgaacaagtaggtcaccacagaaatcctgcaggtaagtgacaagagtgaagtactgtyagggcagaaggtgaatggtcaatatatcagtgctaattattttcatattttctaacatttctagataaactttagcttcacaagtctgtaaagtaatattctccagattctagwtggtcagtgttgtagaggtaataatttctaatacttaatatggtttatttgaagtagacaaattacattgatttcaaggtagcctatttaaaactggtcatgtttccaattgtaagtttctgtttttacttatttctaatatagaaacaggaatacctttgctttgcctttgctttgctttcaagaatgatctatgttttgtccaggaggtattttagaaaagaaaaagagaaatccttcaaactttttgcaagtttattaaatttcaaataaatctgtagaatattttgaattgtttgaagatggacactttaaaaacacaaaaattaccctgttggtcctctcattttgagtgaaagtttgcctttgccctttatgtactttgtggttttgtttttttttaatttttttaagatgaggccttgctttatcgcccaggttggaatacagtggcacgatcacagcccactgcagcctcaaactcctaggctcaagcaatcctcctgccttagcctctgaagtaactaggactataggtgtgcaccaccatacctggcaaattatattttttgtagagatggggtcttgccatgttacccacgctggcctcaaactccttggctcaatgaatcctcccacctcagcctcccacacaactttcacagtcttctccttttctttcccttcctcataagaaaaccaacagtgtggacctggaaaatagctctctggtcaaaaaaaacctctctgcccttcactcaacaaaaacatagcctttccttctctgggccaggcactagcccacaatctccattagactcttcatccttctataggaatgatcaagattgtgaaagacaccatgacaattgccaaaattgctgggattctaggcacgagccagttaatcgccaaaattgctgggattctaggtgtgagccatcatgcccagcctactttgtttatttgttggggcacatagtttggcagctaagggcaagttatttaagctctttaaggctttgttccttcacctgtagaatgggaataataatcctatccacattatagggcaatgcaaggatcacacataaagcagcaatcagtatatattcgctatcattatcatcattgtagttactgctgctttggttattgcctttgataaatatgtgtaaggatgttagagttttgtggtaaaatagacacaagtaaagcagaacatttgaacagagaggtgatgaaccacagctaaaacccactccaaaagaaatgtattggccaagcatggtggctcacgcctgtaatcccagcactttgagaggccaaggtgggcggatcacttgaggtcaggagtttgagaccagcctggccaacatggtgaaaccccatctctactaaaaatacaaaaaaaattagccgggcatcatgatgcgcgcctctaatcccagctactcaggaggctgaggcaggagaatcacttgaacctgggaggtggaggtggcagtgagctaagatcacaccactgcactccaggctgggcgacagagcaagattccatctacaaaacaaaaacaaaaacaaaacaaaacaagaaatgtatttatcctcttccccaaggtacatttcggaaaacaaaattaacaagctcacaaagaagagaaactttagagtaccagattgaccaataaacgtacagttgttacttatatgttttacatttactcttatattttgtgttactagatatgattgctatttttaagggagaagaaaaatatattaagttaatatatatataatataaacatttctgtgtttcgatgcccagattctacgaatcatggagtctatttgggagactgaatctttggatctatgcctcctgccatatggttgcatttcaactggtgacaaaataggtatgtagttacctcaggagatgaatagacctctcagctcgtttgaaaagattataattccttcagtgtagacatttaataactgaaaaatcataatcttaatctgtataaaaaggaagaaaacatttctatgctggtgaatgtgactctcaatttaatgtggatatattgaaaatacatgaatgcatgattcaaatccctgtgactatacatggaaatgattttagtaagaacttgttccctcctctttccttctccatctctaaactttaactcatttcattacacattaaacttttctctcacaaaaaacatttaaaaatagatggaaagatctgtcacttattttagtattccagaattcacattatcaaagctattacacactctactatcaggtatttttatagacattcagcattagtttcagtcaaacatatgtttattcaagtttctgatctgagaactctacaaaaccatttacatttaaccctgtaatttaaaaaaggaaaaggcacagattgccatctgaggaaggatatgctcagcatataaatgcttttatttattactattcaaaaccagccctttcctcttgtcattctgggatattgaaaacatatcccacacaacttccatatcctccttctttcctttctattcctcataagaaaaccaatagcatagacctggaaaatagctctctggtcaaaaaaaaaaaaaaaaaaaaccctctgcccttcactcaacaaagacatagcctttcctcctctgggccaggtactggcccccartctccatcagactctgtgcatccttctgtaggaatgatcgagattgtgaaagacgccacgacaattgccaaaattcagcaaagcacagtgggcaacacgggagcatttaaagatgaagtcctgaatcactggctcaaagaaaaatcccctactgaagaaaaggtgagctcatgctttttcccagtctaatggctccttacaagttgtcatttatatagcagtastggcttcaagttttcagagaatctgccagtgtcttgcctcctgacatattagtgaagttttttacttgtgaaataatggaggttttaagtaccctcccgtggtgacagcatatctgtgtgaaacagaggcactcagttcaggactccatgagcatttgcttctcttttgattatcaggcatactttgcttaaaatttggttctgtaaaataatctgttagcactttttatggctatctatttttgttgttcagccaagatatttagttaccatgtataaactcttacgtacctgggaaatacaacatacacaacaaagtaatttataatttactgctgaactctaatctaaatggtaaatcatggatgctgaaaatgtcacttccaccattccttggaagtgcatatgctcaatccttcacaagctgtgttttagctgtttggctgtcgtttaaagttctgctgcacaggattagcacttctcatttgcatggttagcagccttttggggaggaaatataatgagtagcacttattaatctgttatacatggggatctgtgaacccaagcatactcttagtggtcacaagcaaaacatgttcacaaatgaaggagaaattaccatgggttctatatagttgttggcaagtgatgcatggagaggaagtgaaccctttgattaaattactgttgccctttgactcttgtttcttcctcatgccattgtgattcactgaatcktcacctaaaatataagcagagcaatgagaaagttggcaattcatagatataatgctaatgaaatcaggcacaactaacttgctctctgaaaatggtttccagaatattctctttttagaagtcatttgtagattcatgatgctttttgtagttagaagacaactaatattcaaatgcattttaattagtttcaggcagcagtggagagatttgtttattcctgtgcaggctactgtgtggcaacctttgttcttggaataggcgacagacacaatgacaatattatgatcaccgagacaggtgagtttatttagtgcagaataaacytttattgtggtaaaatatatataacataacatttactattttaactctaattaactgtaagtgttcagttcagtggcattacatatgttcaccttgttgtacaaccatcatcaccattcatccccagaatttttccatcttccccagctgaaactctgtacccattaaacactaactccccatgcctccctcctttcagaacggagtagtctttaaatggagtttaagactggagcacatatttagaagtcattgtgtagggacactggtgcttcagttactctagagcagtggcccccaacctctttggcaccaaggaccggcttcttggaagacaccttttccacggacaggggtgggggagcaaggatggtttcaggatcattcaagagcattacgtttattgcacacttttttttcaactcacttgccactataaagcctgccaccagatgcagctcaattttcacttgccactcactgagagggttttgatatgtaaggaattgatttattatggtctctgtgcagtgaaacctctctgctaatgttaatctgtatttacagccactgcccagtgctagcatcaccacctcagctccacctcagatcatcaggcattagattctcataaggggtgcacagtctagatctttctcgtgcacagttcacaatagggtttgtgttcctatgagaatctaatgctgcaactgatctgacaggaggtggagctcaggcagtaattcaggcaatggggagcagctgtaaatacagatgaagttgctcacttgcccatcgctcacctcctgctgtgtggcccagttcctaacaggccatggacctgtccatggcccaggggttggggacctctgctctagagagaccacctcacttgaggactaaggtgtgagtgaaggaggaagaggcaggaaatgagtcttaagaaggcaaagttagagggaccgctggaaaactaggagagggtcatatcccagaagctggcgaaggtgggagtgatcaccagtgacagatgttgcagagaaagaacagaaagaactcatagatatccttaaatctccctaacccactccactttagtggttcactgtccactctgacagtagtcagtagtggccaccaaagcatgagatttttctctatgaatttgggccattttaagagtagagtctggaaaaggcatcagatggggacagattgcttacttcctatgagaattaaaagagataatatatttatggacaatagaaatgataaagggctaaacaaataagatgatgattattgtggtggtgatagtagtagtggtagaaattgacccaaaggagactcaaaatgatttgcttctatcatgctgcccaagtttctgagatcagatgagcttagatacattcaggatggtatggccgtagatggctactcaaaaggaaaaggtgaataacccctgcccccaagcagagtgaaacatcagtctatcctgagttgcgtaaagagcataagagagtcttagggataatgatgacatagtggccagagagtttgatttatgtttctaagaataattttgagatgagaatcttatagtggcatctggctgtcatctaaagaacaccagaaggatatcaaaaacatacttggttcaaagaatgttttgtggctacgactttcacacacctgctaagacgaaaaatatcacaaactgacaaacattgtaaaaaatgctttcaacacaagatagctcatttttaggcaactcaaagaaatattttaaggaacaaagtgctgtgccactgtaatgatgtcagatactttcttctcttaaggaaacctatttcatattgacttcgggcacattcttgggaattacaaaagtttcctgggcattaataaagagagagtgccatttgtgctaacccctgacttcctctttgtgatgggaacttctggaaagaagacaagcccacacttccagaaatttcaggtaagtcacctccttcatcgcctgctgagaatagcaccgaagcagatggttcctgcagcactccgcagccttcacctctcactcagcttggaggccagtccagcctctacccctaccctcttctggcatggccaaccctacctcctccctttcacttccattcattcctttcccaggtgcaaaatgacacttctcagtaatcctcccacctaaaaccaaacagaagtagaaatatttcataagcagtgggatgggcaaatgtggaacaccaggatgatgctggcactaaagagggctttcaggaagggtgtctgctgagcaggttagccactagatatttgtctattcaagaccttagctagaagactcaaattttacacatatttttcagaactcacaaaaggttgtgagcttctcttggtttttgctacaggtgaattctcgatgtgccaactgggcttatctcatttttataaggcagaatacccaatatttcatttgaaatcttgttggtttgaccacaagttctactaagacctctagcttttcctgcttacctgtaaacaagctcctacatgagtctgtccatctccctgagagtgtgtagatcaggggagtccaatcttttggcttccctgggccacattggaagaattgtcttgggcaacacataaaatacactagatagctgatgatctaaaaaaaaaaatcacaaaaaagcctcacagtgttttaagaaagtttatgaatttgtgttgggccacattaaaagccatcctgggctacattcgggttggatgagcttggcgtagattctactggctttccattccttcctggtctgtatccagttttgactatcaaatacttcaaataccaaagagaattaaatactggcaaaattaataacttaatgaacataattcataacagttgtaactactactgtaatatacctatgttatagcaatacaaacacaaaacaaagacaaggaataattacttttatgtacatttgccttgggtgccctttaaatagccacctcccttagtacatcttaaacatgatttgctttgcattgcacatctcagacttgctctcttttccctgagtctcttcttgagtccaaggttacccttgggagacgacatgacccttgaagttcagtagaacaggaagtaggatacattgttttgaaacctgtctgttcttgtttgttctcctgactgattttcaatttggtgattacaagacttaccctcccacagttccagtggtgttgtcagagaaactgagatctctgtggccagatggtcttgtgattttttagtgtgtgtttttctgcataaactcaattgagtttcaggctatttccagggacttgacacatttcagtcctgtttttctttaaagttaaaaatcacatgttttgacaacttcctggaacagagaaatggttccaaaaaaaaagaaarccctggaagaatttcaccatttaaaggggggaaaacactcatgtcttctctcctgtcagyggggttcatctgtttgtctgtttgcttcggacaaacagagcagcaatgaactgcaacttaaagatcagacatacgcaaggaatttggcctcattgacgactctccttttttttttttttttttttttttttgagacggagtcttccctgtcacccaggctagagtacagtggcatgatctcagctcactgcagcctccacctcccaggttcaagcaattctcctgcctcagcctccagagtagctgggactacacgtccgygccaccatgcctggctaatttttgtatttttagtagagacagggtttcaccatgttggccaggatggtctctatctctcgaccttgtgatccgcctgcctcggcctcccaaagtgctaggattacaggcgtgagccactgtgcccagccgactctccttctttttgtatatatgttatcttcctttttgccagtaatttttcctagaatgactgcacatctgtcctgttgctgacaacattcccatagaccccctggtgcccatatcaccccgtcagatcycagcagtacttctctttttttgctgttgttgctatttttaagtttcaaaatatgctttcacaaaaaggtttgcagtatagggaggccaaggagaggtttcttcccactatcggcatcttccacccaaagcaacaaacctttgcggtgaggctttgtgcagtctgtcctctcagtctggagtatttctccatccttagtgaccaaagtttgtttctcaagccattaaaaccttttttactaaagcaacgtttaggcagtgtgctccactaaaaacacacttttgtacatttgttgtacttgtgtgtgtccgtgttttggagtactgttaaacatacgtgttaagcatacatgttaaatgcctgtgaatctgtgcacgttgagccttaagcacacatacagcataacaaggtggttgaaaggatgggctttgtagyggagaaacttgagtttgaatgctggacctgcgacttaataaccacatatatgattattattcatcctttcataacatcagtttcttcatctgtaaagtgggaataataagacctacttcctgtgctttttctagggattacttaaatgaaatattcagaatgcttagcccagtgcctagatcatagcagaaaatcaataaatggtagccgccattgttgtagtcatcacagtgtgtcttcaaactttgaaaacttttaagttgagaaaccatttttgaaatgagatctcaggtaatatataaaacaaagtagcatgctctgcttacagagtaagtggggttccaactccacttacacctgttctgcttccccttccccaacccctctctgcttactctctccctgtgttccctcatccttcacaacaggaaaaaaacctgaacaccacagctttaacatacatatatgcagaatttccaaagtttacagcatgacaaagatggacagcagagtttttcatcatttgactatgaccttgtggtaatttttttttcttttacatactgctaagccttccaaaaagattttctgtttcttggttttatgttttcttttagaattgaagttcttcaagatcagggaccacatctctaaattctccaaataatgtctcagaatcttgtataataaaggctgccatttttagggaagctgggaaatgttgtatacatttgcattttgaattaaaggtgtcctcatttccagtgaatcacttattttgaattgataaggttaactaatacatgctgcgtatttgaataacctgttaggaacaatggagaaaaattgacccacttttttgttaagggtggggtgagcctggtccacaaagaaaaacatacctaactagtggcttgagcatggaagtaagaggaactgaaataagctctactgcatcccacctctctgcttcccaagggagctactttagcctaggaccatagtcacacttacttctagaataggggagagttcaggaacaagctataattagatagagaaacacaaaaccaaggcccagcgtttgaacccaggagtatctattagccattggagcagcatcctacaaacaggtgctaaacaaacacatttcaatggtgacaattttgataaattctccacagaaaaatctcccttatgggaggaataaaaaagaaaagtgtttttactcattggtaatttattctagaccatgttattttaaatttcactgaacagttatagaatatatataataaacaaatgtatttatatcattggcaaatgaaatttggcttctaagttttttaaatgtcagaatgtgttttttattgttctcgttgttttgttttgtttgagacggagtctctctctgttgcccaggctggaatgcagtggtgtgatctcggctcactgcaacctctgcctcctgggttcacaccactctcctgcctcagccttccaagtagctgggactacaggcgcctgccaccacatccagctaatttttcatatttttagtagagacggggtttcaccgtgttaaccaggatggtctcaatctcctgacctcgtgatcyggctgcctcagcctcccaaagtgctgggactacaggcgtgagccagcgtgcccagcccygaatgtgttgttttttaaaattttaaaactagtaaatgttgtttattaaaatcaagagccagcaaaatattgaaaataccaaaagacataaaaattcattatcctgctttccaaagataatactgtcaacatgttagtttctagaagattgtaaattaatcagcatttgcttaaaaactgaacttaagaaatagatatgttcgtctcttcaaattgagtaaggctgattaacatccatgagatggtagtttgtcattctgaataaaatctaaatatccaggcttggcctgctaggccctgtgtgaggctgtccctccagcctcatgccacactgttcccctcatctgctccctcatcactgtggccttcctccacatcttcccccatcccagctacccactgctttcttcccagaatgctctgtgctgccctgtggtctcagcataaatgtcattctgcagagcagttttctaaatcaggttccctcctgttaccctttgccacagtcccctgccaggtccttcattgcatgtatcacaaaatacatttatttgtactggttttctgtttgtctttccctatcccaactgtgagctctgtgcagcagggccacatgtgtcctgtgtccctcacaaggggctgagccacggtaagcactcagtaggtgtttgctgagtggagtagtggagggacagcaccttgtaggggaggagctggatcaaactggataacctctggggtgtcttccttccatatcatacattgtattctgtgagtttcacaataactcaggcccagattgacagaccatcatcacatggaaggtaataagccttcaggaggcaggttaacatgcgtacattggatgaggaactaaatccaactgtgaaatctaatgtttcattaaataatacaaatatgtgagtgtaatatggtacatattcacatttttgtagagatttccttattgacataaatcttacatatttctttccagtcagagctgtaccttttgccaagagaacagggcatggagtatatacacatagtgtacattcaatacaggacagtggataaagggcaggaacaactcgttcttttataaacaagcattttggagatgctctgtgcacacagtaggcaccaagcaaatctgaagtcatcaggggagccaaataacacatctacagacaaatctatgcaaagcaggtcgtttgaggactgtctttaaaaggcacttgcccctagatgtcactcttaagaagcattttataggagaaaagtctggagcccattcgttgtgttattttaatctaggatgactgtggaaattttcttgccagttttatcaggcccaccctgtttccagttccgcagtcttatccccatgccagcgtatacccaagcctccaacctggaggctcagccacatgcccagtctctatgcagggtcctgactcaggaggttttyaagaacctttattcaaccagagtccatctcttctgtggtctagctctactcttgggtcccacattgttttaactgcttctgtttcagtttctccaccagaggtctctctgtttgttacccagctgctagaactagggccctaatccctcctgtcatttttcttgctggagacttgagtattctcccaagcccagccacagggaccacagagaccttgtratctgacattcttccaagggctgcagccatctcagcatcatttccggtcactattctctacctccccttcctttgtgtgataaccctcatccttgtctatacttataacctgctaggctggattttctcagcctcctgctctagcctgttatagttaccaggccttattcaccatatccaaaataggacactaattcaacgcacactgactaaatacatactacagtttaggcaccgtgccaggcataaagaaggatcaggtactgcctttggcaaggcaagatattttcccagtttggyccctttcaaatacagttgttccctaattcatcctgattttaaagtagtgaatcttgtccaatattgaacttggcttctgaacattaagcattcatccatcttatatatgcagattatctgtagtgtatcagacactgcattgggcataggtgagacaatagagcatggccccagaacatggcaagaaagctacttacacaactttgtgccaagaaataccttgtgctaagagtgtccacagtggtttgcagagggagcaattaatcctgccctagaggatagaaaagggctattcagagaagcatgtgtttttctcaggccttaagggatgaattcagtttcatttttccaggcagatacagggaagggagggaacatccagacagaaagaacagcacgagcaagtgcatgaagttagaaaagtacatacaatcagtatttaggaacaagaagtatatttacctggtatggatagaaagtggtatttctggaagtgtgtagtagaatttgagtcaagaaaggaaatttgggtccaacttgaagcagtacataggctggattagagaggtggagggtagagcaaagcaaagaagtcatttggagctcattcgattaatcacaaataaccataattaaggtctattataggtcaagcaggagatgaccagttcatctgtcacccataatgtactgagctgataaaggattccgtcttgggatctgcaccccgacccactgactaggccaggctcaggctcccctgtctcagtgtgaagactttcagtactcactatctctccatgttatgcactggaagatatcctcaaagaagggtctgatttcagccatttgtaggagtttgaatatgttggtgtgatatctcccccatatgcagacttgtgcggcttgtcaaactgttaggactttattaagcttgtcaaatttaaattactattctggaaaagatacgaatccaaaactggaaagataataaccttttaattgacatcattctctcaatatttagtttctttcagaacattttgtctaacatagaatattgtcagggacattgtttaccatattacaaaacatactctctctattaagatcttcttgtgaaaattctactggtctcagtttctagaaaagctgtgcttctcctaaatagagatgttttcttttaaattttctgaacattgactacagttaacagattatgtccttttagctagagatatatttgaagacttcctatagcaagtactgtcatgcattgcttaacagtggggatacatacagagaaatgcatcattaggcaatttcgtcattgtgtaaacatcagagtgaacttacacaaacctaggtggtagtcttccacacacctaggctatatgatatagcctattgctcccaggctccaaacctgtacagcatgttacttactgaatactgtaggcagttgtgacacaatgttatgcacttgtgtatctaaacacatctgaacggaaaaggaacagtaaaaatatggaattataatcttatgaaacaactatgatagatgcagtccatggttgaccaaaacattgttatgcagtacatgactgtatataggacttgtgatgtacagttttaaattagcctccttccccaacccattgtggattgtttcctttccttttttcagccaattctaactaatgctattttgacttttgtatctccaaatagtccaccttaaatcctttttggaacaaggctgaaggataaatcacacacacacacacagacacacacacacacccctacgtgcacgctatcagaatattgactaaagtagaatagcttattgtagcatttaggtttctaatgtgcttctagctaaatattcgagaagatgacagtacagcccttctcctggtaaacagagctagtctgagaatcacttttcaagtacttacagataaaaatcytaattcaaactcatcaaatgcatggccaagtaccagacacactcctcttttggatttaccagaaagtgtgctctcatgcactgttaggtctaataatcagtgaccttctctgttttgccaaaataattcctaaagactggctagccaatgcattgatttttattaaaaaaacaaaayaacaaaataaaattctctgcctttgactggaatgatttttatccattgtctccttcctctagcagacagaggcaacattactatttaggaaaagtaagtggaggttccacttcatttctagatgaaaatggaggattttgatgttaagtatttcatgtgacctcagacagtctgtagcagccacagctcatcagtggttaataaattagtagattgtatataaaagtagtttgttttcagtttagtgaactgatagttggggcagttagcaaatcaagtaaaagtttgggccctgaaatgataatgaattcctttgttcccaagacttctaagggcagtagctttgtaaaaacaattctttctgttagtactagatgctataattaaggcatttgaatcaacaatgaaattgagagcagatgtactacgtaggctcaatctatttattagctactaatggagaatgttctagctaatggcattaataataatgtaatgttccccacatttgtagtcattaacaagtgcattaaaccaagtcctcgaagtcagatttttcccttactcttcttctctcaataatacaaatccttcaacagtcagttgagaaggagagaatgaggatgtttgaggtcaaggagaggcagccctggcagaagggaaaattacagccagtaacttctgtgttctgtgttttcccctgagctccccaggccacatcctcatagtccctgaaaccacaggcctctaggccaaggtagtgtcagaacactcccacagaccctgtggctgagtccaaaaggcagaaatgaaacttctgggactgagcgggcagggcaggtgctcggctgtgccccccagggtgagagaaccacctgcaggaagccagtgttgctgtatgcttccatcctgcccacctcagtgggccagcaccatgacagcctccctttgacactggttggagtgaggcttatccccaactccaacctacctcaccccctaggcctttactaagagaccttgtgggcagatggtctagagggacagtgagccccttagcgttgaacagtatgtgtattcaataatgcagctcctcgtggtattgattagtaatcatagccaactacttatgtagcacttaaatctcaccacaacaacatgaaatgggtatcattcttattattcttaatctatatttaaaagaggttaagtgacttctccagtgatatatagtttaccagtaataaagccaaaattagaattcattcagcttgatgtgaatctgtgttgttaaccaccacagcacactgcctttcagcaaaggctgattaaagctgcaccaagtctctaagtgtgtacagcccatcagaatctcgacactgtgtttgacaagcatgggacgtgcagttaaactggggaagaaatttctttctcatagaagagatccttgtgtgtgaaaattagaactatctgaataaattagaatcaacagaaattctttatgtgagtgaaatagccttcgagaaaagcaggacagttatttcctttaacgcctctccttgggtacrgcagggataggtgaattcctgcatcactgcttaacaagtatttactgagcaccagtggattggtgttataataacttggcctcaggttaatttccctccttgaaaatgttctattaaaaagagtttgaccacacagtgggctcacacagcaggggatttatgtggatcccccagtgtatggaaggacagaaaataattaaaaatcagaatgtactctaattcaaaaccaaaaggcgtccccatctatgtccttgtgaaaattgtgcaagttggcaaattaatgaggctgttgcctggggtgaagtctgcacttagcctgtataattactaagaaatgagagagacctcagtgggtcctacggatgagcaaaagaaaataatttccggacataagtggagtcattaagaatgcaagagcactaatgcactggggccacttccaggggacaagtgatggctgggcagcagcagcaacagcccacacaagtctcccgcttcttggtgaacagggaggaaatgcagaggggatggtaggcaagggagaggactgacgtttattgagccttcactatgtaccggcctccatgctgggcgctttatgtatattgtctcacttagaaaatgccagaatattccatgggttttgtattgcttaggatgatgtgtaccctgcccagccttgacatacagaatgacacaagcctgacctcaattatcattgcagttaccctaccacacacaaatgtcacagacaatatcagctaaaagcaaaagaaaactcactattaatattttgtcctataaatttatattcttttttctatataaatattttgtgttaatttaccaaaatgggatgcattgttttatacctacctcttaaacacttttacatgtttattaaatatccttctacagtatctttctagtagttccaggacatgcaattttaagtactttttgtgaatctttttttatcagtcccctattgtaggacattattaatagattgctttcaagtttccacaattttaaaccatgttctaatgaacatccttatagataaatcactgcaaaattattcagtatttttaaagatagattcctagcatggaagttgctgggtaaaaggatatagatgtttttaaagccaggtttattgaggtatgttttacatagagtaaaaatcaccctttcttttatttttggctgggggtacatgtgaaagtttgttacataggtaaacacatgtcacaggggtttgttgtacacatcatttcgtcacccaggcattaagcccagtacccaatagttatcttttttgctcctctccctcctctcattctctcccctcaagtagatcccagtgtctgttgtttccttccttgtgttcataagttcttatcatttagctcccacttataagagagaacatgcagtatttggatttctgtctctgcattagtttgctaaagataatagcccccagctccatccatgttcccgcaaaagacatgatctcattcttttttatggctgcatagtattccatggtgtatatgtaccacattttctttaatcagcctatcattgatgggcgtttaggttgattctgtgtctttgctattgtgaatagtgctgcagtgaatatttctgtacatgcgtttttatggtagaatgatttctattcctctgggtatatacccagtaatgggatttctggatcaaaatggtagtcatgcttttagctctttgaagaatcgccacattgctttccacaatggttgaactaatttacactaccaccaacaatgtataagtgttcctttttctccacaacctcgccagcatctgttactttttgactttttagtaatagccattctgagtggtgggagatggtatctcattgtgcttttgatttgcatttctctaatgatcaatgatgttaagcttttttcatatgcttattggctgcatgtatgtcttcttttgagaagtatctgtttgagtcctttgcccacttcttaatgggattgtttttctcttgtaaatttgtttaagttctttatagatgctggatattagacctttgtcagatgcatagtttgtaaatattttctcccattctgtaggttgtctgttcactctcttgataatttattttgctgtgcagaagctcttaagtttaattagatcccacttgtcaatttttccttttgttgcagttgcttttggtgtctttgtcatgaaatctttgcccattcctacaaccagcatggtattgcctaggttgtcttccaggatttttatagttttgggttttacatgtaagtctttaatccaacttgagttgatgtttgtatatggtataaagaaggggtccagcttcaatcttctgcatatggctagccagttatcccagcaccatttgttaaatagggagtcttttccttgttgcttgtttttgacagctttgtcaaagattagacagtcatagatgtgtggccttatttctgggctctctgttttgctcctttggtctctgtgcctgtttttgtaccattaccatgctgtttttgtagccttgtaatatagtttaaagtcaggtaatatgatgcctccagatttgttctttttgcttaggattgccttggctatttgggctcttttttggttctatatgaattttaaaatagttttttctagttctgtgaagaatgtcatttgtaatttgatagaaatagcattgaattcctttgggcagtatagccattttaatgatattgactcttcctatccatgagcatggtatgtttttccatttgttggtgtcttctctgatttcttagagcagtgttttataattctcattgtagagatctttcacctccctggttggctatatccctaggtattttattctttttgtggcaattgtgaacgggattgcctttctgatttggctcttggtttggctgttgttggtgtataggaatgcgtgattttttacactgattttggatcctacaactttgctgaagttgtttatcagctggaggagcttttaggcagagactatggggttttctagatataaaatcatgtcatctgcaaacaaagatagtttgacttcctttcttcctatttagatgttctttatttcttcctcttgcctgattgctctggccaggacttccaatactatgttgaatagaagtggtgagagaggggttccttgtcttgtgccagttttcaaggggaatgcttccagcttttgcccattcagtataatgttggctgtgggtttgtcataaatggctctcattattttgagatatgttccttcaatacctagtttattgagagtttttaacatgaaagggtgttgaattttatcgaaaggcttttctgtgtctatggagataatcatgtggtttttgtctttagttctttgtatgtgagaatcacatttattgatttgcgtatgttgaaccaaccttacatcctggggatgaaacctacttgatcatggkggattagctttttgatgtgctgctggatttggtttgcaagtatttgaagatttttgtattgatgttcaccaaggatattggcctgaagttttcttttttgtgtgtttctgccaggttttggtatcaagatgatgctgctctcatagaacgagttggggaggagtccctcctcaattttttagaatagcttatataggaagggtaccagctcttctttgtacatctggtagaattcagctgtgaattgatcaggtcttgggcttttttttggttggtaggctatttattactgattcaattttggagctcattattggtctgttcagggaatcagtttcttcctggctcagtcttgggagggtgtatgtgtccaggaatgtatccatctcttctaggttttctagtttgtgtgcatatttgtagtagtttctgatggttgtttttatttctgtggggtcagtaataacattcccttcttcatttttaattgtgtttatttggattatatatatatttaggctactttatatatatattaaggatagttaagtcttcttgttgaattgaacccattaccattatgtaatgccattctttgtcttttttgatctttgttagtttgaaatctgttttgtcttaaattaggacaaacccctgctttttttctgttttctatttgcttggtatattttcctccatccctttattttgagcctatgagtgtcattacgcatgagatgggtctcttaaagacagcattaccattgggtcttgcttttttattcaacttgccactttgtcttttaagtggggcattttgcccatttacattcaaggtcagtattgatatgtatggatttgatcctgtcattgtgctattagccggttactatgttagcttgtttgtgtggttgctttacagtgacactggtctgtgtgtttaagtgtggttttgtattagctgatagcagtctttcctttctatatttagtgttcctttcaaggtctcttgtaaggcaggtctggtgggaatgaattccctcaacatttgcttatctgaaaaggatcttaagtctccttcacttaggaagcttagtttgtctggatatgaaattcttggttgaagatttttttctttaagaatgttgaatataggccccaaatctcttctggcttgtagggtttcagtggagaggtccgctgttagcctgatggggttcccttgtaggttacctgccctttctctctagctacctttaacattctttccttcatttcgaccttggaaaatctgatgattatgtatcttggggatgatcttcttgtgtagaatcttgcagttctctgtatttcctgaatttgactgtcagcttctttagcaagcttgggaaagttttcatggatgatgtcctgaaatgtgtttccaagttgtttgctttatcctcctccctttcagggatgccagtgattcgtagatttggcctttttacataatcccatacttctcagtggttttttttttcatttcttttttttcttttttctttatttttgtctgactgtcttatttcagagaaccagtcttcaagttctgagattcttttctcagcttggcttattctgctattaatacttgtgattaaattgtgaaattcttatattgtgttattcagctctgtcagacccattaggttcatttttataccagctatttcattcttcagttcctgcatcactttattgtgattcttattttccttggattgggttttgccatcctcctgaatctcaatgatctttgttcctgtccatattctgaattctgtgtctgtcattccagccagttcagcctggttaagaactcttgttggagaactggtgtggttgtttggaggacatatgacaatttggccatttgagtcacgagagttcttgtgttggtcctttctcatctctgcatgtgggtgctcctttaaccagttgtagattgagaacagtcaacagaattcttttctggatgttttcaccaggccaaggctttgtgcagggtctttatttgaagctgacttcttgtccctggtttcagagggaggtatgttagtgaggtatttttggtgttgaagctttggggtatgatccagcaggtggcacttaggcttattggtcggttggtagactcttgcttggttgtgtggctcccccatgttaactcmcagttgcagccatgttctctctcaatgctctgaaagtgtgggtttctctcccccttgagtgctgtctgtagatcatgacttggcactcctcggatgcccactgcagctcttgtgtaatctcagtgtttatgttcctttcccaacttggaggcagcagaggaagggactttggtattggttgtggccaagggtcatttgcttgtcacctggggactccaccccagagagatgcaggtcagcagtggctcagtgcaagcagcccaggatggagagtctgtgctgtgggcccaagccaggggtttcctgtcttgtgtcaagcaatgcggggggtgtgtgggatgcacgggagacacactggcctcctctccttgggtcagctgcagcttgctggaggtgtaaaatcaccctttctaggtgtacagttctgtgaattttgacaaatgcatcagtcatgtaaccaccatcacaattaagttatataacatttataagcactttaaagcttttgatgcatgttaatcaaattacctgctggtaacattatatgtattcctatctaccatcagcttataaaatgtgaacattgggtattgtccttaaaagactaaaaaaaaaaaagtccagtttttaggtaaattttccatctcattttaagttactttttttaatattaatgaagttgcattttttttgtaggtttatctgtttttatgtcttacagtgtgaatttttgttatgtttttggcctgtatttctggccaattatctctttcttattgatttttaagaactattagggggctggggttgaaagagtgatctgtcatgtcgcaaatacattttcttttgtcattaagccacttttaatattatgtatagctttttttctctcaaaagttttaagttcctgtagtctcaccatcttttcctcatagagtccaccatggaagtcatcttcataaagtcctttcccactccatgattatttaaatgttttccctttttaaatttaattcatctggaatttatttttggtatatcacatggagtagaattttattttctcccccaaatgatgagccacttgtcctggtcccatttatcaaataatagatcttttccccaccaatttgaaaagccacctgtattatatatcatatttatatacttaagtatgtctctgaactttcccttctgttccacaaaattccttgtctttttgggagaagactacttactggttcgcactgtttttaataatgtagttttataaaatggtttaatatctggtttggcaagtactacttttcattattatactttttcaaaatgttctctcaggccctaattatttcagatgaactttaaaccatatctgagtttaaacacccaataagaatttgtattgaaattttatgtttatagattaatctaagaataatttatatcattataagcagtcttgtcactgagggatgttcaaaaactgactcattgctcttcagagattaaagttttataattttttaagagtataaaaattataaattataaaaattataaaagcataggttctacatgttttatgtgttcatcctaggaatcatgttattgttgttaccattgattttagcatctgtttttgcattttactttccaacttgtggatcctatttacagcattctatttattaatttttataaaaacctagtttattaaaaactasttacagtaatatttgattttttaaagacaattaggtcatttgtaaataataagttttccttcacttttctgattttattttatttatttatttatttatttatttagagacagagtctcactctgttgcctactttggagtgcagtggagtgatctcagctcactgcaacctctacctcccaggttcaagcaattctcttgcctcagcctcctgagtaactgggattacagacacatgccaccacacccagctaatttttttgtatttttagtagagacggggtttcatcatgttggccaggctggtcttgaactcctaacctcaagtgatccacccaccttggcctcccaaagtgctaggattacaggtgtgagccaccgcaccaggcccacttttctgatttcatacttcacttctttttctggtatttcattatttagaattatttttataatttcaaataattcttcacattgtcatattttaatgacatatgaagtaatatattttttaaatcaaaaatagatgttaatgcagtaccttatggtgaattaatccctcagctttagaataaaccttatttggctatggtgtattaatcttttaacattatgctcaatatttattatttgaaatatatatataatcactaactttagttttctttaatatactatctttgtcaagttatggtattaaggttggattattctcatgttgtaaaattgagactcttgcatttttctatgctttggaacaatttaaatggcataaccatacctgttgcttaataagcagacttagctcacctgtatcacctgctccaaagctttttgggggaccatgagccatagcattttttaaagccctctctctcactcagtgttcagaatttgtattaaaatttcaaagttcatttaacaattttgattatcagagtgaaaagctaatgcatctgttttcttagacttgaacagagtataaaataaagatgaaaactaaatctcaaacacatttccatcagtgctttggatttcattagttcttggcaaacattatttacacttacataaagtttattgattccagtatgatgttcaaaagctgactcrttgctcttcagaaattacagaaatgtctaccctcaatctcttgggaaagaaactgaattaaaaaggtagagtaagaaataagctgaaacttgtctgtatcaattagttttccttgagcactccctggatatatgcaactacacggaagtatttaagagattataaaaacagtttctcatcaagtttttcatctgaggcagggaccttgatggtttcttctcatggacaggtaactctatgtacatttcagtacatccctgtaatcttcagcctacttgttagttaccataacaacagtaacagcattttcttcttctttatccaggacatctgtgttaaggcttatctagcccttcgtcatcacacaaacctactgatcatcctgttctccatgatgctgatgacaggaatgccccagttaacaagcaaagaagacattgaatatatccgggatgccctcacagtggggaaaaatgaggaggatgctaaaaagtattttcttgatcagatcgaagtttgcagagacaaaggatggactgtgcagtttaattggtttctacatcttgttcttggcatcaaacaaggagagaaacattcagcctaatactttaggctagaatcaaraacaagttagtgttctrtggtttaaattagcatagcaatcatcgaacttggatttcaaatgcaatagacattgtgaaagctggcatttcagaagtatagctcttttcctacctgaactcttccctggagaaaagatgttggcattgctgattgtttggttaagcaatgtccagtgctaggattatttgcaggtttggttttttctcatttgtctgtggcattggagaatattctyggtttaaacagactaatgacttccttattgtccctgatattttgactatcttactattgagtgcttctggaaattctttggaataattgatgacatctattttcatctgggtttagtctcaattttggttatctttgtgttcctcaagctctttaaagaaaaagatgtaatcgttgtaacctttgtctcattccttaaatgatgcttccaaacatckccttagtgtctgcaggtgttagtggtgtgctaaaagcaaggaaagcgagttagtcttttcagtgtcttttgcarttcaattcttttgtcatgtataactgagacacacaaacacagcaggagaaatctaaaccgttgtgccttgaccttcctctgctggtcttgttccagggttatgaatatgaaaaaatagagatgagactttttgtgtcaactctgtccacaagagtgagttatctagtatgattagtatagctttctccagcatggcagcaggaagtaactacagggcctcttttatgcctgacatttcttcccttcctttttccctgcctccctttttcatcaattgcratgctcccacaactctttacagacttgtgaaatcttcaagaacacctttactctataactcaaaaattagttgaaaaataattacttctcaaggattattagaatcttaggtacttatttgtaaagatgtttagtgacttttttttcaagtatcttattaaaggaggcattctagaaaatatgaattagtttccaaatgccttaattttaaactttggcctgaacagttttttctttttcttaatggaagaagatatttaatatcttaaaaatattccaagttaggaagaacactacttgccttatccatttcccatttaaaggacttttaaactttgacacatccttcagatttcctgaaaatmmttgaaatatcttactttaaaaatattttcatctctgaaatatctcgttatttattggaggtattgtttaaccttagakagaccattaaattatttataaaatattttgtaattacctgtagctaatacattacatagaaaaaaactatgttaacagtgtctctgtttaagtataatcagatataaatatatacttaattttttaattttaaaaatagatacctgtttgactttgaggtagtccagrccttttctytttttttttttttttaatgkgtgcaaaagcccaaaggttcctaagcctggctgcaaagaagaatcaacagggacactttttaaaaacactcttatcagcctgggcaacacagtgagactccatctcttaaaaaaaaaattagctgggtatagtggtatgtgcctgtagtcccaggtactcaggaggctgasgcaggaggattgcctgagcccaggaggtggaaactgcagagagtcatgatcatgtccttacactccagcctggataacagagcgagaccctgtctcaaaaaaataaaataaaaaataaaaacacccttgcctgcgctccattcccaggttataatttaattactgtgggatgagacccagacatcaatatttttctagattcttcaggtgattctaattcacagccagagttggaagccctgcgtggcctttgaaggtctagatgattcttcttccttgccctttgagcttttccccatctcacaggtatctagaaaaaaactcctcttctttggcaacctgtccttttaaaatcacactctacccacctgtacagaagaccatgccctataatgaaatgtttattcctatctataaatggaggataaacattttgtggcacttctggaccaactattccctactattcttttgaagaaaggcaggaagagtactttctaattcagaagaggatgttttcactattctgataaacaatagccaagttcagaccttgtacagattctttttatttgaattgctgaaataatttattgatgatgaaaaaaagattagagaggaatacatttatatttagcttattggcacatgtgcatacatatttcctcttcaaatgaaccagttctttcatttcattatgctaatatatatatataacatatatatgctaatatatatataacatatatatgctaatatatataaacatatatatgctaatatatatatatcacacatatatatcacagttttatatatatatatgtatgtgtgtgtgtatatatatatatatatatcacagttgggcttgattcttccgtattccaaagagcataatttcagttctatagacttatagataaataaaaatcatctttgtgggcttccttcctttactgttcgcagtgaattacatgacgaacaacttctatacctttgaaaatgttctagaactagaatcatcctgctactgggaactacccacagctctatcttcaatgccaggtgaaaacacagatcacaagtcagatgaatcaggccaaagcaacttttatgtatatctaggactggcgacataatttgcagagcccagtgaacagtgaaaatgcagtcccatcattcaaaaattattaagaaattcgagatggcaacagcagttgtcacaccaagcacagtgcccttctgagcatgaggctctgtgtgactgcatgggtccatgagaccagcactgtgtgggtctgaatgatggctttggtgttcagtttagcacacgcggtctaccacgtctgcatgagtggtaaatgtagtgcctgggtcaaaatgttccttctgttcaaatcgaaatacctcatctctatggctctatggctgtacattaggacctagaacagtggcccattgctcttagactggaaccatgtccactaaaataaacctaagcagatgttgtagacctagccccacaggactgcatttagctgcttcagtgacactttgatgaaagtatggagaagtggagacattatagataaaatatatcaattcccagagaaaactcttgacttaaaaacttaactgtagtaaatatatctttttcaggtgatgaattatttttttaaaaaaggttacatataggaattctgcagtataatttggaggctattagtgctatattaatggaaattaattattttttaagtaagtccaaaaaataatctagaaagtaagtttccagagcaaatctgacctagcatttggtatgctaggctctgcttttcatgattttgaaataaatcataattagacttaacaatatggagaaaataaacttgtatttttaagtgttctgttggcttattttctgtttcatccaactcaataattctgataaataaatttggttctagtttggtgcttgtctgcatagtctcaaagattcatttcaggacagctatctggggaacaaaaaacacacaccttggccaggcatggtggctcatgcctgtaatcccagcactttgggaggccaagatgggcggatcacttgagcccaggagttgtagaccagcctgggaaacaacatggtgaaatactgtacaaaaaatctctacaaaaaatacaaaaattagccaggtgtagtggcacatgcctgtagtcctgggtactcaggaggctgaagtgggaggattgcttgagcccagagggtcgacgctggagtgaggcatgattatgccactacactccagcctgggcaacagagcaagaccctgtctcaaaagaaaaaaaatcactattgagggcccaccacctaccagacactgcactaagtactggggattcaaatacggagcaagattgacctagtcccagtctttaccatgtttataatatgttagcgatagctgatacttcataatgggtgcatgtttgttgtgggttgaactttgtcccccaaaaagatatgttgaagtctcaaccctggtgcctgtgaatgtaaccttatttggaaatagtttccaaataaggttataacagatataatcaagttaaggcaaagttatgagagtggccccaacccaagtaacatccaaggtgagtaccatgtgatggaggcagagatgcatctacaagccagggaacaacctggggcaactagcagctggaaaaggcaaggaaggatccgcccctagaagcctccaagggctcatgccctgccagtgctttgattttggacttctagcctctggaagtaaaagaatatgtttctattgttttaagccaccagtttgtggcactttgttatggatctctagggaactaaaatagtgtcagtacccaaaaattttgtggaggcttttattttttagtagggggatcacagagtttatgtaaatacatctcttttctgctgttaacaaaaagatttaattgcatgcaaaatatgtgaagggctaatattcttaatatataaaaaggtctaataattcaataagtaaaagataaataccttatcaaaaaataattcacaagaaaagaaatatgtgtggccaataaacatatgacagcagaccccaagtcatgattgattaaacaaatgcaaattaaagtaagtttattttccctatcagcttagtaaagactggtaaagtccagagtgagtactaattttagagaaagggcactctatcaaactgttgaaagcagtgcaagttgggaaattcatgcatggcattttgacaaaacatcaaaatcaaggtatctattctctgacccagcaagtccacatttaagaatttatcctttagaaattattgcacaagtgtgggaagacttatggtcaaaaataagttgtcaacattctttataataaccaaatttcaaaatagcctaaaagtccttcagtaggagactgaaattacattgaaattacatccatacagtggactcacaatgaagcctttgaaaagataaattagatcaaaatgtattgagatctatgtagatatctatgacatactgaggagtgaaaaaggtggttacaggactgtattatgctccgattatatttgagttaaaatgtaggcttatatatgcatgaaaaggctgggaggatgtatttacaccacactgttaatagtaattttttttttttgagatggagtctcactctgttgccaaggctggagtacagtggcactgtgtaggctcactggaatctccatttgggttcaagcaattatcctgcctcagcctcccgagtagctgggattacaggtgcccaccaccacgcctggttagtttctatatttttagtagagatggagtttcaccacattggccaggctagtcttgaacccctgaccttgggtgatccacccacctcagcctcccaaagtgctgggattacaggcgtgagccaccgtgcccagcaaatagtgattttttttcttttttacctcacatttatttttttccattgagttttaggaaatgactttatattatttgaatttataaggggaaaaagttatatcttttcattttgaaaaacaacacagtctgcataataattatatcctttagcttacatcatgactcatttaaagctcagaaaatttggtttctcaaaggaaaaaaaattatgtgaagtcaataattattaagtagtggcatcaaagctattgtcagaacttcttggtgtaaaaatgtccatgtaaaagtttcctgctttaccagccacacctggttttgatctgttgtactgctaaggctggccttgatttctcccctaaaatagcaatgcttttggagaagggcctctaaggatgttgtctattaatcagtgagggatgccttggctcgtgcagctcttctcagatctgcagacctcatgcagccagttggccatgcggagctctctagctcacatctgaggtcccccttggaggtgcagacagcctcattttcacttctcatgaatgtcagattcytttctaagcatttgctcattagtatgagtaaagctcattgcctgctgcttgggtaagaattttctctctggggctggactctgagtctgcatccataatgcacttggcatctgtcttggggaccgtaatggggcacagggatataccaaggaacacagagtccatttgcagcacctcagtggcgattctctacctctcacagcagatggacagccatctgagaagttttatactcggagaatcaaactcagaatcttttgattacacgtaaaagttaaaatgggtccttactacctggcagagatccacccatcattatcaccactgtgtgcaaggtctgtagctacacagcacctcccatcaccagatgtgtatggtggccaaagctatgctggtccccagcaccctccactctgcacctctcctttgcatcactaagcaccctgttctacaaaaacaacaacaacaacaataacaaaaacagaaaaaaaaaacagccctgttactactgagggcttcctccggtcaaatcccatggccacacatcactgccaaatccctgacctctcccaggatctgctctccccaatctatggttcagagaagacagttcctcatttttgaagcaactccttgctcaggcactacctgcttaaagtggcagggcacattctacaggctttcagcaggtagatggatttgattactttaatctgtgcagatttaaaggagtatgagactcgtgagatcctggagaaaactcagagtgagcatgtgtggctgtggacacaaggtgaccttaagccagcaattcggggataatctattttagagcctgagcaagacactgcaagggcagttaataggtaagatagaagtaaagagtggtttaggtggctttggcattagatcatttcaaattcaagtaccaattgtcacttgaacaagctgccaagtttcagccctctcctctgtaaactagggaggacagtatagtacctgctttacagaattactgtgctgattaattgaaataatgaaagtgaagcattaagtagaattctggccaagagttactgctcaataagtgatcactatcatttctatattctttttaaagaaggataaaaaatctcaagaaattaaagccaaaagttcaatggcatcacccttggagtgtgacttttaggagtactttaaatgatgaaaatcttaacaattttctaagtacagtatcttctcagtaggacttcaaaggaaaaataatttccattctctgtcaacatcagataccaaggaatcttctaaatagcaaccttctctgatgagttattctaatcaatgcaaattagttcctgggtctgggcttaaagaaaattagagaagctagaatcaattgacaatgctaccaactcccatttgctttttgaatcagctttatggaacattgcatgaataactttcaccaattttaaatgtagaatttgaggagttttaataaatacataaacccatgcacctaccactatgttcaagataaagaacaattccatcacgccagaaagttctctcatacctctttgcagccaattctaacccctaagaaccactgaattgctttctatcactatagttttgcattttctaggattttatataaatggaatcctacaatatgtggtcttttgtgcccagcttctttcacatagcataatgcttttgagattcatctatgttgcctaaataaaacataatttaggaaggctcagtttctggacagatttgctgcagttcattctagagccaaatgccaagtttcat

SEQ ID NO: 17581 - DNA, 241805 bp, Homo sapiens
  misc_feature (1)...(241805): n = A,T,C or G, or insertion/deletion polymorphism (see Tables 1-2)
tgaagaaagtcattggtagcttgatggggatggcattgaatctataaattaccttgggcagtatggccattttcacgatattgattcttcctacccatgagcatggaatgttcttccatttgtttgtatcctcttttatttcattgagcagtggtttgtagttctccttgaagaggtccttcacatcccttgtaagttgcattcctaggtattttattctctttgaagcaattgtgaatgggagttcactcatgatttggctctctgtttgtctgttattgatgtataggaatgcttgtgatttttgcacattgattttgtatcctgagactttgctgacgttgcttatcagctcaaggagattttgggctgagacgatggggttttctaaatatacaatcatgtcatctgcaaacagggacaatttgacttcctcttttcctaattgaataccctttatttctttctcctgcctgattgccctggccagaacttccaacactatgttgaataggagtggagagagaggacattctgtcttgtgccagttttcaaagggaatgcttccagtttttgcccattcagtatgatattggctgtgggtttgtcataaatagctcttattattttgagatacatcccatcaatacctaatttattgagattgtttagcatgaagggctgttgaattttgtcgaaggccttttctgcatctattgagataatcatgtagtttttgtctttggttctgtttatatgctggattacatttattgatttgtgtatgttgaaccagtcttgcatcccagggatgaagtccacttgatcatggtggataagctttttgatgtgctgctggattcagtttgccagaattttattgaggatttttgcatcaatgttcatcagggatattcgtcgaaaattctctttttttttgttgtgtctctgccaggttttggtatcaggatgatgctggcctcataaaatgagttagggaggtttccctctttttctattgattggaatagtttcagaaggaatggtaccagctcctccttgtacctctggtagaatttggctgtgaatcaatctggtcctggactttttttggttggtaggctattaattattgcctcaatttcagagcctgttattggtctattcagggattcaacttcttcctggtttagtcttgggagggttacctacgtatcttaatctcaccttcaaggctgcgaaagcacgtagtacatgttcgaagaaccaagtggaggccagggtggctgaactgtcaagtaaagtttgagatattgtcaaaggcccaatcatgcaagggtttgtaggctatgctaaaaatttttcattttattgtggaaaaatggaaaagtgattgaaaggttgtaatcaggcaagtgtatggttggcataatgactaaaaaagattattctggttgcagagggagaagaattttgagaaggccatgggaacacaacaaatgtgacaagtgctgggctgagggaagtaaagagagttctgagggcatgcatatctgattttccccataacatcctctagagatacttttttcccagtccaagatccaccctagggtcatgcactgcatatttctaaactgcatatctcagcctttctttatcttttatgaccttgccatttttgaagtatacaaaatatactgcaaatactgtactttagtacttaaatgtcccttagtttggacattctaaaaaatgagaaaacattggtttgactgatgttttctcatgcttagatttggggcatgcacagtaataccacagaagtgctgctgtgtccttcagagtgtgtcacaccaggaggaacatgatgtcagtttgcctcatattagttttgattgttgtgttgactttgattccttggttcaatgtagagcctattgtatttaccacatttctagcttctataaatataatgccttaatatatataggggagagagagacaggttctcactggagtgcagtgatgtgatcatagctcactgcagcctccaactcctaggctcaagcctcaagtgattctcctgcctcaacctcccaatgtgctgggattacaggcataaaccactgtgctgggcctaaacttcatgtttaacatctgtcctgcatgcacatgccatatacactttgttctagataatctgttaatatgcctgacatattagtcatcttgctttgacctcctgcttgttttataaatacaaattagtcagtcctaaacctgcttactctgccttgtctgttcctttaggtggaaaccatagtaaaggagcttgcccacacttctccccttgccctctgcttccctgtgtggtcccttgaggcaagatgtgtactccttctcttgggatctgtgaatataacaaactatattttcaatggcagttatcttttggtctgttgactttatcatatttaaataataatgaaacatattaaaatatctgacatatttttctgcttaaagtcactttttccctttttaatgaataagtaatttgtggggagatactttaaacttttttggctgagatgcatatgagaaatatattttacatggcgacacagtgtgtgtgtgtgtgtgtgtgtgtgtgtgtgtgtgtattggtttgggctccatcctgctgagtttgaggccttaggacattggattggagctgttcagggggcagttggctctcaggaggaaactcaggaggcactcaggaggamacacacacatcacacacacacacacacacacacaagaaacagtagtgttataaagttatacatatcttttccacatgaaagttattttggtttctatgttgttatatttcatttgaatataattcttgccttgacctgctaaattgatttcattaccctctaaaaagtaattacctctgtttgcaagcactagtttgatagaactaccaagttgaattgtctggttgccaaatggaaagtagatgggagggggcaaaactgatagcaaggagctcattctaaggctctccctataatttagattgatgagtggattgataaatttgagttaacagaatttcatgattgattggcaatgggggtggaaaaaagaaggagtcaagaatgatgtaaatttcagcttggcttctggggcaatggtggtgctgaagcttcttggtttcactttcacctgtctctttcggttgactgctctgaaaagtcctatatacatatatggagagagaaatgtgaaaactaaagaaattatctttttgcattatagagaaacactgctggcttaaattgcaactgaattaacctgggctttcccagatactggtccatagatttaatcaccccaatctagtaacaggcattctcaggtatggatgccagagataaacacgtgcatggtgcaggctgttttcaaacgtcacgaattggggattgcattgagaaaatgggttattctagtggaaaagtgtgtgggtccacatacagagtgctgcgaatgatgggctgtgctccgctaggtggtcccccatccctaccccttttctgctctcctacctcccgttctccctccctcctttcccctcttctgcgttattctgggattaacggcggggtcggccccatacacaaacgcagctggctagtacggtcagcctgagccctgctgtgcaaccacgtcaggaattccagtaagttggcaacactggagcacaaagacaacaacaattgaggaactcttcagtacagaaaggaatgtttggagccctggctgctacagtgaaagggcacacacacacacacacacacacacacacacacacacacacacacacacacacacacacgctcgcgcctgcgcgcccacgggcgcactggagggagcccagcccctcccgcactcgcgctcctccctcccgccagccggcggccgctctttgtaagtcggaggtgcggggacgctcattgactatgcagcgcggccccagcgggcgtcggaccggcttgaccccggcgcggtctcgtaccatcgcctcggccgcccggaaccggcataaatcacccgcgaagactggagtgcagcatcaagccccctcgccgcctccctcctcccgctccggtccggtcgccccctccctccccagaccccagctctcctgtccccagtcctgtctcctccgcgccgcacagcgcccaacactatgcagggaggcaaatagagaaccagtgactttggccagagcacagacctctggatttcccaatccaggaatctctcccactctttcccacaacgctgcccgctccacctttttttctttaagcctaagttttctctttttgtgtctatttatctctttttgtctttccgaagtaacacctatcctttccctcccctagcccccacacctaaagctgcgcctaccactgcagcccacggaagctacgcgatccggactgttggggtcagcagagccccggacgacctgtgccccggggaaaggggctggcagtaattggcaggttctcgcccctggggaagggaggcagcgggaacctgtccagcgaccacgtgcgttcagggctgtctcctccatgcgtcacggccccttcgctggagggaaagggctcctgacttcttggaccaggatccggagcctgggactagctgccgcgctggttcaggggctggagctggagatgatgggatggcctcaggcccgcaaacagccccttctcacacagggttcccaccaccgggaaataacttgcatcaaccctccttttttacccctccctgtgggctctgatgtcacgtacaggctgaggacgtgcgctgagggcgggtgtaaggccacttgtgcttttggcttccgggccccttgccagcctgtccaaagcggccccaaagaagggaggctaggggttccctgaacctctcgtgtttctccctcttataaaagggtaccggaaccatggagaagacgttcgctctttttcaattttgcttcaaaatgagcagacttgtaagaagcacgatctggccatgacacctgtagatgtggtgctgaataattgctaaataaggatccaacctccccaacaaagatccacctccctctctaatttgtaaaaacacaaagcaccccatctcagcagcctgtatcctatcaggggaaaccaagatatccgaaggagcctagagagatcaggccaggaatgaaggtcacagatctccatccagcaggctctttactccttcccttccctacccccgcctctttccctttctttctctttccttcatttttacttgtctggttgtgctttccttttccatttcttattttttctttctcttctctattcttgactttcctcctcgtccatttctttccattgctcatttagtaaaactgcgtccgtgcagatttccccgtgagccgcctcgccggcttctgtgcggggcaaaccctgcggagaggcgagggcagcgcgtgtgcacgtgtgagtgtgcctgtgagagtgtgcgcacaggagtgtgctcttgtatgcacgcgtaaaggggactgtgtatgtcggcgttgaagtgtgactgtggaatgtgcgcgcgtgtgtgactggcgtgtatgagtgaatctgtgtcagttggtgtgacacttaggagtgcatgcgcctgtatgagtgcgtgtgtgagtgtgcacacgcctgtgtgagtgtccctgtgtgagcacgcgtgtgttcgagtgcccactcctccccgcgctgcaaagtgcagggggcgggccgggcggcagggggcctgcccgctggattcccgcatgcttgttccggggcggtcgggtctaaagggctttatgcactgtctggagggtggggactggcgcgggtagaaaacgggatgcctcgggcgtgggggcaggcttttggccactaggagctggcggaggtgcagacctaaaggagcgttcgctagcagaggcgctgccggtgcggtgtgctacgcgcgcccacctcccggggaaggaacggcgaggccggggaccgtcgcggagatggatcgcgggccggcagcagtggcgtgcacgctgctcctggctctcgtcgcctgcctagcsccggccagtggccaaggtaagarcccagccrgagcctctcgtggagcccccacttccccggctgtggcagggtcgggtccgcgggaggccggaggggagagcgtccgggcaggggctagggccgggcggcggcgcgggagctgctcccggtggggcgctcaggttgcttcgcgaagccggagsgggmgcgcccctcttcgctcrccaggaactgagcggcagcaaacttgagaaagcagccccgccagtttcggtgacagcgcaccccacggagaccctgtctttgttcccacgggcgttggtccgatgctcctrgaaagcactttgcgggagaacgaggttctccgccgtttgcagcctgccctccctagcggagttctctgctgggcggcgcggtcccgggctctgctcagagcgcagctttccacctgcagcgcccctcccgggatcccttcgcgcgcccagggccgcgggccagagcactcctcccaccaccggcgaaacttggtcccgcggtgacccccagagaccgctctcaccatacagatcatttacgagccaagataaggccgggaggtgggattggccgagagagtggctgagggactggagtcttttcttgaagttttcctttccagctgggagctgggggcttttgtgttgatgaatggggcccgtctgcatggccagagttttggggatcgaatgcagaaagtttctagtatgaagtgctttaaacttctctcaagttgtccgatagtttatgttttaacagaaacagagaagagggaaagagagggagaaagaagcggagagaataaaactagtaagaagggaagaggagagagcgtaagagaagcaaataggaataaggaaagaaggagggaagagaacgactggggcgggagaagagagagagagaggacagagaggagagagacagagagagagagagagagagagagagagagagagagagagagacagagagagacagagagagacagagagagacagagagacagagacccggccgaggatgaatgggaagggcgaggaggaggctggaaccggcgagctctccccctggctttgcgttgctaggtagcagccgggagctgcgtgtgaccgaccaccagacagacagaggggacgctgctgccaccgcagggactaatctgtctgtggggatgggagagtcccccctttcccctcctgctccttccctcccgtcggacaacttaattgccctacaatgaaaatgaaacccctattgttgtaggattagccaaagcaataaattgattttcctggatcacatattggggttgatgggtggggaatgtggaagcccccatttacggaggagtgaggggagggcttgtggatgggccgtggcatgtattcaaatggttaatctgctttctttcctcaattcttagcgtaagctccttagagggaatcaagtaagtaattatacagcaactcctagcagcacccatttcagacttcctgggaagaagtttggaaaccctaacaaaccccacaggtcttgcaaaagtcttcagaaaggcaggagaggcaaggagagatcattaataaccttcctttgaacaccctttctcagtgttggtaacgcagaaagagggtttattattattgtgcagagtttgcacaatgcttagggttgtatctcatgtcctaaatatagctataggatttactatatgttcctgtcagtgcctggcaaaaggaaatcttaccttgattcatctatgtccttgtacaaccaaaacagatattctttttcctgggttgatgatttagtcactaaataaccaatacctactcttcttgatagttttttgcacccatccatcttccattctatgataataatatataataataatgtgtatagtaatagtaacctagcatacacatatatgtggcaggctttgttctaagcactttatrcttattgactcaattaatcttcataatatcccttggaagtaagtactcttattatcactgttttacagatgagaaagtggaggcacagaacaattcagtaatttgtctcagttcatactgctagaaaatggcaaactcaagggattctgaattcagagtctataattgctacagtatacagtgtctggttttctctctctctctctctttttttttttttttttttttttgagagagacagaatctcgctctgtcacccaggctggagtgcagtggtgcaatctcggctcactgcaacctctgcctcccaggttcaagcgatcctcacacctcagcctcccaagtagctgggactacaagcccggggcaccatgcccagctaatattttgtatttttagtagaggcagggttttgctatgttggccaggccagtcttgaactcctgacctcaagtgatctgcccgcctaggcctcccaaagtgctaggattacaggtgtgagccactgcacctggcccgatttctcttttttcttttgtacaaaaaatgtcatgctccctaacttactgtccatgtttgaggttcccaaagaagctgagggrcaatatgcaactcgtaccacctgctgcttcataactgtggatctttttccagaatctctcctcaggtttctaagaccagaacccaagtctccccattcccagtcttcctacttgatcattttaagacgcatttcctctgaatgtcctctgcctgatacgttgagatttctagaatcctgttgtaatgatcctgacttaatatatgaagtaaaatccaatgagattgtaacagcctttatttaagcactaccttttaggtaggctaccattgcaaacttcgcatcactaaaaattggaggggaaaaaaaagagctctgagtattctatgtttagtctttgaaaaaaattataccacatctgttgttaaaaattatttgcattttccttatcttttgtgtaatgcttttcaagaaaaaacattttgcagagtctgaactcgagtcaagctgttgggttccaacattggctttaccactttctagctgtgtgaccttgggaaagtcaaccaactttgcatagctcagatggcttatctgcaaaattgacaagataataagagaatttacccaatgacatcttgtaagcataaagagataaaatatgccaagtgcttagcatggtgtaaagcatatagacagtgaaaataaactagaaaataatctaaaaatayaatatttttattatatttatcaacccttaaagtaacatattgttttgcttcctattcctatttccatttccaattttcaaatatacaaaggaaagtcttctttaagcatttttcactaacagttctctgaagacttctcagaccctagcatgtgattggaagattttttcytttttttttttttttttgagaaaatcgtattggccttaaacaaagttgtattctgtttactaattaaaaaaacttatttttcaaaaatagaaatggggtctcactgtgttgcccaggctggtcttgaactcttggcctcaaatgatcctcctacctctgcttcccaaagtgctgacattayaggcaggagccaccttacctggtccaacattatattctttaatccaataaaaatgtggtaatgtttttaagagttagtatcagcttttatgacaattacatcttcacatgaagtttatatgtttaaaaggattgtgggggcaatagcaaacttgtatcgtttttattccatcacaactctggaacctcactgctgctttaatttcacagttgttggcttctctttctctacttgaaaaagtttctctttaccagtcttcataagacttctgcctgaactcccttcagtcatgcacctgtctcattttaatagaaactcagactttttacagctagagggaaccttagatatcaactggtctgcttgcattttttttttcttacagataagcaattagcccaggagggagaagaaaggggctgagaggatgaaagggaaggcggttaataggtttcttgcctaaggacatctagcctgtgayagagctaagatataaatttgcagtggaccattttttagattcatgccttctgaatgtccccagcctgtttggttggttgagatttctagattccttttggaatcctgacttgccagataaggcacagtctgataagcagatgaatcttaaaaacaattggatgggttacctgtccctggccaaagaggaatcctgtgataggttattacaaccatgtaccatgcgctttcagcttggtccagaactgatgccatgtcagtgcccctactcccaaagaccatacctccagatccatttttcaaattcttgagccatcaaagygcattcctgaagatctttgggttttgtagtgcaggctgctgtaagactaggttttcagtcttactaaaggtaattattaggtcataatcattgttcatgttctctagtcaggcactgtaagaacactgaaaggtttttaaaatatttaaattaaaattttaaattatcatttaaaaataatgataccaggaacctagatgtatttcctgtgtaatcagaagcaagtgcattgtcatattggctttggagtttctgttaagtcctagtagctagaacaaggtaagtagaaagtagaaggtgctgagctgggcgtgggggctcatgcctgtaatcccagcactttgggatgctgaggcgggaggatcatgaggtcaggagatcgagacctgcctggccaacatggtgaaaccctgtttctatttaaaacacaaaaattagctgggcgtggtgacgcacacctgtaatcccagctactcgggaggctgaggcaggagaactgcttgaacacaggaggcagggattgcagtgagctgagattgtgccactgcactccagcctgggtgacagagcaagaatctgtctcaaaaataaaataaaataaaataaaataaaataaaataaaataaaataaaataaaataaaaataaataaaaaagaaaaaaaaaagaaaagaaagtagaaggtgcttatgaaagagtgttgaatggataggaaaggggttctcaaggttgactgcacgaatctagagcaactaaaaaaatactaattgtgaagccctattctagcatggaaaaaataagcttgatggaacctttggtataaatcaaatggttctatcgtatcctattaactttatagtcttgagtaattaaaaatttttaccactattgtgtattctgtgaatgtttattttattttttccatgaatatttattaaatatcaacagtgtgctgatgagtcaatagtatcaatactacagaaacattaaggaagatgagaactgaaaagaggtgtctacatatctcgcaattaaaatggactgcagttttgcatttaagattctgaaatagtcattgactcattcctaataaccctgcccaggatctcaccagcattagaaagaytggagatgtttcagcatccgagttctgggatgcttcttgataatgatcagctagtagttgttttgaaatgtcaagagcatttctgtggttcttcacatgttcctaatgcaaatgtttccgaagtaatttcttgacagttacagtgttttgagatgaagtgggaagggcttgtgattttraagttggaggatcttggtttgattcctacctctgccatttattatctgggaaatccagtaccacacatgctgggtgctctggggcagttttcttatctgtaaaatggacatatatctacctcacggggtggttatgcaaaggcaatgaatgtgaaatgtttaataaactgtgaagtctcatatagatttccattcatcattattacccaatacgagaattttactttttccaaacttgagaggaggaagatgttgcagtattttggtatcttctttaccgtgggtctgagaatgatgcacctgtgcatgttgttacatccttacagtggctaccacaacttcacatgttattcagtactgttatgttggtgaatgtcacaaaactaagttaaactgtctgaggcaaaaaaggaaggttattgaaatacatagttgaggctgggtgtggtggctcatgcctataaatctcagcactttgggagtctgaggtgagcggattgcttgagcctaggagtttgagaccagcctgggcaacayagtgagactccatctctacaaaaaatacaaaaaattagccaggaatggtggwgtgcccttgtggtcccagctacttgggaggctgaggtgagatgatcgcttgagcccaggaggtcgaggctacagtgagctgtgatcaygccactgcactccagcctcagcgacagagtgagaccctgtctcaaagaaaataaatacatagttgaaaagatacagataattaggttgatccatttgagattgattttttttcctatgcagaaatagtcaaatattggcaatttcatttggttcaacctaatataaaatggaggctcaaactatgtcaggccaatcttgtcttttttccgtctcctggctctgagatgactccattcttaaacatgttctcctttgatgtaaagcggctgtcagtggctctggagccacctcctatcagatcacatccactgggaaagaaaaagagtttttatcttagctattcccagcaaaagtttcagttgcatctcagggtctctacttaggtcataaactcattggagaaccaaccactgaatcccgggtcatgatgtgttcccatggcttaggcttgggctgtatactcagtctttgagatcatgtatgaaggggtggagtccagagagaaatgggggtaattattgggagaatggtgaacagaggctgggatgcaaaaataacaggtgttcagtataccttatcagataaaattgactgacgatgttattttcattttgtatgtgaagacacacttgaaaaagctacagaaatttctcaagagctggcagccctggggtaacttacagaattgaaaggaataaagtattggaaacattaagaaaaaagacatggtgatctgtgcccatgtgaccatgttgcaactttaagtttagaaggagaacaggagaaagaaggacttttagaaggtttatttggatcctaaagttttcttatttggagcagagctttgtgatagacaggaaagttctggaaaatgagctgagcgatcagactacaggatcccttaagtcykgtgcagtatttcatttttctgtgaatcttaggctcctactccttttccaatttacttcactccaatgtttatgttcctaagagtttgtctgttttccaagcactagtcctttgctataaggatggggtagagagaaagaagcttaaagagtttgcagacaggttaagatgcttytgtggagacagaacacatcttggtgcacatctgagtgtccttagcacttcatctatggacttctttcataaatggtagaacacgtatccatcacaccttattggattaattcagaaatgccagatatatgtactctttgctgatggttactttkttggtctctaatttaagtcttatctctaatcacattagctgagaaaatggagacattatcattctaaaaataagatggttaacttttatattaggacacttctgatttaggatagcactgaaattcagtgcaaagaaatgtaagtctttcctagataatgacagattagacaatttgaagtttcacttttggtcattagccctcaggtcatgcctgacctcaaggttactggaaacagtgagaaatgaatgaaaggaggaaatgtaattaccattctgtgcattgaatagttgagccactgttaccatggatacaatggcgcatttattgtccagatcttgagatccaagtttgtaagcaatatccaaggtctcctttaaatttatgtactatcagcgaataacacatgaagattcctggtaactttgaaaataagtctttcctcactgatctactgattcacattaagtaagagcatgtgtacttttgaaggtgttgaggaaacctgaaaaagacgaaaaggaaagtagctacacttctgttatgctggacattcttggattcctctataaaaatattctgtcttatactgtcagtgatttgcttgtcactttgggcccagttctttggtttttatgtcattaacaaggagaaaatttcctgagtaaaggttgaaaaaatcaaaatcgtttatttttattttttgagacaaggtcttactttatcacccaggccagagagggtctcactttatcactcaggctggagtgcatggctccctgcagcctcaacttcccaggctgaagagatcctctccgcttaaccccacaagaagctgggactacagacacataccascactcacagttaatttttatattttttgtagagatgaggtttctccatgttgttcaggctggcctcaaacccctgagctcaagtgatcctcccgcctcagcttcccaaagtgctgggattataggcgctagccaccatgcccggctgaaatcatttattttgtcaggaaattcttaaagttgaatttaagaatgaaagtattttatcagaaatatggcaatcctacccacattttaatctcactagaaggggggtgatacatgctagcaagtactcccacactgrtttaattttgatgtgaggaagggtgtggagaatactttttgttgcaagaaacagaaaacccaactcaaaatggcctacacaataaagggtatttcttggcttatgtgagtaaaaaatactgaggcagagtggggttcaggcgaggtgcagtcagggctccagttctctttctttgtgttttccttgaccctactcccccctaagtttcacctttgtgtgcggtctggcttcccatatgattctratatggctgccagggcaaatggggctacgtgtttccttgatcctatccagggggaatccaactttgagaaggttttagttatgttctcaaaagtattatttcatcacaataacttacagattgttagaatttctaaggaccctagacaaagtcagctagctccccaaacttgrcatatcatcaaaatcacctgaggaacttaaaaaagtatagagattcttaaatcaaaactcacccttactaaagcaggggtatgaaaatctgtgtkttttaaaaattttattttattttactttcagttctgggatacatatgcagaatgtgcaggtttgttacataggtatacatgtgccatggtggtttgctgtacctatcaacctttcatctaggttttaaggctcacatgcattaggtatttgtcctaatgctctcccttcccttggcccccaccccctgacaggccccggtgtgtgatgttcccctctctgtgtgtgatgttccccccccgtgaccatgtgttctcattgttcatctcccacttatgagtgagaacatgcggtgtttggttttctgttcctatgttagtttgctgagaatgatggcttccagcgtcattcatgtccctgcaaatgacatgaactcattcctttttatggctgcatattattccatggtgcatatgtgccacaaccaacccaaatgcccatcagtgatagactagataaagaaaatgtggaaaatctgtatttttaaaagtttcaaggtgattctgagggctggaccaatttttgggaacgtgtgatctaggtaccctctcatttttcagttttgtaaacagacttagaggtgaactgacttamcactgcaaatttcttcagtggcagttaaatatactctgttaaatctctttcttttggatgggaatgttacaagctagctacaacaagaaggacaggactcttttaagtctgagggtgacatgaagtactaccctcattcctggccacctccttttttggccagcrtggcaggtcctgaacctctccctaaatatgccactgtttgtgtcttaattgtatgttttgttcttaccttggtcacctttgaagttccccccagaccctcctaagaacgttggattcattgaggtaaataactgttgcaggccttctaatcttttctcacctgaatctgaattcatctcagaacacccctgacacagcccactggcttctagagaagctgtctgttccatgcttggaatggaagtattgaaaaacttcatggctcatttcctttgtatcccagcctcaactctttgttgacctcattgggacttacagtttgttgatcctaccgcctcttcaccatccctcaaatccctcacctatttacttcctcagcttatattttatggccatcattaatttcacttccctgcatacatacrcgctcagcagcttggcccctttatctggctctgttgtgcttggcaaggccctgatcctggttaaatccagttctccacatctgcaactctgtagctaaacatggcaggagaaaaacacaactatactgactagcctcgcttgacattcatgaagccaatctcaagcttargacttgcttcctagtctgtctattgcctctcttgcttccttatatcttctcctctttcctcaaacctctgacatcaccttctcacatgtagagtgagctttttaaaactgtgaaaatggaagcaaccagaaragaattccataaacttctataactcaaccatcatcatttgaacttcgkcttatatcttctgtctttcctcctattactctggaagaattttcccagttcttaagtccaaccatttcattcatgttctagatctcattccctctcacctctctgcaattgtcccctctttcttttatgaaatcctctrttccacattaccttctaactatcactctattttttcggttccactttacagtaaaattcttgtacagatgtgcctatatccactgtaattacctttcaattttttctcaaatccatgccattttgctttagccctcatccttgatagatatttttttggtcaaagtcactcatgasttccatgttgttaaatccaatgatctattttcagctctggtccttatttaactggttagcagcatcacacacagtgtatccwgacttcctccttgaaacacttagttagattttcaagaaactgccttctcctggtttcttttcttccttgctggcctacccttggtatctcatgcttgttcctgtctatatccctgacctgttttcatctctagctacactgcctccttggtggcctcatcctgtctcatggccctctttgaagcagggagtggtttcccaattcagggaggcggcatggactckggtggaaagaacatcacatgtcaagtcaggacattcatggatcttgttcctgaagaaagaaggaaaaataggcacaaccaaagagggccccaggctgctgaaaaggacccagggccacttgtcctctggggatagtctctgtcatctgagtccccactttttttttttttttttttttttgcgatggagtctcgctctgtcacccaggctggagtgcagaggcgtgatcttggctcactgcaacctctgcctcccaggttcaagcgattctcctgcctcagcctcccaagtaaactgggattacaggtgcacaccaccatgcctggctaatttttgtatttttgtagagatggggttttgccatgctggtcaggctggtctcaaactcctgacctcaagtcatcctcctccctcggcctctcaaattacaggcatgaaccactgtgcctggcctcagtccccatacttttgaggactccatatatacttctttaccatgtacatgctgacaactttcaaatttatgaatctaatccagaccactaccctatagtctagacccacatatccaactgctcatttgacatgtccacctggctggccaatagtcatctcagacttcacatgtctgaaattgaactcctgatctccactaatgtccaaacttgctttccatgtggaatttctcatctcagcaaatggcttcctcatccttgctcaagcctcaaactgtatcctactttgacttttcttttgctcctctaccccatatagaattccttagaaaatcccattgttttgatcttcaaaatacatctagaatccaactacttttcaccatcttcacttctgccaccctgattcaaccractgccctctcttgcctcgacgattgcaatggcttccatactgatttccttgctgtagcaacttttttagaacatcagtcagatcacagcacccctctgctcagaagctcccatggtttctgtcatactcaagttgggttgcccaaaaacagacactgagatggagcttggagtatataatatttattaagatcaatgcgtgtgaagggaaagggaggaagcaggatgggcagaagaagaagttgaactctggcagctgttggtcaacccagaggaagctctggagcaagagttgcctgttagagtgtcctatgtcaggctgaaatggccttgcttaatcactggatgtggcctgtcctggaaggacacgaccttgggcaggtggctttctatagctgaggcagaccccaaaggagctgattgcaggaagaaagtccttcctcatagctggtccttcctataaggggaagctgcatggcacawctctgggtgtaccactgcttcccatctcatgaagagtcaaagtccaagtccttactatgatctacaagaccctaaccatttggccttcacatcacctccctgacctcatttccttctcctctccccatgcacagtgcaccaggcacagtgatatccttgttttccctgacatggtgagcacttttgggcctttgcacttgcccccctttttcctaaatgctcttgcctcagatggtgcatgacttacttcctttcctcctacaggtctttgctcataggtcaccctctcagtgtggccttctctgattctttcccgacctcttctttcctgatttactttctccattgcgcttaccaccatctgacataaggtatgtaacttagttagttgtttgtttatttccttacttattatcttcccttccctaagatgtaaatggcacaagggcagggattttcatctcttttatccattgctttccctagtgtccagaaaagggctaaataaatgaatatacattgaataaatgaatggacagatgtcaccatgggtgctaagaaggggcatcctcagctcatcaccattccctggtactaccagcccttaattcctcgaggcccctggaggcccagtcarggtcctgatggagaaaaaggaaaattgctgtctctatcaaagcaagtggcttagcaacgctgtttctctcgatctgactccccccttttctccaccccagtgcctcccactcccgccctgctggtgattcccaatgcatttgagtagttgaatctgcatccttctttttaacttccatcccagatacttggttaccctgtgagaattcccctgtacatacagaatgggtcattctgctatttttaggacagatttgatacagtagcttttacaaaaagataagccaaagtttttagacwtcrtgttagtggactgtcattctgtatttaaacagaacacaaaagaaagctgtctgagaccatgacacagtgaaaacagccttgatcaaacaaaaggccctctttgaagaggggagtggtttctccactcagggaggcagcatggattgtggtggaaagaacatcacatgtcaaktcaggacattcatgggtcttgttcctgatgaatgaaggaaaaatgggcacagacgaagagggcccctgactgctgaaaaggacccatggccacttgtctcctggrcatagtctccctcatctcagtccccattcttttgaggactccatamgtaacaaataggttggaggcaggagartgatggaattccacacatagatgagtagagaagttgggaaataagccacaataaaagtgactaaattatttgagtgctttctataccaggcattggcctaagtgttttgtaggtattagtttacctacttaygtagtaacagtaaaaattttatggataaaggaccaagacaatgacaggtgaggtaatttgcccaaagcaattcagttactaagtggcagagccaacatttgaacccagaacccttatttgtatatgttgtcaccatggataatttggagcaagtggaagatagtcctctgtacgtaatcaaatgaagcctcatttaatttctcatattatgatcagatgacctcatttcagaggctggtaccattgcgacccaacttttggacatttttttgctactcttggcagttcattcattcattcattcattcaatatatgttgcagccttatcatgctctaggcgtgatgtaactaggtactgcagagtatagacagagaccttcaacataggccacatccaaaacaacttactattgaacagagtatatttccacttccttctagaagactagaagactgtactttttaggtacggattgatttctctctgctgggtttctcctatattactatttcattatctgggaacaccttttttttttttccctctataattatgtgtcttttaattcaaaggacccttacctaatcagagagttcaattttaaccttccgttagggacagcagtcatctataaattttcagaggttgttgttgtttactactaatgaaaaaaattattaagttctcttatttaaagtcactgaagaaaaaaatgaacaaccaagtgagagctgagtttctttacttcccggagaacactgctgttgtagagatggagragacatttcctatgtgctggatgtgcttaaaggtctcttggtcccaaagtatctctcactacggccaaagatctctgctctgtcattactaaagtcagttcttcggagtaagacattctttcctcctgaaactcctattacaatgtggaaatgttcactcctgtagggtaaagtagttagttgagatagtaatgcacagtaaatgtttgtcagagcaaggttcagagagaaggagacacaaagctggtatgttttaatggggatgaaagagggaaagaaggtactagaggtgtgatatagtcttgaaaataagccaacttccttttctggggaataaagggttattatgcttgtgctttttcttagaatggctttatggggaatttcagctgtgrtctattaggaaggcctcaaagatagaacttaaaagcttctagtatggctgtccttcctctagttagcaattgaaactgagttgttacaacaaaaggaaaagttgtcgttaaaagcaacacagttgcaagactccatcaaccattccttggggattcatcagtgcctggtaagtttgagaagagacccttggattttaatatacatggcagttataatttgtctagaccataatgattactattaatagggaatcctgtttttctatttttaaaaaaatttagagatgggggtctcactatgttgcccaggctggattcaaactcctaggctcaagtaaccctcctgcctcagcctcctgartagctgggactaaggtgtgtgccactgtgcctagctctgtttttctttaaagttactgtgtaataaaaaaagaatttgcaaatgcataaaattgaatatacacatgtcccaagtcaattgtcaaatgattggtttttatgtaccaaaattctgcatttttttttcaaggtcacttctgatataagaatttacttcttccctaatatttggttcagtgaagtgttgaaagaatttgctaagtaatcattgaaagctaagattctagtgaaamacaaaatgcatggtttaaaaattgaacrtactaactgaaagacagtggaagttagatgcttcttgctgtaaataattaaacccaacagtgcagacgagagaacatggcaccaagagggacttgggctaagaaggatcatattgtattgaacactttcgtttccctgtaagggaaatcaaaagggtctttaatagttgttgctgattgtgaatatgtgcaacaaaatcccactgtaatccagatttatttttcaagcattttgctgtgattgaaggaaggagaaagggataggaagaggatggagttttattaaagctgtagttacttcttccctttaggaggtctaagtgtgacttgtcacagtgacctgggactttgattccctccagggccttcctgttctatgggcacattggtggatcaaagacaattgacttttgttttgttttgttttgttttgtttttggagagaagcagtggttctgctaactcagaacaagaacgacaagagtcatgtaggatgtttttctgagtttctctaacagtgctcgtttttttttttttttttgaccgccccctcttttccttttgaggtggggccaaggggtcaaacctccatttttctatctgtaaaaaagagaatcggcctttatgaagtgctttaattttaaaaattaacataggctaaaattgctgtgtgtgtgcacagttctgtaaatgttagtgcatgtatatatttgtgtagccacaacctcattcgggattagaacagttcaatcacccccactaactcccttgtgctactcctttgtggccacaccctcccaataaagtgtgttttaagttccttttttgaaaactgaccttcccagatgaatgtctctgttgccttttatttgttcatttttatttacgcagtgttccttgctcatttttgaagtaattcaaaatgacactcacggtaagcttgcaagrctgcctttcctttaytataacggagaaaaaattctggaaagaaggcagctctttcagtatagtcatataagaacaaaatttccccaaacttggcttgtggctagattggaatccgtaaagaaaacacactcaagaaatctctcttgaagaggaggacagaggtttattttttatttaacgatttaccccttgacacctgggaaatgattagttgatgttttcaaagaagattaagtcagtgtggttaattaactgtggtaatcaggtgacttaaatcaattaactccttgttaacaatttccatcaattttgtaaataaatgactaaatcagtaaattgtactcttaagattaaaggctattttctgatttatttttttgatgacaaattagagtgtttccttctcatctcagtcactscctgccactcttgctcttaatcataagccagttttagtttgagaggagcacaccagggaaacttttaatatatggttttaaggaaaagtcaggcttaaggacacctttgctccttcatctcagcacatttggaaagaatgatttagtgagagcagtagttgggggtgggtgtagaaagcaatcctgaaacacactctaggataagcttttattattaagtcacttaatgtcttgttttatttatgttttctaagttaaaactcgatgagggatataataaaatgaaacagggtttggctcttagctaaaaataaactttaatggatgtcttacatgctctatttagagggaatttcacaaaatattgggatatattgactgcattcatttgtaaagcttgattgcattaaaaataccatacaaatatacaactaaaatgttgttactttttagaatctttataattgaaaattctcttccctgcttacataactttattatgtctttgtctccaatgaaatatgagctggataaactaacacaagaacagaaaaccaaacatcacaggttctcactcataagtgggagttgaacaatgagaacacatggacacagggaggggagcatcacacactggggcctgctgggggttggggggctaggggagggatagcattaggagaaatacctagtgtagatgacgggttgatgggtgcagcaaaccaccatggcatgtgcatgcttatgtaacaaacctgcacgttctgcacatgtaccccagaacttaaagtataataataataaaaaaagaaagaaatatgagctggaaaattataaaaccatatcctatgcccctgaatatgccattgcattctctgaggattttcactgtaggacagatgatataggtttatttatggtttcttcaagaagggatatttggcatcttgaataacttttgaggagttagtaaatatttatgtatttgcaaaaattctatgctattctcacattttataaagagaaaatttctatggcttcctttaaggtattaaggatagattaaattgtgaaactgagctgaagccactgttgtaaatttaaatcactggctgccaagcaaaattctgggctcttcctattattatagaagctttctggccataccccaactaccccttcccaacttccctggacatagttaacctgtggccaaaccctttctggtactgggacatggtctggaatcacagctcagagatttagctcgactgctttccagatgtgtacctctgaagctctctgagcttcagtttcctggactatacaatgggtgttagtaatttctaccttataggtacctgggaatatttaaaggatattgtgaacatgcaaggtcctggcacttggtgagcattcagtaaacatttggccccacagggaacctgatattaaatcattcatagttgaccagctcttggttaggtcatgcagcaaagcagccaccatgctgtgattttttgaaataaagaaaccacttgtcaaattctctatccatagaaattgctggggaaaaatacagctttttaaagcagatgaaactactagacaaaaaaatgttggaagacaggcctggtcacctgcctttcttcccccaagaatgtttggttcttcacctcccaggtcttgaaggcacagatccaaatgtaaagttgccaagaagttcaaacgttggtggacctggtgtttccattttaggtgtcctgtgcatgctttctgtaacttggttttatgcagaacttgctgatgatgtctctgtaactctgagaacaggaatgatggaagcatgggtctgagtggaggtcagatgtgtcctctgggcaaggagaaggatttgcccagggaagactacacttgaagaggagcacttgattttgtgagaggttttagacagagcatgtaagaatcacagtcaatgaagagttttctctcttgcaaaagttccttattatttcatgaaactacagaaaggtcagtgagatgttcaataggtgagaaagctgtcaagctagacttggttaataattacagttaaaataatcactgatgtatttctttcacrcacgtttattgcaagctttttttttatcaggaactgacatgcatagatgaataagacatgcaaataaacaattgtgctacagggtgagaggtctataatagaagtttgggagcacagaaaaggcagtgatgtagtcaactagacctgagaggaccaagggccaaggaagaccgcacagattgccatttgaactgagtcttgaaggagttgggagagtggactgtggaggattttgtatgtcaagctaagaagtttggtgcctttgaagaaatgtaagctgggaagtacaatgctcagattttcattttgtaaaaagaatacttgctgcaatgagagaaagcagatgaactagttaagttagaggattactgggattatctgggtgacagatgatgagggtagaactagacttgtgcacttggaagtgatgagaaaaggagagagtcaccatggaacaaagagaaagcttttatttgttgccgtttttgataattcttgttatttgttttataagttggcatgttttatttatgggaatattagacatgtcttttcaatgtatgtgtatgttaattacattcataaatattcaactttttttttttttttaattttcctgcctgaaaaatttccagcttgctgtctgtctgggcatagcgtgtgacattttctttgttttagttcactgattcctagttggttcatctccctcagggaacctttggaaacatatagtagcattttttgattgtcacaatgcctgagtatccctgccagcatttagagggcagaggacaggaatgctaaaccgttgcaatacacaggatagttccatactacaaagaattgtctgggcttaaatgccaatagttcttttgttgagggcccatcttggttgataggaagtgaatagagaggcagaaagggatgctattggtaataagagcggtcatacactgaaacttattatatgcctgatatatagtcaccatagctatagcatttgttcttgtgacactccagggaggtagataccattactattccctttttactaatgagtgaactgaggcagagtaggatatttggctctgggcctcacatacttaactctaatactctgtttttccacatgctttactttcttgtaactttaaattaataataagaggaaaaggagaaccacacttgctttgtgctttacagtttgttaaatatcagaatatacctcctggaaacatttctgccagtttagtagaatattgacaagttatcgcctccaagcatttttaaaaatatggaaaatatttgatgaaatttttttaaaattaggatgcctttgtagattggaagaaactcttatttgatggaaaaacagttggtgctccataaatgcctggggaattgaattgactctggaggcacttagtgtctttagagggtgtcaaagatcttgcaaatttattttaattttaattttaatttttttttacttcacataaaagagaatctgcctcacgtatgatctttgtaatttgaagacgtgccagtgacattgatgaagaatgtgactttttcttggacatgccttgcacttccctgtttctgtgccagttctagtttgtttcctctgtgaggcrtcccctcccctcagatccatctatctgtagcttaaatgcacctttctctacaggacctttcttgatatccactgaatgttatctgaacctctcttacagcatgtctcctcatgccatgagatacaatcatttgtgtatgtattttatctcttcctctagaagagtaccaccttttgggagaggcatagaacaggaccactgatgctaagagtatgcctagctcctctggtctcttgtgtctggcacagtgtcaggcataagcatgcactcaagaaatttttgtttaatagaaagtcaaaagaacagcatgtgttatagtaaagcaactccatcatggtggggaggtaataggcatgctctactctgggctcctgtcgcagagaggattttgtttggcttgaacaagacaaacatttaattctctcttacataaccagcagtggaaggctggtctggtggttccatgataccattagagacacaggctccacagtcctctgctggtgactcccattcctgaagtcacctcattgtccaaaatggctgctgtagccatagccatcctttctctatgccaggtagtgggattgcagaaggagaaaggaggacatgccttctctgtttaaaggagactttccagaagtcccacacaacactactgcttgcatttgatctcatcgattaagrcttagtcctatgatcacatttggctgaagtttggaaaatgtagctttttagctcagcacatagttcacctgagtaacactgggttctattactgaggagagagaggcaaatgaatgttaaagtatgccatgactgctcctggccaaagctggtcgggtgacactgcacatcttctcttcagctttgaataccacattttgggagaggcatagaaaatttgaaccttatttgaaagagagaaacaagaatgatgagaaaactggaaacaatattatgggggaatgatggaaaaactggagatgtttcttttggacaagagaataggggaacaatggttagctctccaaatatttgaggaactattatatgaagaaggataaaacttactctaaatgactctaagagatgggaaagaaattgtagatatatcgtatgcaccaaaagaatgctggaatttgactttagggtcacttttaacctttgaccttatatagtacagatgcataccatatagatgtatccataagtttgtgcttttgaggttaaaatattrcttattctctggttacttcatattggaattctctttactgagggttgctatggtgataacacccttagcagtctgcattttgaaaagctttggacttttccttttgtgagatgtggtctctatgtttcccccatgcttggcgtttttcaaaatatcatcaagtcagaaacaatttccaaatttatcagagtgaagtgaggagaattttaaaattgtagatactaataacaggggttagtaattctatattgtacaactcagtgattcaataaatattgtcactatcaacttctttggattaagatagctatgtttaggcaactggttagtgttatttagttaagcatgtattttttaattattactaaatttcttaaacacccttgaaatataattgttgaaaatgtcttaaaaacacagctagtatcaaccagagaaataatttagcaaagagttaatttatttcactaagtagtgatatatttttgaaygcatgtggaatagatgtgtgcctataaacttgactttgtgaattaagttttatttttctagttcagttttactttgaatatggatatgttgttgttttgtgaatcttagacatcagaaagatttagttgggaagagaagtaataatgtaaaataaaagtaataataaaatactcaaatttctgtattaaattagcttttgggggaattagctacataattaggttattttaatagattttcaaactgggttgcagatgatgaatatagaagagctatatatatacataaactctcatataagcaaatatataagaagcaaaaaaaaaaccctgtagaattgagagggagacaatatttggagtttaaaggatcagaaaacactggcctaaaaatagtatcagtaatcaatttttattaaacacttactgatatgccagacccataatcctcactctaccctcatattaatgttatgagtaagagctcttattatctccgtttttagatgaggaaactgaggcacagaaattaaaatggctgtcagatagttagtaagaggtggagcagtggtttgaatccctagtatatgactagaaggacttcaccctggacagttacttggcttctaagcagtcttcgcgtgctcttccccttccttgcccttctgtaatattatagtagtttcccagtagtatgcagcatctggctattcagactttgtctcttaaccttctgtggaaaagctgttgacttttagacatgctgggcagaatggaagaaggaaaatacagactgttatacttggagaaataatgatttcatatgtaacagtagttgaatcaataggtggacaaatttattgaaacttcttgagttaatccagtgatggtaaacaaacacatggccaaatgagcactctataaagcatgccttctggaatgcatattgtcttgtcttgtctttttccttccttccttccttcctttcctccctccgtcttcctccttttttcttttcttttcttttctttctttctttctttctttctttctttctttctttctttccttctttctttccttctttctttctctgtctctcttacattctatctttctttctttcttccttccttttttctttctttctttctctttctttctttgtttttctttctcccttcccttcccttccctccttccttccttcttcctttcttttctttcttttctttctctctttctttctttcctctcctcccctactccctctcttcctccttccctacttccccccatttctttttctctttcttttgctctgggtttgctctgtcagtcaggctggagtgcagtgcagtggcatgatcatagctcactgtagcttcaaactcccgggygcaagcgatcctcccacctcagcctcctgaatagctaggactacaggtgtgcaccatcacacctggttaatttgttttgtttttgtagatactggctctcactatgttgcccagggtggtctcaaactcctgggctcaagcgatcctcctgcctcagcctcccaaagtgttgggattataggcgtgagctaccttacctggcctcaagtctgtttcttgatcagtaagcctggtaatattgggctgtcttgtgtgcatatatgtagatgtacatgcatgcatacacatatattccactttgggtggaatggatgaatcttttgtttccagtggaaggagttctttgagttacaaatagtagaataagggctttcagtttaaacagaacccacatgagtgtttcattaatcatgttcacgtgttaatggattctcttgaggcctttggagtcattgyttttgcaatatttccttagggcctttttcttcagtccagattaatctaaaatacattgcactgatccagagatgtcaccaaattctcctgaaaagccctttgactgtatttgggctggcctgtgcttttatggaaaaatgctatctcactgctgatgaggtttctggcattagcaaagatggccttatacatggtaccacaacctatgtggtacgatgttaggagccctgataagatactctgttcccctacaatctgctccatcaagccrgtgaggaaggtatgtaggcattaggaatgcctaaaatgccacaattagaaaattcattccttggagggcttctgttttctgctgaaagtgcaaacacccgtagaaggctttaagaatctctcaaaccttcccgtgaataagttcacctgggagcagatttttggggtcagggtcgtgagccatggaaactctggccatgtcatggggatctgagggagagagaaggagaggatttttagacagcggtgggggaagtcaggcggaggtgggaccatttaactagataaggctctaatcgtctcattcctggactatcagaacagccttttaagtttaagttgcttttccctctttgtaaccttacccaccaaactttgtgaagtgttgagtgcttatagtaaacagagtgaacataactcttcccagggaagaactggctgactttagtttcttggtttctggaaggagatgggatagttttattggcttgcttgaggatagccaaacggttgtggacaagagggcttgtttcctgacaagtgttattctgccttaagaatacaaagataaatggtctaccagagcttcagtacctgtttgttgcgttgcatttagtttggagtgtttgctctgtgcagtggagaatactttggagggtggtaaggtctctctgtttcattactggaaaagaataggagtggggtcatggcaatggggtatttcattcctctgtgcgtgtgtgtgtgtgtgtgtgtgtgtgtgtgtgatggagtcttgctctgtcacccaggctggggtgtagtagtccaatctcagctcactgcagcctctgcctsctggtttcaagtgattctcctgcctcagcctcctgagtagctgggattacaggtgcatgccaccgcgcctggctaatttttttgtattttcagtacagatggggtttcaccatgttgcccaggctggtgttgaactcctgacctccagtgatccaactgcctcagcctcccaaagtgctgggattacaggcatgagccactgcgcctggcctcattccttcgtttgcaggggctggatgtctaggtttatggaaatctattctcattcaaacagaaatagggtaacaacttaagataataaagtttttctttgaatgaattagaaaggcattattgtatgttattttagtcaaataatatttttgcatttattgcattcttctgttatataagagaaagtttagagaattaggatagtgaatacttttaatgcttgttttttttttttttttgagatgaagtctcacttagtcacccaggctggagtgcaatggcactatcttggctcactgcaacttctgcctcctgggttcaggagattctcccagctcagcctcycaagtagctgggactacaggtgcatgccaccatgcctggctaattttttgtatttttagtagggatggggttttgccatgctggccaggctggtcttgaactcctgacttcaagtgatccacccaccttggcctcccaaagtgctgggattacgggagtaatccaccacacctggcctttcatgcttttaggaaaaatttgaaattcttttaaacrtgggtcctggagaatcgctgaacttcctttttttttcttctattgagacagaatttctctctgctgtctatgctgattacagactcctgagcttaagagatcctcctgctatggcctcccaaagtgctggggttacaggcatgggctactgtgctggccaaactttttgaatggaaaactttttagcttggtttcagttgattaatcctcaatttctttatgtccttaattctatggcttatgccaaggcatgagttgaggtcaacagaaatccttttatgatgatagaaagataacgatgtccaagtttaatgtacagtataatgacttaaggtcaattctgggaaagcctgtatgtttatcatcaatttctttttggtgatggaattatacacctacagtatttcatgtaaaactccagaggatcacctgaaatatgaatgatttacaatggacaaaataataaaaatgctcatcgtaggaaaatacaaaaatatataaacaagaaaataaacataaaaatgcataaacaagaaaatagcaagttgggagcaagcttgcttttgactctagtttgacctgtgtttctcagaataaatcttgattttcactcttgcccttgaccgaagactgggccagtggaggcaaccaccaccatctgtgctttcagtgttgagcatcctaccaagcaaggtggcttagattttgaaagttttctctcagtcagatagtaggggaacaactcttagaatgttagaattagatgagtagtgggaatgccctggaaggaaccacccttcatggagggacggctgtgcttcaggcattgtgccagaggtttacagggacctctttaatcctcaccgtaacctgattttgcaggtcagaaattttgtaggtaagaaaactgcatactgtatcagtttaaattcaggttcatcaagctaaaccagttcagtaacaaatatttattgagtgaaggttcagtggtaaatgagacacaaacagttcctgccctcatggaacttagagtttggaatgacacagggacagtcagtgctttgccagagttgaaagccatgcatctcttggctttctggcgattgctttttccattggtattcttattttagccattcttactgaatttaatttaaattttacttaattattataatgcctatggatccatgttctgcatattagctcactcatactcatccaagactgtaactataggtacccaacacccagaattgagatggccactgaaaactctatncttgaccaacactctaatatcattttattttctttaattgcctttgtaagaagtataatacaaacaaaactccagtaagcaaatggctttaattatttgtgtgtcagttagtagagattttattgtatatattttctggtatagtttattactgaagccgtacttctttttagcattaaaattctaaaattttatrtttataatagtgacaaaggtttttactgtaattactaatgatatttaaaacacagattaggcaaaatcttaggaaatataccctgctttttttccttccatttctggcaatcactgcagataaacttgtaattttattcatgttgctattaatatggggacattataaattcatcatgtctgtgcagaaacctgaacaccactttatcacacgtgggtatcagttggtgacaatgtaatattgttgattctgtgtcaacaagctattgaattgtttcaagtcatcacaatcacattataacgtgaagtgataacattgacagagcctgaaagtggtttggagacctcctcatgctatttgagcccaggcataacaaaccagggccaaaggactcctggtgcaaagataacctgctggtgaggcatgttctgaagttctttttgctcagtctgttaaaagcaatccagtaggggagacacaggaaatttaaggtcattctaccatgagagtatttgcaaatataataggtccttctttacagatttacaaggcaatgatttggcattacatttgtttctctatagggaaattaaaatcatgattatgctatattagcaaattgcttataaaacaaattacaatttttgattgtaggataagawgtactcttgtagccccctccctccctccctccctcccttccttccttccttcgttccttccttccttccttttcttccttccctccttccttccttgtagatctctttgtcatcttttggacatcatcttagtttcacacatatattctaacacatcatatatagttcgtttattgagggtaggctgggtactaggaggtcctgtaacaggccctgggaatacagaggtcgcttagtctcatctgttctgttccttatatttcacatatccaggtcgtggcaggagaattttgaactttctgcttataaaatcatttccaaggcataacttgtcactaaaggggaaaaatacaaaaatattgtgtaaaacatcagcaaaaccagtttttaaaaaagagaatgacatattacatttttattaaaaatgttgacttcagtttactagatgattaattatcagtacttactgcccaagaaaaggcttttaaacttattgttggaaatcttttggcactcttgctgcacaatatttcttaatagtttaagaaaattcttactctgttggcagaagccatacatgcccatcactaaatggtcaaggtcgaggcatgcctgtgtgtgcaactcagttattcatctaacgaatgaactgtgaataaagtttagtgtttgtgtgaataacaatgcaatgagcctcaccatcaccaagcataaacatttctgataagagttgtcatcagagttgcttattgatgttgaagcattggtttcgttagagtaaattatgtatatatatgtgtatgtgcatgtacgtatgtgtgtgtatatatatatgtatmtacctgatctctactttctgaaaatttacacatttagaatgggaggttatttagttcctagcatgtaacttgtgacttataaacccacttarcaattacatactgcttcaatctgaatttgggccatagctaaataagggtgagttgccattttgtaccaaattgaggttaaggtgcaagatgccaggtgtcatttaaaccaaggctaggatgcaagatgctaggtctcatgaaatttagtgtctggacactgattgctaaccttgacatctctcctttctgccctctttttctctgtctccctttttctttttctccctatttttgcctcttctctctcttctcgtttctttagagcttgttgttactattgcgatagtcaagaactaaataatatggagttagggagaaggaatacagcaaggtgtttataagattcagtcaagaaggtccatttagtagttataaataatttagcctatgactatggggaattaccaaatctaccaattgagagtcaatttcttctcttcttgttgctattgtcataatttgcagtatccaactattgttcacttgataacctggtgatctcatctgattattaagatgaccaaaatgaaagtgatgtttatagctttaacatatccatgtcagtttgatttatggttcaacacttggacctaattaatcaggaaaaccctaatttgatgctgtctatcaatgctagtctgaaacaccattcaaaagccttaagcaagaaagctgcctttctaaagtctctcttgtcatttatttctcatgaatgtccattttcttttttagtgtttgattccactcaaccattttccagtaatttatattgctaatcaaaaagccgtataggaattctctgggtgactgggactggaaatgtgctctgaaatgggaatgatttgtagtttttgcacagggtgtgtcaaatcatgaggtgctgaagggcatgttattcttstaagtagtttgattcattgggtccttatttacctgggcaggcaggccatcttaaattttcttctgtttggatagtgttcttttcaacatcctgtaagtgtagctcttttaccatgaaagatgtaaataaccagttagtctctagtggggattggggccagaggagaagaaagtcttgagcttagtttccttccacgtgtagggaaggttcctctccaggaacctcagtgacttagctgatagaggaggcactgcatgagstattyagggggagcacagaaaagactggtacaaatacactttcagtgctttgatgctggctaacaggaagttttcattgctcagcgttcttggtaaaaacttggacattcttttgaatgtttgagcgcttaagtgattgtcaatttatatttttaattttttgtgaatgtatgcagttgggatggggagaggacatttggagaaattatttttttgctctgataatgaatacggacgggaaaagtttgcaccacaacgcagaggtgcttatgactgtttttcatagccacaatcctttacattaatgatgaactacttgaggatttcagatgcttgtgtttttctagtgtggtcccctccccttgaaggggtagacctgtggacgtgtgatggaatggagcattccagggtgaaacaggccttcctggaaattagattctttatcactctcccaggggagttcatttcaagttgctggtactagcagctgcagcgtgagattgcccaatcctaggtgctcttattgatgggtgggaaggagtgggattgctgtttaagaaattttattatctttagaagggaagaatgtattatgttttttttttttagatgatctctttcatgtgggctaagataattttgagctctgactgtccaagctgcttagaggttctgagttgttctccactgggggtggtactgccactctcaagcggcatagatgtgcctgggagtgtttttgtcaccgtgatgtgggggagcactactggtgttccacaggtgggggtcagggatgatgtacatactgctttgaccaggacagttctgcaagatgagtaattgtcccaccccaaatggcgatagygtcctctgaagaacctctgagaagtgtggctttgcttatamtgttctgtagtgctgatggactgcctgattgtagaggtgagaggtgcataatgaaaaaacaagtgggatgtaagagccttgggggagaaagacaggtgactagtgtttaaatggaaatggagaagggtagctcagttataaatggctcagtttaaatctctcattgctcagaattgagaggctgctcaagtagtacatctcattctgctgccatttggttattggaaaggcactttattttaattactaagcaaatatttaagtaatctttgagatcaactatcttgagagctgactggattctgtggcctggatactcagaaacatccagcttggagaggatggtgggggctggtcactaggatgttgttggcaatgccctaaggcagcggtccccaagctttttggcaccagggactggtttcgtggaagacaatttttccatggacagcagggtggtggtgggggagggatggtttcgggatgacactgtttcacctcagattatcaggcattagattctcataaggaatgcacaacctagatccctctcatgtgcagtttacaacagggtttgtgctcctatgggaatctaatgcagccactcatctgacaggaggyggagctcaggcactaatgctcactcacccgcctctcacctgctsctgtgtagcctggttcctagcaggccacggaccagtaccagtttgtagcccagggactggggacccctccctcatggaacctgttcgtagtttgccatgcaagcggacctgctttggatgcttctggggcagctggaggggctgcaaggtgagacccttctctgctagcagcctcttgcctgcacctaccagcctgctcactgggctcagggttggggtgaggttctggggattgaagtggagctccaagctcttttcatggtcaaagtctgtatgctagttcaggctttacctactcagagtgatcttcacttttaatgcagttattgtctgagtaatcaccctcatactcatttgacaggcactctttggcttggcactgaaagctctttttctccatcttctcagccttgttgcctaccactctccaagaggtcatcactgcttgggtcatacttattagaccctcacccatgctaagcttctgtcaagtttttgttcttttttttcttagagacaggtttcaccatgttggccaggctggtcttgaactcctggcctcaagtgatctgcctggcatggcctcccaaagtgctgggattacaggcgtgagtgatcacgcctggcctgtcaagttgttttgaccctacacacaaagcctggtctccctcttcaccttcccaaatcctgctcattcacaaagacccagtgtagtcttataattctttgtgaagacttctctgatgacaccggcctgtagtgttatttttttcgccaaagtcagttagtttttattatctccattgcttatttggaaccaaattgtctgttgtcagaggcatagctttggaatcagactgcctcagtgtaaatctgtgctccactacctactagctgtgagatttgttcaagccttgtcgtcctcatctatgaaatggggccattgatamcatctcacaaagctgttgtgaggatatgtaaggtaatgcatgggaagcacttaaaatattgctggcaagttctgggtgaacaaatgctgtcatttgctttgcaggacatgaaatgatgaaataagtacaggctctggagtcacacaggtcctggggctaaatcagacttcgacattttctacctttgtggcccttgggggagttggttaatgtcactgaggctcaggttccccttctattaaataagtataaatctcacatcatacagttctgagaggatccagtggatatgtataaagctttatatattgtataacacatagtaggtactcagtaaacaatatcagctgttgttattgcatggatatttaatttataacatataaatcacttttgcccccaataaacttataggctctgtcaaaaaaggaccatatctttttatttatttatttatttatttctttttttttctttttttttttttttttttttttatcccggcccgttctcaatgagctgttgggtacacctcccagacgaggtggtggctgggcagaggggctcctcacttcctagtaggggtggccgggcagaggcgcccctcacctcccggacggggcgtctggccgggcggggggctgacccccccacctccctcccggacggggcggctggccgggcggggcgctgacccccccacctccctcccggacggggcggctggccgggcggggcgctgacccccccacctccctcccggacggggcggctggcccggcagaggggctcctcacttcccagtaggggcggctgggcagaggcgcccctcacctcctggacagggcggctggctgggcggggggctgaccccacctccctcccggacggggcggctggccgggcagggggctgacccccccccacctccctcccggacgtggggctaacccccccacctccctcccggacggggcggctggccgggcggggggctgacgcccccacctccctcctggacggggcggctggccgggcggggggctgacccccccacctcccttcccggacggggcggctggctgggcagaggggctcctcacttcccagtaggggcggccgggcagaggcgcccctcacctcccagacggggcggctggccgggcggggggctgacccccccacctccctcccggacggggcggctggccgggcggggtgctgatccccccacctccctcccggatgggtcggctggccgggagggggctgagccccccacctccctcccggacggggtggctggcccggcagaggggctcctcacttcccagtaggggcagctgggcagaggcgcccctcacctcccggatggggcggctggccgggcggggggctgaccccacctccctcccggacggggcggctggccgggcggggggctgacccccccacctccctcccagacggggcggctggccgggcggggtgctgatccccccacctccctcccggacggggtggctggcccggcagaggggctcctcacttcccagtaggggcggctgggcagaggcgcccctcacctcccggatggggcggctggccgggcggggggctgaccccacctccctcccagacggggcggctggccgggcggggggctgacccccccacctccctcccggacgtggggctgacccccccacctccctcccggatggggcggctggccaggcggggggctgacccccccacctccctcctggacggggcggctggccgggcggggggctgacccccccacctccctcccggatggggcggctggccgggcggggggctgacccccccacctccctcccggactgggcggctgccgggcggagacgctcctcacttcccagacggggtggctgccgggcggaggggctcctcacttctcagatggggcggatgctgggtggagggtctcctcacttctcagacggggcggctgggcagagacgctcctcacctcccagacggggtcgccgccgggcagaggcactcctcacatcccagacggggcggcggggcagaggcgctccccacatctcagacgatgggcggccgggcagagacgctcctcacttcccagatgggatggctgccgggaagaggcgctcctcacttcctagatgggatggcggccgggcagagacgctcctcactttccagactgggcagccaggcagaggggctcctcacgtcccagacgatgggcggccaggcagagacgctcctcacttcccagacggggtggtggccgggcagaggctgcaatctcggcactttgggaggccaaggcaggcggctgggagatggaggttgtagcgagctgagatcacgccactgtactccagcctgggcaccattgagcactgagtgaaccagactccgtctgcaatcccggcacctcgggaggccaaggctggcggatcactcgcggttaggagctggagaccagcccggccaacacagtgaaaccccgtctccaccaaaaaagtacgaaaaccagtcaggcgtggtggcgcgcgcctgcaatcgcaggcactcggcaggctgaggcaggagaatcaggcagggaggttgcagtgagccgagatggcagcagtacagtccagcttcggctcggcatcagagggagaccgtggaaagagagggagagggagaccgagagggagaggggagaggggagaggggagaggggagaggggagagggggagggagagggagagggagagggagagggagagggagaggcagagcaaaaaaggaccatatcttatttttcttttttcttccactgatcctaggacaattgcatatagtagttatgaatttatttgtggctttagtgaatctggcatcatattcttttggtccttatttatttattcatttatttttgcacttaaatgatgtgtctacatgataatgcatcaatttgcattgtgggttttgtccccaaatctttgacttcttgaaatgtccttatagtattgttttgctctaagaaaacatcagggctctgaatcaataattgggacaaagcagtctattcagtggtttgtaaactggattaaaaaaaaaacccaaaagaattcctgccacctatttgatgatctgtaaggaaaaccagacagttaaaatgttgcacagaaagagactagcaggttggtttgctgttcctgtcttgtttcagtttcattaactgaatccttgactattctatcaatttgacactagacagggtagagtgctccatacaatttgttacccttggctatcatcactatagtgtaaagttttggaaataagcaggtgactctaaatcttcaaaaggggactggccttgtttatgtgggcaaggtatgggaattgtagtgaactgtcagccaacttatgaatatcagaaggatgtctatccataccaaaggaatcaaaattaagtatagaaaaagtgaagcaaaaattatggataagttaaggaattgcctcttaaatttgtttgtttctttgagttcagtgaaggtggaactattaaaatgtgatttactcatacaaatttttaaaaagaggactgtacctcctcaggtagaccaagtgtttggaaggaccagcatgtgttaagaggatctagcggggaaataggatttgccacagaaattaccttactctgttaactttggacaatgttccattgactaccacttgtctttgtcttataagaatagaattkatggaaggagaaagaaacttacaaggaacgggtaaaagaatgaaactgctattaatatgactcaatgtttttttctttctttttttttttttttgaaaaaaacttctagatattccccttttttcagattattccagattccatttttctttctatggatttaagatggtaaatttctatttaaagtctcattgtttgctctgatagctttctatatctctgatatataatggtctcagcaggctgagttttacaaagagaattctacacttcctgacgaacatgcattagctattccataagcacccggtgctgtgccagaggctgtaaatgacacagaggaatgctctcaatccagygttgttccttgctgtggaaaacaaacaggcaaatgactyctcttctctgggcgctatctgttactctaatatcttatcttaacacattcttagtccaacacttacccaggaagcttgggatatggctacttatgaagaaaggattactctttttttttttttttcccctagctttgggctctttatgaggttggaaaacaagtttattcctatgtctaataaaattttactaccgatttcaaaacgcttaaattttttttgcattgctttcaattgctgcaatttttcctaagcccaataattttttaatgctatgttagtcaccaagtaaactactctttttctccaactgaagtatataagcactatggattctatgccagcccaataatgaactcaattaatgttaattgagagcagctttgggggaaaaaaatcagatttttacattcattcttgagtttagtggaataaacttttttttttggtgaaagggaacatagagtagtggtcaagtagcacgaatgctggaatcagagctgtcagattcaaatccttgctttgcacatatttgctgttggatcttgggcaagttaccgaattgctctgtgcttcaatttatttatttgtaaaatattcataataacagtatctatttcatagggttattatgaggattaaatgagctaatgttggcagagcacttagaatggtgtgtgccatttaagtgctatatgagtacttcttttcatctttgcaccatctattctgattgatgggacagacaggggctagtgctggagagatagggtgttcatttggttccgatggttcctttgtgatgattgcctggttcttaacaaaaggtttttatttcaatgtggattgtattttcctcctttcctccttggtttttactagagggattttttttttttttaatcaggcagcccccaaaccagagaggctcctggagaatgttttaaagttacataaatgattatttgcaagattacttcttggctaaaactggattggttgaatgtggcagttttgagactattttctgaacaaagttttaaagctggytctatgtagattttttttttctccctgtgggtggctccaatgtatgaaatcatccccttagctttttttttttttaaatcttcaaataaataacaaaatgtagataatatctagataaaacttttggagggcttgtgagtaaaggctacttatttaaaacaaaacactcaaaataaattgcatatagactaattgaagtaaggggcacctgcaattgttattagacctaatctagaccttttcactagtggtttatttttggtttatttttaaacaacacatattccctttatgagagaatgagcttctgaggccagtgaagcattttggctgatggctgagaggtcacccagcaatgataaagtatcagtttgttttttctggagagatatttccaaacaatagtcgtttgggagttataaacaggcatcgaagttamtactgaaaaggtgaatttgacaaatgaattatagatctgttgataaattgagtaaattggatttgatatattagataatggagtgaggagatcaagtgtgaaaatcactacctataaaaattasttaattgcaacatttccccatcagtttcatttttcatatgtgtgattttaaataattgactttgaagtgttttataaaatgacttttgrgtctctattttgtgttcttttcatgatgtgtttaacttggtattttagtttggcaaaaacaaacaaatccccccaccccactcctcaaaaatgggacttgtaataaaagttgcttaagaaatagcattaattatatatattttcaaaacaggcaatatatattgttctgataatttcctcctaaatactcagtctctaaatttatatttttcttttctccatagcaatatgaaactgtctgtaagaggactgttctttatgattgttataatttttcaaccagaagatactacctttacaacctcagatactaagggagacaaatgtactgaacttacaaatgtattatgttggattactaacaatagacctaattgataaaagtgatttaatatatgttgtgttaatagctaaacctccaaagcccctaatctcccatggaaatattgctttgtagaacaaaatccaatgagaagttctgggattccagagtgaatttgtacattccttaggggcatttttgcaagggaggttgttgtgttttaaaggtagttgataagagacctgcaccaccaaccccagacctrcaccaccaaccaccatcatgcattagtctatagaaggtatttgggtgtacgtactcctgtaccactcggtaccaccatttagccaagcgaagtttctgaccatttgcagcatacattataaatcaggatgtcactaccagacaatcagatttgaacattccatgaacaaagtagcctatataccctagaaatagatcacttaactatgtttatgtcatgctgttgatatgcctgcatttacacaaatcaggatagcacattgcttatttattttaggagtaggtacttgatctgtatatttacctaattttggttaattagccaaaaattgaaatgggtaatttagcatgattgcttaaatacatggggaagatataattattcttccaactgcaaaaatttctcctttatcccttgggtttgtgaaagaataaaataattttgagtcttctctaagtggggctggtagtggctgctttctttgaaaaatttttctatgtggcacataatgcttgggaaggtcactggccaggtatttggggaactttgtcccttggggagacctaggaaaatcacaggatatattagttcagtgaagtgagcttgtttaagttatattgtccttccagtatcactagggactatcactgccacttggggtgtcaacttttggtgtcaagtttgtatactcttgttggctgcagagattttgttttgttttgtttttggctctttggtttaaaaaaaattgtttgcagagatgagcttatagatctggcaagttataatttaatttttaaaaattaagacaaaatattagtctgaatctaagaatgaaaggccataacttgctatatatgatttagtaataaaaaatcacttaaaaaataaggtgaggaactcaagaaagtatagtcaagcaaatgaaaagttactcacgatgttatcaatcagagataaccactgttaacattctggtcttttttacgctttttttttttttgcatatgtaactctgttatcagtaaaaatttacgtccttgtttttgttacattaaattataagtatttctctaagtacttagaatttctccataaccattttttaagttactaatatgtcaatataaagatgtaaacaaatttaatccttttattgttggacatttaggaggtttgcaacttcctttgttataaataatgttgcgatgaaaatctttatacataaatctttgtctacttctttgattagttccttaggaaaaaaatccttgaagtaaaagtactaaattaaagatcaagtatttttaaaaagcaagatacgtgttgtcaaactgctttcccaatgagttccatcaagatacacactaatcaactgtgtatgaaaatcactttcttcccacggatgttcaaataaatatttttatattatcattgggagaatgtttacctaattttctaatttgcatttctttgattatctaattagttgaataatttttcattttatcaaaaatttatatttcttcggttaaatatctgcatggcataagtttttaaaatttctgtctattattgcagaatgtgacagtgcgcattttcgctgtggaagtgggcattgcatccctgcagactggaggtgtgatgggaccaaagactgttcagatgacgcggatgaaattggctgcggtaagtgaggaggggccaggctaagttctattttgagtaacctaagtgcttcctggtgatttcagctgtaacaaagagaagagctatgccttttagtgacagagccaggtctgggcccaagtcttttgagatctgtgtggttgaatagagaactgatggcattaacaataatttcactcccttctgaggtaggggttcaattcacattgatgatagagcatcagtttctatctcacccttatcccttgaccacaactttgatatggaaacatatttgggtgcagttttctggagtctgtaggtgattatttctaatattcactctgtaaattttgtgtacccacaagaacaaacaaaaaataatgttatctgaactactgtgatttgtaagtcaaagaggagtccatttttatgtaaaggatgtagaataacttgtgtcaattaccataaagaaatcacagaattggttagtgtgatttatgttttttaaaaattctagttttaaaaaatttgaaaaatacgataatgtagtaaacttcaaatctaattaattataaaatgactttcacattcattttktcatttagttttctcactaatcttctgaggtcggtttcagattagtaaattgagactcggagaagttaagtcatttattaaagttcttacagttggtaagtctatgcacagatcccattgctcttcccaacttcccataggtgatcaatcatacatctgcaatttccttcatcccagcaggtgaactaatgagggttatctttcaaaaatcaggaaagcaggtgaaaaatttttgttttgaattgttggccatgttatggcataccatagcagtcaaactttggtgtgtcatttagatgacaacgcatttgaaaatgggaggaagggtaaggatggggttctgtacagtgctcctcaaatactcatgcacaaatggatcacccaggagctcattaaagtgcaaatttagattccatattttgaggtgggacctcagcttctgcgtttctataaacttcctgatgatgttgatgctgctagtttgtggactgcactttgaacaagggactaaactatatttgtagagacacaatcatgtgctaactatttgcctcctctgggcttactgagttcattttgattaaacaataaaagcaaaaaggcaagggcagtgtatctggggtaaaggaataagtgaacagctatgccaacarctcttcagagattgttacctgtattatattttattgacctgtaaaaataataacaataacaacaatatcaatgacgatagtgatagcaagtaacattacatggcgctttcacatacattatttaacttatttttcacaacaaacagtgagatgagtatagtccccattttatgatgcatacattgaggttcagagaacctgccaaagatcttaaaggaagtaaatcatggaaataataattatttgattttgggttttctttcccaaatctcatgaattttccagttcatcatgatactttactattagttattatgaaacaaatagtttaacagtaactcacagttaatgtttacttgaatgaagcttttaatctaatacctttatcataatttttttgtgtgtatgtgtgctgtttgttttattctctgtgtttttaagttgctttggttcatgagtttgttgtgatgctgttgctgagcttatttgacagtgaactctgactggcgtccacagactctagtrtaagggttgtttactatttgccttcaaataaattgagcaggagtttacatgatacactcttctggaacaagcattgcttgctagtataatggggaggatgattgccataatgagtcctcttttggtttgttttagctgttgtgacctgccagcagggctatttcaagtgccagagtgagggacaatgcatccccarctcctgggtgtgtgaccaagatcaagactgtgatgatggctcagatgaacrtcaagattgctgtaagtgtttggagaggaatcttgctttggctttgtggacacctaaaacccaacctgtcgcaaagaagttacacacaatgggatgattctttataaatgtggagcagggccttaaatcataagggaacctatgccagcaatctcattcaggggttggatgatrttgaaagtacggatgtactgaagaattatgaatataccccagcaatttggaagtgagataggttcccaatctttaattttgattatgttatgctcaagaaaggaaccaaatatttattggagtgtatagctgggtgtcttcatgtgtgtggttgacagctgaatgagtcctttggctctgtggcatactttgtattcaaaccttccactccttctgccccaatattaaattctcttctttttgactgagtggaagtaggtaggtttgttggagggcttcttggtggttacttcagtgactgctgccacagccaccatagggagagcttgaacaagaaagaaaatagtagcgatgaagcggatcttggcaactgcggcatccctggacrttgagggggtttggttcagtaacctggaaaaaacctttaaattctaatttctttggaatcagactggaaaagactgttttaataggtctaacaataattttattttatttattttwattttattattatttttagagtcagggtctcactctctcacccaggctggagtgcagtggtgcgatcacagctcactgcagcctcaaacaccggggctcaggtaatcctcctgcttaagcctcctgagtagctgggactataggtgtgcaccaccatgcccagctaatttttaaattttttgtagagacacgatcttgttacgttkcccaggctggtctgraatcctgggctaaagtgatcctcctgccttggcctcccaaaatkttgggattataggcatgacccccccatgactggcctgaaaataattttagatgagaagtaatgttgggtaaatataagatggcgacctatgagcaatttgtctatcacatgtatcattccattcctttctctattaaggatatttgtataatttaaaatcattcttgtatcattgtggatgtttttggctgcaaggaaagaaaacacaactcaaaaaagttaaacaaaaaggggatttattatctcacataataagaagcctaactatagggttgttccagggttgattaattcccagctcagaaatattatccagctttttctcacttttttgctctgccatatttatcctattggcctttcttgattgcataaaagctgctcaagtctcaaaatttgcatcctgaaggcctgacattctctcaggcagagaggaggttcttaatagatagatactaaatgcataaatgatgggttgttcatctttaggctatatagttttgagtctattttctcttactcctctcacagagtgggaagaaagctgagctttattttgcgattcaatgtgtggtggatgaccctttgctaataataatactttacagaggggattggaactactaagggcaactgcttgggaaaagagactggagataagtttatagcagtcattttaaaacaatattgcatatcattttaaatgactatacatttcatgaggcaattctcccatttttaatgatataaaaattctccattagatatcttttaaccacaaacaaaatatgccacctctgtattcactaaagttaccagataactcctgattgccaatgggcacttttccttccttctcacactggatgggcrtttagattgcacttgactctggagaccattcctccttcttgacaccactcccttggctgccatgactcccagcagtcctggctctcttttgagctgctttggtcattccattttattttcctcttctactcagcccttgagtattggtgttgctcagagccctgccctgagcagcttttctcattctggacactctcaggatagtctcaccattctcatgactttagtgaccctctgtggcctgatgagacttaaatctgtgtttacaacccagatttttgcccacacttgagtcttgtatastcaactacctttggacctctgcaagttgccttgaactcaaggtgtcmcaactgaaaataatcatcttccctcctgaactggattttccttctatatttgctagtctacatattttatctttattaatagaaatagcatttaacccactatgaggcactggcagaaaatacaaaatcagtcttaaactattggaaataggcagatggaggctctcttacttgttgaatttgtgaaacatatttcataatgaaagtattttattagatgaagaagaaagattgctgtaagtgacaggaaagatataatcaattaacatgaaaaggctatcacaatcccctaggcacccacgctagaaacttggaggttattcttgattccttcctctttttcactgcccacattgaatcaccaactcctgcctaatttgcctcataaatatttctaaagttaatctcttcatttctctctcttttatttttattttttggcaaggacagattttttttttttttgagacagggtcttgctctgttgcccaggctggaatgcagtggtgcaatcatggctcactgtagccttgacctcctgggctcaaatggtcctcccacttctcagcctccagagtagctgggactacgggcgcatggcaccatacctggctaattttgtattttttttttttttttttttttttgtagagatggggttttcccatgttgcccaggctggtctccaactcctggcctgaagtgatccacccaccttggccycccaagtgctggratgataggtgtsagccaccatgtctgacccatctctttatttctgctcccactgccaacatctctcatttgggtgtcagcagtagtctctgggttggcctccctgcctccagttctgtggatccttagattctctctgacactgatgctgatctaactaagattctttggtagctctccattaattccaggagaaagttccaattccctaacacggtttacagtggcttccaagatgtgactagtgcttattttcctatgtctatcatttgctattcttgccttgaagtggccacttgggcacagcagtgcttttagttcctgtgggtgtgccatgctgtgtcctagccttttgtctccgtgcaagctggctgaatgctgaatgctcggttctagacagtccttctttgcttttggcctacctgactgctgcttctttaagacccagggaggtgtcactttttcaaggaaactgtccccatccatgctcccatcccagagtgaattaagttcctggattgatggttctatcattcctgtgtgcctataatccactttcataattgttttctaattactccttagtgtcccctagaagactatgagcttcttgagggtagggattgtgccttattcatttgcagatccccatattgctatactgtgtggtacattataggccctcaacagatgtttgtgtaattaatgaatagatgaatctcagcattagataggttgatggaattatataattttaatttgtttgctctctacatttgaatgagcttttaattgcttcttcgtaagccctttgaaaacctaagcacaacatttagaattatttgggcttgacgtaaagaagaaagccaaggtaattgaaygagcactgatacctgacccaggttcttttcatattttgtttgagacaacccatgacttgccttctcgggaataaaagaaagttctttaattttatgtgaaaattggcaatatatacttaaataaattatttggaaatttaatgaggaagtattaatctctttaacctttttcagataaaattgtgtctctgccatgggcagaattcagacacttaagtgccttctggaaaaatctatctattctgcctttattaatagaagtaaaattggacccacaggtataaggtacttagagaaaataygaaattatttagtgttagaagtaggctgacttgaaaaattttgtttgctgttccagaattataagacaccrttttgctaattaaacagaaagaaggaacaaaatgacaaggaagatataatcaattaagcatggagaagggtgttaattatggttttataattattatatcttatcacatgataatttctatatgtttgaattttcaagtaccaccttgaaaactgtcactgtctacttatcttttacatatttttttttttttagagacaggggtcttgctttgctgcccaggctggagtgcagtggcatgattatagctcactctaactacataaaaagagaagttttttttggctcaagtgatcctcctacctcagccttccaaatagctacgactacagctacttggaagtgagccactgtgcccagctaaatttwwtttttttttyttttaagatataaggatctcactatgttgcccaggctagtcttgaattcttggcctcaagtgatcttcttgcctcaatctcccatagctgggattaaaggcacgagccactgtgccaggtttacttgtcgtttgaaaaggtttttcatgttaagttttgggggtacattccttaacagatctaattttatcagaaaaccaagttttgctgaacctaaatatctatactacatataagtaaaagaagckctgtaggctgggagcctcggatccctgacagttttgcagaacgctgatatctatggactctaaaatagacttcatttatagatacccacggaccactaatggacaaaaacatgaatcaatatgtattgtggcattcaaatcctagcgctttgggagaggagggaggttccaagatggccgaataggaacagctccagtctacagctcccagcgtgagcaacatagaagacgggtgatttctgcatttccaactgagctttgaagagagtagtggatctcccagcacagagtttgagatctgagaatggacagactacctcaagtgggtccctgacccccgagtagcctaactgggagacacctcccagtaggggccgactgacaccggatacggccaggtgcccctctgagacgaagcttccagaggaacgatcaggaagtaacatttgctgttctgcaatatttgcagttctgcagactccactgatgatacccaggcaaacagggtctggagtggacctccagcaaactccaacagacctgcagctgagggtcctgatggttagaaggaaaactaacaaacagaaagggcatctacaccaagaccccatctgtacatcaccatcatcaaagaccaaaggtagataaaatcacaaagatggggagaaaccagagcagaaaagctgaaaattctaaaaatcagagcacctcttctccttcaaaggaacgcagctcctcaccagcaacagaacaaagctggatggagagtgactttgagagttgagagaagaaggcttcagacgatcggtaataacaaacttccccaagctaaagggggatgttcaaacccatcgcaaagaagctaaaaatcttgaaaaaagattagatgaatggctaactagaataaccagcatagagaagaccttaaatgacctgatggagctgaaaaccatggcaygagaactacgtgatgcatgcacaagcgtcaatagccgtttcgatcaactggaataaagggtatcagtgattgaagatcaaatgaatgaaatgaagtgagaagagcagtttagagaaaaaagagtaaaaagaaatgaacaaagcctccaagaaatatgggactatgtgaaacgaccaaatctacgtctgattgttgtacctgaaagtgacggggagaatggaaccaagttggaaaacactctgcaggatattatccgggagaacttccccaacctagcaaggcaggccaacactcaaattcaggaaatacagagaatgccacaaagacatacctcgagaagagcaactccaagacacgtaattgtcagattcaccaaagtttaaatgaaggaaaaaatgttaagggcagccagagagaaaggtcgggttacccacaaagggaagcccatcagactaacagctgatctctcggcagaaactccacaagccagaagagagggggggccaatattcaacattcttaaagaaaagaattttcaacccagaatttcatatccagccaaactaagcttcataagtgaaggacaaataaaatcctttacagacaagcaaatgctgagagattttgtcaccaccaggcctaccttacaagaaatcctgaaggaagcactaaacatggaaaggaacaactggtaccagccactgcaaaaacatgccaaattstaaagaccatcaaggctaggaagaaactgcatcaactaacgagcaaaataaccagctaacatcataatgacaggatcaaattcacacataacaatattaaccttaaatgtaaatgggctaaatgctccaattaaaagacacagactggcaaattggataaagagtcaagacccatcagtgtgctgtattcaggaaacccatctcacgtgcagagacacacataggctcaaaataaagggatggaggaagatctaccaagcaaatggaaaacacaaaaaaaggcaggggttgcaatcctagtctctgataaaacagactttaaaccaacaaagatcagaagagacaaagaaggccattacgtaatggtaaagggatccagtcaacaagaagagctaactatcctaaatatatatgcacccaatacaggagcacccagattcataaagcaagtccttagagacctacaaagacacttagactcccacacaataataatgggagactttaacaccccactgtcaacattagacagatccacgagacagaaagttaacaaagatttccaggaattgaactsagctctgcaccaagcagacctaatagacatctacagaactctccaccccaaatcaacagaatatacattcctctcagcaccacattgcacttatttcaatattgaccacatagttggaagtaaagcactccccatcaaatgtaaaaggacagaaattataacaaactgtctctcagaccacagtgcaatcaaactaraactcaggattaagaaactcactcaaaaccgctcaactacatggaaactgaacaacctgctcctgaatgactactgggtacataaagaaatgaaggcagaaataaagatgttctttgaaaccaatgagaacaaagacacaacataccagaatctctgggacacacttaaagcgtgtgtagagggaaatttatagcactaaatgcccacaagagaaagcaggaaagatctaaaattgacaccctaacatcacaattaaaagaactagagaagccagagcaaacacattcaaaagctagcagaaggcaagaaataactaagatcagagcagaactgaaggagatggagacacaaaaaacccttcaaaaaatcaatgaatccaggagctggttttttgaaaagatcaacaaaattgatagaccactaggaagactaataacgaaaaaagagagaagaatcaaatagacacaataaaaaatgataaaggggatatcaccaccaatccctcagaaatacaaactaccatcagagaatactataaaaacctctatgcaaatcaactagaaaatctagaagaaatggataaattccttgacacatacgccctcccaagactaaaccaggaagaagttgaatccctgaatagtccaataacaggctctgaaattgaggcaataattaagaggctaccaaccaaaagaagtccaggaccagactgattcacagccgaattctaccagaggtacaaggaggagctggtaccattccttctgaaacttttccaatcaaaagaaaaagagggaatcctccctaattcattttatgaggccagcatcatcctgataccaaagcctggcagagacacaacaaaaaaagagaattttagaccaatagccctgatgaacatcgatgcaaaaatcttcagtgaaatactggcaaacccaatccagcagcacatcaaaaagtttatccaccatgatcaagttggtttcatccctgggatgcaaggctggttcaacatacgcaaatcaataagcgtaatccatcatataaacagaaccaaagacaaaaaccacatgattatctcaatagacgcagaaaaggcctttgacaaaattcaacagcccttcatgctaaaaactctcaataaattaggtatcaatgggacgtatctcaaaataataagagctatttatgacaaacccacagccaatatcatcctgaatgggcaaaaactgggagcattccctttgaaaactgtcaccactcttattcaacatagtgttggaagttctggccagggcaatcaggcaggagaaagaaataaagggtatccaattaggaaaagaggaagtcaaattgtccccgtttgcagatgacatgattgtatatttagaaaaccccatcgtctcagcccaaaatctccttaagctgataagcaacttcagcaaagtctcaggatacaaaatcaatgtgcaaaaatcacaagcattcctatataccaataacagacaaacagagagccaaatcatgagtgaattcccattcacaattgcttcaaagagaataaaatacctaggaatccaacttacaagggatgtgaaggacctcttcaaggagarctacaaaccattctcagtgaaataaaagaggacacaaacaaatgaaggaacattctatgcttatggataggaagaatcaatatcatggaaatggccatactgcccaaggtaatttatagattcaatgccatccccatcaagctaccaatgactttcttcacagaattggaaaaaactactttaaagttcatatggaaccaaaaaagagcccacattgccaagacaatcctaagccaaaagaacaaagctggaggcatcatgctacctgacttcaaactatactacaaggctacagtaaccaaaacagcatggtactggtaccaaaacacagatatagaccaatggaacagaatagagccctcagaaataataccacacatctacaaccatctgatctttgacaaacctgacaaaaacaagaaacgggaaaaggattccctatttaatacatggtgttgggaaaactggctagccatatgtagaaagctgaaactggatcccttccttacaccttatacaaaaattaattcaagatggattaaagacttaaatgtcagacctaaaaccataaaaaccctagaagaaaacctaggcaataccattcaggacatagacatgggcaaggacttcatgtctaaaacaccaaaagcaatggtaacaaaagccaaaattgataaatgggatctcattaaactaaagagtttctgcacagcaatagaaactaccatcagagtgaacaggcaacctatagaatgggagaaaatttttgcaatctacccatctgacaaagggctgatatccagaatctacaaagaacttaaacaaatgtacaagaaaaaaacaaacaaccccatcaaaaagtgggcaaaggacatgaacagacacttctcaaaagaagacatttatgcagccaacagacacatgaaaaaatgctgatcatcactgagcatcagagaaatgcaaatcaaaaccacaatgagatatcatctcacaccagttagaatggtgatcattaaaaagtcaagaaacaacaggtgctggagaggatgtggagaaataggaacacttttacactgttggtgggactgtaaactagttcaaccattgtggaagacagtgtggcgattcctcaaggatctagaactagaaataccatttgacccagccatcccattactgagtatatacccaaaggattataaatcatgctgctataaagacacatgcacacatatgttttttgtggcactattcacaatagcaaagacttgggaccaacccaaaagtccatcaatgatacactggattaagaaaatgtggcacatatacaccatggaatactatgcagccgtaaaaaaggatgagttcctgtcctttgtagggacatggatgaagctggaaacgatcattctgagcaaactatcgcaaggacagaaaaccaaacaccgcatgttctcactcataggtgggaattgaacaatgagagcacctggacacaggatggggaacatcacaaactgggtcctgtcgtggggtaggggagaggggaaggataacattaggagatacacctaacgtaaatgactagttaatgggggcagcacaccaacatggcagatgtatacatatgtaacaaacctgcacgctgtgcacatgtaccccagaacttaaagtaaaataataataataaaaaaggaattataaaaaaaagaagttttgtaaaaattgagagsaaatcttttttcttccattaggggattatattatattttttagatgatcacgttttcccccaaagctctttgtatgtagacaatttaaaatcccaggataagataatgttaccatgttatggtaattcctgcctcagatttacaggatagctttcacatcatgcttgcgggcatcagttcactggattttatctgttttatccggaggcaaatttcatgaactgctgatgccctgctttcacctatactaatcaacatgggatgaaatcaagstagcttaaatttttttctctttataaaattgatacatggtcaatgtaggcagtttatagaatagaggaaactatatagaaaaaaataaaatcactcatattcatattcacaccactctggaataactgctattaaagctttggtatatttccttcttgtttatacaaggatttcaatgggtgggttgggggtccttggttaatacctatacttgcaaaatttttatttcattaaactttttaccatatagttttaaaatctatattgtattctttacacatgttgataacgtaattgtgtacatagcatgcttgagtgtggacactattctctgggcattttgataayattatacttctgtttttgctttgtaagctcagcttggtggtagccaggtactttaccttgtgtccctatgaactttwtgctttccaatatccttgttaatgmcaatagattagtctgtgtctagcaataattataaattaagtaataattttttctcttcgcagcacaaagtacatgctcaagtcatcagataacatgctccaatggtcagtgtatcccaagtgaatacaggtgcgaccacgtcrgagactgcccmgatggagctgatgagaatgactgccgtgagtctgttttagtccttgcrctgtatttggtttcacccttgtccctttggcattttaatcaatttgttagatttgttgatggacrtaaatgcctacaatatgcctcttgttattgcaatctcttggcagattcttttgtggattaggggtgatgttctgataagagtctatttttaacaagacattctaagagtgtcctgccttagtgcatcaagtttctgtattttttatagtaagaaacttttaacatgaacatagattctgaaaggaaggataattaaatacattgagtacagaatcaagtttggtaaattttaactgttattacacagctatagtaagtttctaggtcaaatttctcactagttttcctgcttttatgaactcaacatttttcagattacctttggaaaagtgttacattttgaaaatgtcttttcctataacagcagcatactatatctctttgtaactgatcaccacaaaataagacatataaatcatagtattctatgtataatgtataaatattaccacaccaaaataagaaagtgcaatcatggttcattatctagtaacaggtaagtaaagaacaatcttcctctttcgaggcttatatagaagtgttaggatatgagaagataggaattagtctgctgtgtcagtcctatagtccatataattgtctttaatctcaggcataccacagtttctctctctttctgttttttattttttatttttgagaaggagtttcactcttgttgcccaggctgagtgtgatggcatgctctcggctcaccgcaacctccacctcccaggttcaagcgattctcctgcctcagcctcccgagtagctgggattacaggcatgcgccaccacgcccgactaatttttgtatttttagtagagatggcatttcaccatgttggtcaggctggtgttgaacttctgacctcaggtgatccacccgcctcggcctcccaaagtgctgggattacaggcatgagccactgtgtctggcccctagtttctctgaaaagttcttacaagtctagcgtttatgaatttttccagaagttccttgagtttttaatatatatayattttaatatatacatataacatatatttctgacaggccttttcgtgcagtcctgcatttcataaatttactatgtgctgtataaagatatagtcatgtgtcatttaatgagggggacacattctgagaaatgtattattaggcaattttgttgttgtgtgaacgtgatagagtgttgttaaacaaacctggatggtatagcytactgcacacctagggtaaacagtatataccctaggcatatactgttgctcctaggctacaaacctgaacaccatgttyccgtgctaaatactacaggcaattggaacacaatgttaagtatttatgtagctaaacatatgtaaacatagaaaaggtacagcaaaaatatggtattataatcttaggggaccactgtagtacatgtagtccatgcggtctgtcgttgaccgaaagagccatatgcggttcctgactgtasttccttttgtttgctcttaaatttatatttcaaacttcaagaaattatcccagtattccattaattggtgagcagatttttgtgtaccttagaaatcttgatcataaacttttcagttattatgtctccaacggaagattcaagttttagcctattctcacgggatatctcctctattgttttataattttgatttaattttagttctctggattgtctctaaattccttcctttgatacaaatggtttattttatgctttctgataaaagaactatcttgtgtaaattttgctaaacttcccaatatggtgctgtgactagggtaggagctaacatacattgattatggcaagcaaattgtttctagtcactgtacatttcaaactatactgttcatggaagatatacttgtatatgtgcaaaagcaagacctatgcttccatccataccatgaccacatggtgcatttttaaaaacgacccttctccagtgctttctcccttgcatgttatttttctttgggagaaatgtctgtgctatttgccattgtctctccatttcctagcagagttcctagtacagttctgttctaattttcatctgaaatattcttatttatctatttatttttaattttactttaagttctgggatacatgtgtgacgttcccctctctgtatccatgtgttctcatcgttcaactcccacttatgagtragaacatgtggcgtttggttttctattcctgtgttagtttgctgagaatgatggcttccagcttcatccatgtccttgtaaaagacatgaacttgttcctttttagggctgcgtagtattccatggtgcatatatgctacattttctttatccagtctatcattgataggcatttgggttggttccaagtctttgctattataaatagtgctacaataaacatacatgtgcatatgtctttattttttgaaagacattacagtgtttccactttggatttaccttcactctggaaattatgcaaagaatttagactaaactctggcaagtttagagatggtagcgtgtgtctggatgccacagaatagcaagtttaggggtcaaagattctcctttcagtgctttgtaaagcacacagtaggttcttcatttaggcaaatgaagaagatatttttgattaataataatgataaaccatatgttatattttgtagcattttataaatttcagagcattatataaattctagttgttactattaggttcctttatgaggacaatagggcaggcactattataatctcttatgaataaacaaaaacttcaaagagaagcgtgacttgtttgaggttgtatagtagagatagggcttaatttgtcttctagttccaagtctggtgattgctcttcatggagggctttatttacagaaggagaaagtcctatcttgtacaagttaagagaccaccagaggcctgtaccaccagccaaaagtctgtgtctttatcccttatttacaagtagatgaaaatgagtgctttattgcaaatgcagtgggactaaaggaactgctactttggggaaaataaaagtcagctgaaacagaatgtttgcagccaagactaaagtcactaatacaaccggctcacaactttgccaatgaaccttctggcaaaaacctggcaggatacgaatatgtaagtagctgctgtaaaagggaacgaagcagaggaaatgagctttgtaagttattatatctgggcaggaatttttaatcaagtttttttttatttaaaaaaatttaagtacaaatagttggtgaaataatgattcactaaggaaagaaaaccaaatttgkcttactgtttctggaatcatacaagtcatgaacccttcagggcacactgtgacctaaaatgaatcacatgcatgtaagggattttgcagtgaggcattctttcctatttccctctaccttgtttatttatagctaagtttcatttatggagcagtgtaaaaaaaaaaacctcagaaatcagaggaaatgtagaaaagaaacttcttattcttttgttagtgctttgatctggtcacagtcagatatatacaagaaggaaatgaatggcctcgatcaaagtccttagaaaatgctagtataggggatgggttgcaggagtgatcccattttgttttccttctttgtttaaagctcttgtggaaagtgggaaagggaactgccagtcaccgagcaccagccaccacyttacccacttttcacgtcaatgctgcaaggtgggtatgaggaccagctctgttttacagagattgtaaagattatcaagatgtaagagtaggggagccaggattttaacctaggtctaaaccatatgcctgtgctcttaaaagattttgctttaggaatagaaacgtataacttatttttgtttaaaggttacttagctattttattatttttacatattatygtctaaaccttttttagtatggaaggttttttttaacatatacaaaagaagcatgaagtgtatagtgaacccctttgtatgcatcactcaattacatcaatgatgaactcataactaatattgttttatttattctctttattctccccattattttgaagtatttcttagacattgtataattccacctgtaaatatttcagtatttatctctaaaatataaggactgaaacataatcataatatcattatcacacctaaaaattaaacaactcttctttaaaataatcagatattgagtcagtttttaaaattccccaatcatcttgttattttttatagtttgattatttaaatcaaagtccaaataaaatctttatgttcaagttagttgatatgtctcataagcctttcaatttrtggggtttccttctatttctgttctttacccctwgcaatttacttgttaaaaaaaaaaaacccaggtcacttgtcctggagtttcccacagtctggcttgtgttcattgtgtcccctgatgtcctttaacacattctctgtcctctgtatttcttggcaattagtagctagacctggagcagggtttctcgaccttcacactaatgacatttgggaccggacagttctttcttgtgcattgtagaatgtctaacagtatccctggcctctatccactagatgtctgtagcattgcccagtcgtgacaatccaaaatgtctctggasgttgtcaaatgtcctccaggagccaaatcatccagttgagaaccactgatttaggggactgaacaggtgcaaggattttcttggtggggaaacaagggaaggcaagagtactttttatataaatctgtgtattttcattaggagacacaggatagctagctgtctgtgatgtgagtagccattgatgatcattgctgaaatccatttagtcatagcagtacttagttattttaaatgttgcattagatatataacagctgttattagttgctttaaattagaatgttttcatgtgatcaaagattaaatgaggcttagccagaaatcatcttcatgagacatgacactttattatttctgcagtgacgatgcatggaaatcattacttgtggacaaacttagaattagcctgtgaatggggcttttgtttttctatttctcagaaatagaatggcctataggaatgaatatattaggtacctggaaaccacctaaaaatagtaatggatgttggaaaagctccaaagaaggrctcaattcttccctctaatattcaaaaggattagggagcttgatgttgtagtttgtagccctgcctgtcattccagacccctaggttgtagttcataccctttcaagcttctaaaatcaagacactgagctccaagacagagtaccttgtgtccattccgggcattcctttacagaacaaagagtggtgtgtaagagtcctctcagggaggcaggcagggagagaggaggtgagagaatgttcgagatggtgaggaaggggaggatattagggtctcaacaaaaagattatttttgagataaatgtggtatagtatgagagattcttattgcgtttggtctttttatctgcttcatctttatatgcataaggtattggtggttattttacccttttagaaaaatttttgaatatatatatattaaaacctgtgaaacaggtaaaagctcattttcccccttagttcttttattattcaatctggtcatctgtaaaatggmatctcatattaaacagcttgtcaattaacttttttttttttttaaggaacagagagattcaaaactgcggtccattttacttctaatgggattagcatcaaggaaaaaccactcatgcagggtctaagataaacatcagaacaatgcagcaattataggtcattcaattaatatattgaygtgactttcagttgctcaaaaatagtacagtttttttctgttaagtgaaaagattattttgctttttcaagcaccatattagaatgattttggtgtgaataaaactattgctaattatcgttggtttgcagcacttctcttttgttacttaggaatgccaaagaaagggtaaaatccctgttacaatgaaggctttcttgctggtaatcagcagtayttggtctgcctgcaactggggctgctttgtcccagaagttttatttctattgactttctgctctttagaatttaaacatttttctttatatctttaactgctgaaactccagctgagggaacagtgggaggggaataaaaagatggttaaagtcatttygtggactgtgagggtgcatgaagaacatgttcttcaaactcagttccacatttaagctgcccagcgagccttgcccttgctattctctctctccctgaagccagaaagaagaagcaggcgactctccaaaggaccccatcttacctgtcacatcacagatgtacctttttagcattctcacaattgagataggattcagagccctgaaacctggaggaaggaaagaaaactctcttttatttagtttccatcatacaaggatgttataaatatcccccatctttaaaaagatcctaagatccctcttagctgttgccaattactctgctcccttttacaacagagtttcctagcattaacgttaatggctgtttccgtttaccctcgtcctgtttctttctttaaaaaaattttttttacatatgtgatatatccaactgattgtcctttttttagaacccactgaaaatagtccttcatcttcaccaatctcctgaaaatattctttcaatgctaccartgactgccattatgctaagcctaatggttcttgttcaaatatcacttctcagagagctactccccacagttactctttaccttttacccagctctatttttgcaagttttttttcccattgtgacatttactttaatagctgtaatttcactctcccaaatagaatgtctgttccatgagaaatgggattttatttcattctttagtaccttgcacactataggtgtgcaataattatttttgtatggattgattaataaaatgctgtgggaattgctacttcacttgtaattttgtttaccttttaatttaattcttagcacagtatctatgaagtcagatttcaataaatacatgttgagcacaagagaattctaattaagaagaaggcagcactctgtagaataactggtttctaggatattgacattcatccagcaatgatttgctgatgagtattcaaattatttggggctacatttccagcagggaggctgagccacaccatttctagtgattggaaagtggctactcttataatgctggggtgcagctagttttcctgtctctttgattagattttgtcttttgttctgcccaggtgggtccctgggaataactactaaagtatgaaaccatggtgttgtctggctttcaatgaaaacatgtagccycgtgccactaaacatgatgtacattataaacatttgtttaccccttagaaggcatcttacttctttgtactattccttggagcatttgatgcacatttttccatcttgttgctcggtcacttttgtaatagagcttgtgtgagttttttttttttttaaggaatttagaactatrtcagtttttatctcctttgcagtttttggtgatagctctgttatgggaagaaggcagtgctgtggatctggactccttggagcaaccctctcaggcacatttctagttgaggtctaagattaggtcactgtggatagagaccagcaaggaatctcaggcttaagacccagttagtacaaagggagtgagctaaggaaaactagataacttagtttatttctctttttcctttggcttcctgaaagccacccagactaaacttgatgttagttcaattctacaagtcctcgggatgaccatattttctttctctttccaaggtgctgaatttctttctttctttctttctctttctttctttctttctttctttctttctttctttctttctttctttctttctttcyttctttctttctttccttctttctttcttctttctgaatttcttttttaataaatctggttttatataactttttattgaaagcttcttcaaattacttttggactggggaaggatatgcttctctgtttttttccttgtatattactgcattccctargagctagtccatgatggcagtcactttagggacttgaaattcaccaggaatgggggtttggggagtcgtggtggtaccttcatgagactaactttatggcctgttttttggtatygactctcctgtttgtcctggtactccttctggaaagttatttttcctgtgtaggtttcctagaattcctagawtwtatcatattgaagtactttgttaactatgccataagttgtgggaaactagagttggcctcacttttcccttcttcctaatgtggatgggaaactgactggcagaaagaaaatcttccccccttcctcttgggtttcttctttttcttttcataatctcttttaagaattttctattaccatttcattcaatttctttcttctttaatttttcgcttcttcctgttacttactctgcagcctataagtggtagatgtatctgtggtagtggttagtaacctgggttatggagccaggttgattggatttgaattctggctctccaactttaccagttatgtgacctttttcaaattccttaacctcttaatgctcaggttcttactctataaaatgggagtcatcatagtatttacttcatgaagttgttatgaagatgaaatgagtttatacatattgagtactttgacacatgtctggcacatagtttttaatacatgttattgatgatgatgatgatgatgatgatgatgattgcttgtttaactttgtgggtagcgcttgaagtaagtgctkktggccaaactggtagattctttctggcaaatcattacattgactggattaatctgtcttggagccagaggaaataacataaagtaacttataaaggatgactctaggaccttgaaaagtcccaggtgtctgggctggacttgtatcggtaatttcttgtgtgtgtgtgtgtgtgtgtgtttcccaatcttggcttaagtttcctaacctacttttaagattccttcttcataataatggttttttctatgttgtcctcagccatgttgtcaaattgtgagaataaaacatgtctgcagtcttcctgtcaagataataatgaacagtgccttatatttgtatcttactctgcttaaaatgatttccattctaagaggtctacaagrtcttcaaactacatttctacaccctcctccctgattatgtaaacagaactatagcatagaaatttcttgcttcaaaccaaatcattaacagtgaaaaaatataaaaactcttgtctgcataattttggggcagctcccaattatgggggaacaaatctgaacatgtatcatttgggattgggagaaagtaaagaaaggggaagcaaggagtggtatgaggaaggatattctcacctttttgtgttagaaaaaaccttaaaggtctgaggcttaatttatagctacttgttgatctttccatyaaaaccaaattcagaaggaagagtttccttggtgttcttatatatggtctcctctcatattgcactttaccctatacttaaattcttgcaggacattatagccacatgatggatttgctctgtgggaagaaggttagacttaggcttgccaagcaaatgaaccaaaaaataagactttagatatctcccagttggaagctcaaaggattgtgaattattgttttctggagtagattgaaactcattaacatctttagcaatggtagtagaatccattcatttctttctttgctcagtgttracagtttggacctgttgtctctgtgtgggtctccaaagagggaaaaccattcagaaacagattttcaggtattttcagtatttggtggagttagggagctctgtgcaatctttcctatgagtatacatcccaggttaactatgcaccraagagatcaaggtgtgcaggggttgagaggggtcctctgctgattgagagtgattctttatcagtgtggatggagacaagaaagctgtgtgttcctcattccaaaagtcaaactgctgacctctggccatcacaataccctccctgatgatatcaagctgggcttcttgtttgttgggtggggaatgggccttgtcagtaaacttgtagtcatgtcagtggttacagttttaatctttcccctttcaattttctggcactggctctcaaaaagcaggatgaagaaaacgagagatccatccagcacacttattccagattctttatatttataattatcaccttaaatgaagtagccaccgttcaagcccagattaattttcctccagacagatagcttatctattgcaaagagctgggttttctacgagtttttcttctgcttgctgctgctcttaaaaggctagataacacattgactctaggagctatctggctcacaggggcaaaggaattgcttgctgacctcacctggtcttttgcatctcttgaagggagaattaataaacatcacttgaagggagagttgtgtgactcatttgaaggcacatttgtaaggcatatcatctcagcgaggaaagacgcaataactctaggcactggctcacttttggactattaaaaaacaaaataaaattcagaaaaaattttaaattttaaccagctatttaaaaatgccttccattttaacatatgattgactatatgtaactctggcaattgagatatttaaggacacttaataaactagctttgaacctctggagatgagaagagttaggcttattcctttactataccaaaaaaaagatcattggagagtccatttttttaaaaagtgcaagttgttaacatggcacaagtttagtacagtttcagcacagaattttgtgcatggcttctgcttgaaaagacttgggactatccaaagaattatcttcaatatatttatatctctataaaatctcaaattgggttcttaagtgcaaaattgagactcaaagtcaattaagacataccttttccttggttaaaaagaaatcagaagatgacctgataatcactacaaaaataatctttcatgaagaagatggtcagaccaaggaagatatcacatttgtgaaaaggagggtattcaaaggccataaaaggcagaacttcaaaatattttaaaaagccraatgaactaaaatgttcacctgtgataaataatagcaacattgaacatttctcaagcacagagagtaatgtcccacccctgtactaagtgtgcacagtgagaaatgtcccacccctgtactaattgttggggattctaaaatgagtaagacaggatccttgatctcagggagtttcattatgtcatggcggaaagagatcaaccatccacagaataaagcctccagtaagaagtcatgagagacaggtggtccaagtctggcaagtagagaggagggacagatagcacgttattcctgtaagggacttcctgattttcaactgtgacctagaaaaccaggtccagtgagtagcagtgaggtggtcatatgtacataacgtggcaacaacaatttgtgctttgaaagcacattatgcttttcaacatgctttaccagacatggtcttttcaggccgctctaccctgtgcagtaggttatccaaatgtgcagatagggaagtagcaacatggagaggacatgaagcttgagtcacagtaaatagctgcttagtggtacctctgggccgccagggctcctgaactctaggcctgctttctttctgcaacccgccagtggaagaaatggcctttcttttttccaagcttgtgcagtggtactttagtttcctgggatgttatctgtatcatgtaaaagaatgtttgattttgaactaaagttaaattctttctcattcttcatcttttggctcaaaagtyacttcttcaggggatacttttctgggcccccaaatctctctgctatgcagtctcacagtcctctgtactttccacattagcacttatcccagtttgtaatttaccatttgtgtcttatttgattaatgtctgtctcccatgtccagccttactctccatgaagccagggagcatayttcttttgtgtatcaatatatgcatttagtgacttgcatatagtaatcactcaataaatgtttgctgaaggaaatttaaggtttgtttactgtttccttttcctttttttttttttttttttttacaatagagtacccaacatgtgagcagcttacttgtgacaatggggcctgctataacaccagtcagaagtgtgattggaaagttgattgcagggactcctcagatgaaatcaactgcagtaagtattgtgcacaagatgtgcagttgtgtgctgaagctggtttatactggtttgagagagccaatatgtacatctcttcccaagttcaggttcagtgaattcatgttggtagtttgaagtcagccgttggtaggagtatttacacactggaaatcggcaaacactacaaaccagggcctttttgttcctggataactggttcttaaacagttaccagcacaccactgcttaataagaatccctttttaaactggagatgctcttcctttgagattaaatggctacaatggagttaacttctctcttttctttcccttcttaactttctgttgcagctgagatatgcttgcacaatgagttttcatgtggcaatggagagtgtatccctcgtgcttatgtctgtgaccatgacaatgattgccaagacggcagtgaygaacatgcttgcagtacggtgatttctttatgctgggtcatgttgttgggagtgttttgttttgtttcggttttgttttgttttatccccccgctccsccaccaatgtacctcttttttcaaggagaagagtcactacgtttgatggcagatggaatcagacggtcactagggggtcttggcacaagcctttgtggtgttgctcgacctgggctcctttattttccaaggatctgtgtagatgtaaagggctggtgatggacagtttgccttctttccttaggctccaggggtacaggatatattgtatcactggattctcaaatgacccatacctctgacaaccttgatagtagaatgagagaagtgtttttaagggaaaggaagttcctaggagtggctctaactctcctctttactttgaaatttctgctgcattaaagttggagggtcaggaaagtttctttttcttcgttttcttttttttggagatggagttttgctttgttgcctgggctggagtacagtggcgcgatctcggcttactgccacttccgcctcctgggttcaagcagttctcctgcttcagcctcccgaatagctgggatcacaggcatgcaccaccatgtctggctaattttgtgtttttagtagagatggggtttcaccgtgttggccaggctggtctcgaactcctgatctcaagtgatccgcccgcctcggcctcccaaagtgctggtattatgggtatgagccaccacgcccagcctgaaagtttcagtgtggtataggtggctttcttgcctccacttcttcackctgaccttgcttttatgtccatgctgttgcctgcaatgcaaatgacctctcttattgttgccacctctccacttatgttttttggaaagagtaaagttagaagactctgtgaaagagttttactatgttcagtaagttggcagctttgcgtggtgatttatttactagaatgtatgatttccctccacacctcttttgattggttggtacccatgccttagggtgttgttaaatattttcratatcaccctaattttcaatgagccatgcctgacttcctttctggaacctgggcttatttcagtgacagagaattaaagagaatgtgacatcatggaatggtcgactcagaatcatttggtcatagattagcaattacggagcttgtagtaaagtatgagaacgttggatgttgtcatgtctgcagcatctttgtctgcattttctgttctgtgccaacgcattgcaaaccatcttgtttttaatttttttttttttttttttttgaracagggtctcactctgtcacccaggctggagtgcagtggtgcgatcttggctcactgcaactccacacacccccaccaggctcatgccatcctcccacctcagcctcctgagtagctgagactacagacatgtaccaccatgcttggctatttatttttatttttcgtatttttggtagagatgaggtctcaccatgttgcccaggctgatctaatttttaatcttgaaaaacagaaaccggcacctgagttcatttcctggacccaaagctgctgktatcttcttctttctctctcttttttwtcctcctttttaaaaatttttgtcaagatgtctaagggattaaattgatatagaaatttcawtttctaggagtactgcttaggcagtgaggtgagagcactttcagtttttcccggtgatttgtgtctttggagtgcagctgttgctttattccagactatccgacctgcggtggttaccagttcacttgccccagtggccgatgcatttatcaaaactgggtttgtgatggagaagatgactgtaaagataatggagatgaagatggatgtggtaaggaggggaagagaytcctactgaaaagcattttcttcaagtgttttccagcgcttgttttttctcctttcctttttagaaattttgtgtgacaagcaagcctcaggattggctggagttgaaggggttgtttaggaacttagtgggtggggaagacggaggtgactgcgctaacttctcctaagaagattcagaacacaaatacagattaaattataatcctctcccttctatctttaaggcaaaataggtaggacagtctctgtctcttctataccccagtctgactttctccctgtaagactgcctgttttaaatagatttaaaactatataaaactaataggctggggaaggaaagaaaatagggaaaatgtcatttgtcttagaccttacaatctttaaaaatgactttgaaccttggtaacagttcagcttatttttttgttttggttttgtaaattctgattcccaaatgagtcactgacactcagtggtgaaagagaggccaccttgggaacacgtgggttggagctggggattggtaagtgtaggagaagctactatccagggaagtgcttaaagattccgtgagaaggaaattgccagtgatattcacccttttatgttgctgatattgacccttttatgttgctgatatcatcagcagtacctccaacaatttagcagttactaatacccataccctacagcaagttacctgcaccattccaatcccaggtatgataagggaaatgcttgttaaaactatgttttatgtttttatgttccagaaagtggtttttctacatttgggttatggtttttcttatactgttgacatttcactaaataaacaaagcaaatcaaaaagcccaaccacaaattcaagtaattctggacctaacttgatggccctaattctataattcatgatttaaataactacatcttttcttaggggatcatgaatttagtttgtcgataattgaggcccatatctgcttcttcctcttataaccctactgggggctgccthttccaggaaaagtggagtaattccattatgcctctccttagaatctcagtaaaagactagtggtagagttagaaatcactaacttattgtaaaatgtagatcatttatagatttctcttgttcaacttgctctrcatcctctgtaaaccactgattaacaaagagctggctgtacctcccctatggcctgtaactctctctttttccccccacagaaagcsgtcctcatgatgttcataaatgttccccaagagaatggtcttgcccagagtcgggacgatgcatctccatttataaagtttgtgatgggattttagattgcccaggaagagaagatgaaaacaacactagtaccggaaaatactgtagtgagtatagacatttacctgggtagctttcagataaagatatttctgttttctagaacagacgttcaaatacagtgtatctgttggcrtttgcataacaaagcaccccaagacttagtggcataaactgagaaacgtgtcttatttctcacagttctgtgggttggctaggtagttcctctggcctgtatcagctcactcacacgtcaggatgttgcagtaaaagcttgggctagcctagccttgttgacccagaggctgaaagagcaaatcctagggctcaagtactttcaaggttctacttatgccaagtttgctcaagtcttattgtccaaagcaagacacttggccaaacccagagtggatggaagaaatagactccatctattgatgggaagagcctaacaattttttagcaactccccgttcctaatccctaacrcacacacagggaggattgtttcaatggcaattttgatgaccttaaagatgttctggagattttattacctggcttatacttatggaaaaaggccttgtctggctgtactaaaaaaaaaaaaaaaaaaaaaaaaaaaaaagcttctggttcctgggttatgtaccttgagttactctccaatggcaaaactgagttggccatgcacagtgttgttcgattatgtcttgtgtgaccacattcatttatgaggaaactgactggaactagggattttttttctccttttttggggctgtagaatattcaccccaccaacaacccmtcaactctgtggacagctgatggtcctgtaaggaaatgccatttaaaaccttgatttcatcaataatatactctaactaaatttgtgattgcctagaagtgcccatgtaactgcaaccccaaggttattttttgtttcctgacaaaaattgtacataatatttaaacaggcagagacctctatggcatttttttctctatttcatttgggagcccatttaaaaaagcttaaaaattaataagagatatgtagtcacagtatgaaagttggaaaataaaaattaaccaaaagaaaaaaatataatcacctgaaatcccatctcttgaagccagccacagttaatatttctagggcttattcttgctccagtcacttgggagttcttagccctttttactatgtagacacaaagatagacccatgcatgacctgatttttttttcataaataagacttttaatgacttatacttgcacatagttataactttaaaaaggagctttttyttttcttttgtttccactcaaggcagcctcttgttctgtcacccaggctagagtgcagtggtgcagtcatagctcactgcagcctccatcttttgggctcaagtgatcctcctgccttggcctcccaaagtgctgagattacagttgtgagccactgtgcctggctaatgcttttatttttaattttttgtgaatatgaggtgtagctacattacccaggctggtcttgatctcctggcttcaagcaatcttcctgtctcagttgaacttttattgcaaagttttgcagtaagctttgaagggtgacagatttttctgtacatctacttcatgcttactgagctgctactcatggaaaaagaagctattagattaatcagtcttgtccagaggtcaccattcatttaacaaagttcttttcttcgtttaggtatgactctgtgctctgccttgaactgccagtaccagtgccatgagacgccgtatggaggagcgtgtttttgtcccccaggttatatcatcaaccacaatgacagccgtacctgtgttggtaagtgatggggggcggcggctacttgtctttcattacagtacactgatgggtgccctgatctctgacatctaggaggttgcacttgtggagagtcgtcatggtctgtyataacaaagagcaacccagacctcacagaaaacctggcaaatagggaattttaactctgagaaggtttggtgtggtgtacaaggcaaaagaatggttctgtcatgagcgagttgactagctayctggaacctatccattacttgatgagggcrgtagtccttttctgttttcttttcaagtatttggcatcaggattggtgcagccatactggttattgaatactgaactacttccatgaggttggtagatagctgctgcctgagcccagcaagcaccgctaccttgctcccctggcctcttctccaggatgcacaagcatccccaggatcccacaactaaaggttgttacctgacacagcagaggatcaccaggtcattgctcaggtgactacactggtgggccagtgcctttgctgggctggctactcattccactgattgtgacatccacttggaactatcattcaagatgagcagattctttatcatggtgcttccagatggtggctggcattaaactagacaccagtacaccaactatttcctcatatctctcctctctgacttcagaaatgatttctcccaatgagatttttgattttgatgccagctttatatctcactgtgattaggayggggccttatgatgggagaattagacttgaccaactatcatcagtttttgttttctcagtgagtttttggtgctctgatcttttttccttctatctgatttttgatacatgaacaacaaacatactagcaggaagtgatcacagagggagtttaaagaaaactatttttactgctgttgggaaaaggcatctggaaggcaattgaaactattcattaaaatttggtagtcatctatggggctccaaaatgattcagaattttcccaggatatttatattcttttgatattccttagaaatgtgaggtattctttagggcttttgggatagcaacaaacatgaaatgtgtaagaaatgcttctagaaaagtatttcttctgaaattattattttaatattattaaaatattaaaattttaatattaaaatattaaaattttaatattttagaactatttggtaacatttggaaaaaattattgaatatagataaacctaatgcagttattcagtctttagtctcagctcattgcttccaacataattatactttgtcaaatacagctaatcttaacaactactcatagccagaaaagcctttctttttttctttattattattattattattattcttcagcggaagtgctagcaaacagaaaaatgtattgataccagaaataaactctggtttgcaaattaaacttgaaattcttgagaaagtctgctcctcagcgttactgaaaactacaatcgttgggctcacttacctaccatatgccaaaaaaaattagatttttatatccagtaaagcaatccatttgagcttttccttgtgttcatagtgggtaactgtaggttcttaatatcaggaccacgtcccaaagttgcccatctaattgctcctcttaagtaactatattcaacaaggtactttaagatcaagtgacttaagtgaactctggaataatttaagaaggcccccaaatttctaatcattttaaaacattttayaaataaaagttatgatctgcaactggacttaaataagattgcaggacacattttgtgttttattgttatcattaccattatattgggaatgcattcaagtaatttacagatacttttcacacgaatgcccttattggttaggtggtgacctgactctgggagccctgcctggatttcaggcagccctgcgcaaaggggcagcctcacttctgctcagagtggggctcgtctgtgggtgtgaggccactcctgtgtctttagcaaatgtcaggctcctttkcccccctcactgctacccagctgccaatcccattcccagccttttagttctttaggcattttccttttctcttagtagaaaagaagttccaatagaaataccagaagccacattctcagtattacatcagcttttctctctttttcctttatcaactcccaaagaggmgttggggctgagctgtcttacagttgaaacttgataggccatgaagkcctttcaggaaaagtgatttgttctttcagaatcgctaattcagtcttgtgatgccccacaagctgttctcagttttttgttccacsctagagcccagataacacattttccatattttccaacatataagtctgtggtgagccttgggttgtatttccaaatgtctagggttttctaaatgtcagagattcaggccacttcaattttcaatagcctctcacaaagcgaaaggctgtcataacaatgttcttgttttataaaattttgcatttaacctactagtgaatgtaaggcagaatattgcagtattatgtgtgcacaggataatttcaggatcagagaagataccacaattaataacacattggaagtagtgtgttctaataccggggcactaattttaagttccacaacagacatcttctttcattcccgccagcgcgtttctgggactttagtacagacaacctcatttggagataatctcaaaagtctacatttgagggcctttgtgaatatgaggcctcctgccacctgcagagaccttttctgtgacctttgctgtccttcaagaatgtgtcatttgcctctgagttttgaggctgggttaacatttatttcacatttgtttcaaagaagactgtatttttctctctttatagagaactctttaaatacatgacgttaggaaaccagttacacttgtttcagctgagctgaatttttaggggaattgttgctttggtttgctctctcaagcatttcatttcaacaaatactctctgtatggctataaccctctgcatggctgacgcattacacaggcttcaggtgttggaaacctatgcaacatttattatcttagacatggctccccagtgaatacctcggtggtaatcaagaataacattgaataatcctgacacgaaatcttgtgtctttctaccattcatctgcctctggtagtsttgacctggcagtggaagctctgaggcatgctgaagcagtttactgggctcattgtttctgattgacaggacatgctgtttgttgacagaatgacatcgtggtgcagagtgagggcagggaggtcattcagcatggtggggtttcacacagccagatggatcagagggtrgccaagggggkctcagttaaaaaggggtttttgagtcattttcacagcagtatttgttggtgggaggagacaaagaataaaaaggaaagaaaaatagataaaggtattggagtgagagggggattgtaaagtagtgttttagtgttttgtgtggtttccactatcttttctactctcacgaaaaccctcaattctacttttatttttcttgtcttcactctggctgctgatggatgttaattaaccttcatattcctctatagtgatccaaggatacaatcttattgtcacaaaagtgacagcaattttatacactcattcaaatcctgttttttgtgatagggtctcactgtcgcccaggctggagtgcagtggcattatcacgctcactgcagcctcccacttcagcctcccgaatagctgggactacaggcacgtgcctccatgcctggctaatttttttttttttttttttaattcttagtacacataaacccttgccatattgcccaggctagtctcaaacccttggactcaagcaatcctcccaccttaccctcccaaagtgctgggattataggcgtgagccactgtgcctggcccactcattcaaatctttaaaccacttgtagtgcaggtgataggaagggcatttgtgctagagaattcctagttatgacttctccacctttggtttccttctgtttgacatcagaacttctgcttagagtgactccagatccttagacgtggtctcatggatcttgcattcaaaatgaagttatgacattctgggggtttgagggagaatgtcctgtactttttttcctgctgaggcaaagccttaggtggagctttctcagggctgagttaaggggacagaagggattcatcagtgagggcatttcacaccctcatgtggcatttcacttggtagtgtccagatcggattgggttttttttcctctggttagtcacggtccttggaaagaaagatatgctggctcatgttgttatgtttaatctgcagggaaaatgggatcattagaagagccttcttggggctggatgcggtggcttacgcctgcagtcccatcactttgggaggccaaggcaagctgcttacttgagatcaggagtttgagaccagcctggccaacatggggaaatgccgtctctactaaaaatacaaaaatattagccaggtgtggtggcgcacacctgtagttccagctactcggtaggctgaggtggaaggatcrcttgaacccgggaggcggaggttgcagtgagccgagactgtgccactgcactccagcctgggcaacagactgtgactccatctcaaaaaaaaaaaaaaaaaaaaaaaaragaaaaaaaagaaaaagaaaagaaaagagaagaaacttggccttttggtgggttatggaatggtgggccacccagcaggaatggttgaacccaattcacaactctgacagttgctgcaaatgtaatcagatcatagaaatctggagaattctagacttgggagtgcagtggtttcagaaattataatctacttgagaacttcctgaaaccagagggtgtgggaactctattgttatagtttgtataggtcatcctcccagggaagcgaggagggtgaaggatgatggagagtggacgtggacttggaaagtcagatgtaccaatttctgcacccctgaagccttatagtctttaagaaagactcttctaatattttgttgtgttctcccctccatattctattgtttatgtcaattatattggaactatttttamacagtagaactgggacttctctggtaatgaacagagctctgtcatgtaagggacttcaatgaacacttactaaatgagtgaataataagttaaccaataagtagaggagaagacatttttgatgtcttgaaaataagttcaatttaattttggttataattttttgacatcagaggaaagacagctgggtaaatagacctttccaagtactttattgcagtcatagatttgtttcttcctgaggggctgtctataggcaggtcttactttattcagaaatagtgctgtccaatagaactttctgcagtgatgtaaatgtgtatcttcactctgtcatattgtaaccactagtcatatgtggctattgagcacttgaaatgtggcaagtgactaggaaagcaaattattamttttattttattttaattaatctaaagatacatttagatagccacagggggttagtggctrccatgttggaaagcatagtattgaagggaaacatttacaccaaaatttatatatttgtagactaacattaataaatgaaatgcagtaccatagggctatgaattcaggaagtgttgtgcattttctgtaaagttatccttcatgtaggtttaaaaaatgatgtaaatgttctttttccttacatgaagatggttgttataaattctcagaacctgtgcctaaytccagagggtgtttatttagacatgggcaacaccacattcttggccatcttatctaggatttttgtcagagagtgcttaataaatgctgataaccttgactacaaatgtgtattttccatatggcagagtttgatgattgccagatatggggaatttgtgaccagaagtgtgaaagccgacctggccgtcacctgtgccactgtgaagaagggtatatcttggagcgtggacagtattgcaaagctaatgattcctgtgagtaaattatggacacctgtgtctctgaacagtraacagattctaatagcttctttccttccttctgatgacaacagaattatcagcatttttgttgttggcagggctttatcattacaaatcagggatggctcctactgcctagaaaaattggtcaacattaatttcatactttgattattaaggaccaatttgtcgaytaatggtgaccattattaatattttttaattgattgattgtttactttgcctaggctatcatgtcacccacctttaattgtggaataaatgctatgcctacatttgattggcttggacatttaacttttaattaattacctaccacaaaagtaggcgacaactatctacagaaataattttcacagtgttcttgcaaaatttagggatatttccaaatggacatgctaaatttggattaacaattttttgaatgcactaactctgggtaatttgttggaatcartgtaagagtatgaaaagtagagagtagtacagagtagtagagaaaagtcatggagaaaatctgcaaaaaatagatgagggctccaaagcattttgtcgctgttgatttctccggacgaaggtctcaatataaactcctattttccaatagttatttaacacttgattttgaagtgtctttggtgtcttctgaaacttaactgctcccatgactgaagaatggcccattttctacttgtttttgtgtagaaatacctgatttgctgtgtagtaacttttaggttcagcggatttttaacaattcaatgtgtttatttttgcataggtaacatatttatatgttcacaaattttaaattataagaagatatgtagtgaaatgccttcctccrtaactattcccctctgcatggttttcaccttctctttcctatgagtaattgccgtttctttattttagttctagagattttttaatgaataaacaagaacatacaaatatagatatttaactgtatttacatatctatatatggtagtaaactatatgcacagttctgcatcttgtgaatgtactgaagatattttccagagctttccatttcagcacatgaagttatttcttaattattttatttatttatttatttatttttatttatttatttttgagaatgagtctcgctctgttgcccaggctggagtgcagtggcgccatcttggctcactgcaacctccgcctcccgggttcaggcaattctctgcctcagcctcccgagtagctgggactacaggcttctgccaccacacccagctaatttttgtatttttagtagagacggggtttcatcatgttagccaggatggtcttgatctcctgacctcataatttacctgccttggcctcccaaagtgctgggattacaggcatgaaccaccgcatccggccttatttatttatttttgagatggagtcttgctcttgttgcccaggctggagtgcaatggcaagatcttgcctcactgcaatctccgcctctcgggttcaagcgattctcctgcctcagcctcctgagtagctgagattacaggcccccgccaccatgcccagctaatttttgtatttttggtagaaacagggtttccccatgttggccaggctgatctcgaactcctgacttcaggtgatctgcctacctcagtccctcaaagtgctgggattacaggtgtgagccactgcgcctggccttaattatttttttataatggcataatattccttcttttatgttcataatttgtttaactagtcctctactgatcaatttttatatcattccttatcttttgctattgccaataagactgcaattaataccttgttcatatatcattttgcatacctgsgagtaaacagacagaacagatttggaaccaccattaccatctttttcagagtgatttcctggtaatctttaaaatgtcttctgtgtttaacaaaatctaaagttgcacatggggctaaggtgcccataccatcaaggagtctcgaaaatatctgagaaatactctcctcagtgtcattgaaagtgcattggactagcatccagaatgcttgaattcttaccaaattcttcctaacttactgagattttggacgcttcattaagcctttttgtgcctcaatttgcccttctgtaaaatggayagaatgctagctatctgtctgcctcagaggtttatgttaaaatcaggtaagacaacctagaagatagcatttgaaaaagcagaaagcatatcatttgtaagctacttcaccatccttgctcatctgaaggagtggtgatgccttccttcttcgcatttagttggcgaggcctccattatcttctccaatggtcgggatttgttaattggtgatattcatggaaggagcttccggatcctagtggagtctcagaatcgtggagtggccgtgggtgtggctttccactatcacctgcaaagagttttttggacagacaccgtgcaaaataaggtaaatagaaatttcagtagctgaatggaaccctgagcacaaagtgttgatagcttttcactyttagagggagtagaggggaaagttcctttgttttctaacaaaaaaggcccttgagatattttatgttaatcagcaccttttccatgctatactattacatstgacctattaaacaaagcagtctattatatggattagccttgagcaacttttaattttattcgaagtggagtccaggagcctaattaaaagaaatagtagacattctttcaaaactggatagatatttggtagtaatttttgaaatttgatcatttaaaatgtaaaaagcacactgcttttctggatgataaaaatcagatttttacctgcatcttctaaatggaactgtaattcgggatcgagtaacaaatattgacggtattttgtttaatggcccaaattttgtttcactgtcttatttggaaagtgtgatgggtttaatttcatcttggagtaatgcaatggagatttttgaaacataaatttcagaaactcttaaagagttatggaattttatttatttcttcttacattttattataccattaatacgattctcatttatttaaatgataacttgcatgaaatttctgaaaattgagaatttagatttttagcacttctgatttgattakagctaaaaaaawtcaaaacaamccacgtagttagtgatgctgaagaaatayaataattttggtttttctttcaggttttttcagttgacattaatggtttaaatatccaagaggttctcaatgtttctgttgaaaccccagagaacctggctgtggactgggttaataataaaatctatctagtggaaaccaaggtcaaccgcatagatatggtaaatttggatggaagctatcgggttacccttataactgaaaacttggggcatcctagaggaattgccgtggacccaactgttgggtaagtgatgtgaaaacatattgattcctgtatttttagaattttctctctccctctatacackgaacatctactggattaatcaaaggctcattctgatttcttttaggctgtatactctagaagccatgtctattttrtgcccttatttatagaagctttaagagagtttattaaatataatcctatttgaggacatgttacccaaacacacctagtggtgtactaaaaatacttgttgttttggggctatgaattttattcttagtgtttgccacgttttcctagctaagagattggattttgtgttctaactcaatctaataatattattacaactaaacatcacttatgcttcattattattaagatgattactctaacatgaattagctgtaaagatttttaaagatggaggttggaactattcctttcagaactttcttgatacaggctgggattgagatatcaatgctaatatctcattacaagttgttcagtctgaatcaatccagcaacaccgataatgcttttcttcaggtttaaatttaaatttcccaatcttcacatttgagaagtgttataggagacttagctttctcctagaatttcacaattgggtcttaggacccttggataagctttaggctattttagtctttgtgaatgatgattattcagttctacttcattatatcagctatccttccttgaaaatgacggaaatgttctctgtgcctcagaatggaaaactgaggagcaaaatggcttgatagcttcttttaaaaggtatttgtaagttttcctgggtgtaaaaaagagaagcaaaggacaaataaaggaaacagaggagaaagttcagaaggtgaatatgaattttttttttttgagacaggttcttgctctgttgcccaggctggagtgcagcagcacaatcacagcrtgcygcagacttgaacttctgggctcaagcaatcctcccacctcagcttcctgagtagctgagactatgggcaagtgccatcatgcccagctaatcttttaatttttgtagagatggggtcttgccatgttgcccaggctggtcttgaaacatgggcctcaagcaatccttctatgttggcctcccaaagtgctaggaccacaggcatgaaccactgtgcctggctggctgaatatgaacttttagactgccatattagtgcatcataatagttgctatttggaactgttgatgctcctgactgacccccacagtctctttaaaaaaaaaaaacaacttaatttccctgttgttttatactgtggttctctaatcagctggataaaatttccattgatccaaacacactgttaaaaaaaattcccaggttaacttgtaaaataccagattctttcatcttctgtttttcttttgtagttatttatttttctcagattgggagagcctttctggggaacctaagctggaaagggcattcatggatggcagcaaccgtaaagacttggtgaaaacaaagctgggatggcctgctggggtaactctggatatgatatcgaagcgtgtttactgggttgactctcggtttgattacattgaaactgtaacttatgatggaattcaaaggtaagaagtattttttatggcttatggctttataagttgcagggaaagtgcataaaatggctgsagagaaatatcaaaggaccagaattaaaatattgctttgttggtggacatgatagctttaatgacctttgtactgacatttgcatgaagtgacctgctctattttgttaacttttcttgtgtcccataacacaagaggtaaacgctcattaaatataacctccagcatttgttctttgatttctcctctccaactcttcccctagtcccacatgatgcacattattttcattcactcctgagttcatttgtgctttgtttctcaagatcactttcccttttaattttctaaccttcccccaataaatacatgttttattaggtatttgatgttgcctactgggaattaattggattttactctgctcttatatatttcaaatttcaaggagaaattctttgtattgtatttttacctggtatacaaagatacttaaacrgcaatatttgaatgtagaatatggctttcttttttttttttttttttgagatggagtctcactctgtcacccaggctgaagtgcagtgatgcratctcggttcactgcaaactccacctcccaagttcaagtgattctcctgcttcaacctccccagtagctaggattacaagcatacaccaccatgcctggcaatttttgtatttttagtagagataaaatttcaccgtgtttcccaggctggtcccaaactcctaacctcaagttattcgcctgcctcrgcctcccaaagtattgggattacagatgtgagccactacacctggctgaatatggcatattttttttcatctttttactctgattagagctaactayaacttaatgtaaaaaaaattattttagatcctctccttttggtattttcaaaaattgggtaaaacatgttcttcaaattttgacccaaaatattattctttgtggattcagcaaataggctggttaacttaatttttcccaatgacttgattttattgttttctcaatgaaagcaatattatagttttgtttcctcttgtatttccattttgtaaggataatatcacagtttgccattggattatatatccttgggacaatctctgcttggttaaatgaagtattgkgtattaatatggtgacttcctatcactgaaactggcttccataaggagaatatgaataaattttatgaaaaaattagctaacccaataagtcacataaaataattgtgaaattgcttaaattttttctctttgggatgttttagcattatattatatagtctaacttttgctgaagtaaaaaaaagtaaagcataaaagataaaaatcaatggaatttcaaaaagatttgagtggtttgctggctgtgaagaaacatcaaagaaatattaaagctcacaagtacagctgaaatcataaagtcattgcctctcgctttgccagcaggtggcattcagggttttggaatttgctaactgagagagaaactattctctaatcttaatgtaccatgtcattatagaatgtttcaaagtgtgcactaacctgccaccttaggtttctttgtttactcccctttagtgtgtttcccagctttaatatcttcaagtcttttcttagagctctattgtcctttttagttttcaggggatgctaagatttttctttgaggtctttgtattacgccaaaataaagaaaataagagttttcccatatcaaccgtcctctgcctcactctgttcatgagtctaactgaatcattgtttatggagacatagtcacggggggcgttgttgatttcctctcttcgcttagtgcctaattttacttctgttttcttcccagttaagtggctttgggcctccattacaagtatgatcagttgatagttccatcaagcagatgcataagagtggtagtggcattgcttcttgctttccttacagtgacatcaggaacagaygtgggcgtttkctggggcttgaaccctaccactcactgtcctgctccctaattgctaggaaatgctcaatggtgmagtgggaaatagttggcaaaggcatcttttcccagacttccaaagtcttggtatactctttcacttatggtattcaaaatgctatttcacatcttagccttttagatgtggggcaacctaaaaggaatgaagaacaaaaggggaaacagtaaattccaaaaaagtctaggacaagctaaaggattgactgggactggaatgtaagtctcaagggtcttttccaagagacaacatgaaaatccttctatcatatgtagatggaaatatgtatacatctaaaatgtatcttttctatctattccgtatttgtgacaagaaattatttagcttttcaggcatttaattgaactaactacagctttaattataataaagcaaaactaacaaattgtatgatatatatgtgtcttttataacaggaagactgtagttcatggaggctccctcattcctcatccctttggagtaagcttatttgaaggtcaggtgttctttacagattggacaaagatggccgtgctgaaggcaaacaagttcacagagaccaacccacaagtgtactaccaggcttccctgaggccctatggagtgactgtttaccattccctcagacagccctatggtaagcctcagagcagtggtaaccatgcttggtaccggacttggtggaaaggttttctcaaagctttgaaagttaataatgaggggtcttatgtgatttgggtggcattctcaagtatatgaagggttacccagagtgttaaactctctgaaactggttctgcaggttaggagcattctgaagaaactgatgtatttcacagttaaatgccaaatctagagggaatttagagatttatttaacagatgtttattagcacctgcaaagatgcttgggggtatagcagctcacaaaccaaaccaaaatacctatcctcattctactgggaaagacatctatttcaaacttctaatattacagttaaggaaacaggtcccatagaagaaaatgacatgtctaagtgtccattttcggtagcatcagagccatttttttcttcttctctgttgcatatgtatggcacctgttctttggttctgattaatctgtcataggccaactgggtttggtgtctctctggctggtcacttattttaaaaaaagaaatattttgattcagacactgcttagtcttctcctgttattttaccacgtgattttttctttttattttttctgagatgggatttccactatgttggccagacttttctggaactccgggcttcaagcgatcctcctgccccggcttcccaaagtgttgggattacaggtgtaagccactgcacctggcctatcataagctttgtttatgtttccaggttatagcttgagctttgataagtctatcaggactgtatatagctcttttctgtatttgcttgtggatcaaagaaaaagaaacataaactacactacgttggtagaaagcttaatattggtgagcaataatttagaggaaaacagatttgctctaaaactcatgttaagtgatggatctatttaggatgaagaaagactgcaaagtaatgaggttaacttaacaaaagcccaaccactagaamtgacacattcagatgaatctccttcaatgtcatcatcctgggaaagtataaacttgtctaaaaatagatattttatctgaaaacatttttggaaatatctgttttgaatagtttttacactcaattcacaactaaactcacacctgccctcacattagatccattagatcaatgatcaatgtgatcactcaaattactattttcattatttggctcagaatgacatctgcctattgtttccccaaatcaatccacctgagaagataaagagaatattttaaagaataagtcaaaggctaaaaagacaattttgaaagcagatataaaatttctagctgtggcagtgctcttcctaaggtcactactttgagagtggcttttggaagtataaactggtttgtgttgcagacatttaaggttttggaatcagatctggctttgaatcctagtcaagctgtttagctgctgaataatgttgggcaagttatttaactgtttagattcttggtttctcctctgtaaaattggaggactaatacttacctcttagagctattggttaagttggtttacttacaaagtaagcatccagtgagtaatatttattatatcctacaaatggcaaaaaagcagtgaagtgtgggttttcttttgacaattatttgtaatcatggaggatagcagacatactctgacataattattggggagaaagttgtaggagtcctttctttttttttgccaccgtctgttggagagtggatgggagagcagcagtgaaattgggagggttagtgtagccagatgtggatgtatccagtagtaaccagtagtaatgttttcaacacgttgctaatccattactctatttcacctataggtgaaaagggctagaagtggcttcaygtcttggataattacacatttctaattgcaatttaaccctgtgcatttttccttccagctaccaatccgtgtaaagataacaatggggrctgtgagcaggtctgtgtyctcagccacagaacagataatgatggtttgggtttccgttgcaagtgcacattcggcttccaactggatacagatgagcgccactgcattggtaagaagtctgttttggacrttgttggcaggtgacacaggtgtatgtgtgtccaaacctctaactagactaactgctactcttgaactggaccagctccctgtctaacttcttgactgcaaataagctttctgtagcccacagggcatcttccttggtaggcaccacttctactatacacagaactatgtttgaaaatgtaaatttctgtcttttgggattttgctttaatcccacatctaaggttttcttgggttcccttccccctttgtttcctgaagcctttttctcctattaactatgatcttgaaattccatatggttgaactttgagctcttttctatgctatgtataccttttccactttagatgttagccttaactttgatgggaagtactgtacttctccccactttgacttctcctagaccaccacgtatgcccctttcaaccaggtaatcacatctgaatcttatctggcttattttttctctctgtattccaaagtaaactcctgagcattggggtggctcagttactcacacagtttttcacctttcagttcaaactttcttgtatctgcctccatattcctgatttcattcttaccttgaaggtttcctttcttcctctttggtttcctacacatctattcacacttaagccatcgcctgggccccagctaatgatgaaatgcactcctacaatatttgtttttcttattttcacttctacawttctcctttctgtgcctgtgacaaattcttgctctccagatgttgcggtttctagcgtcgtatataaattatcttattctaacccagacacatttgttaacttcttaggtagttttagattcagaaaaatcaccctcattaaaaacaacatgtatttctaactattatatcaatagtgcgttgtctaataattttgcttttaaattccgttactgcgatttttatctttgtcttgggcatacctccttcatcttcttgactccctggcatcctgtcacagtctcctctttgctgttaaacatcacttcttcttacctatttcctttatccctccccttccttccctgctttcactcctttayatctttatatttctgattgctgttaattatcttggtatctactgtaaggttcttggtgtagatctctatgcagaagttaaaccaacttgaggattgttacggaattactatagagttcagctctgtatgatttttaaacaaaagattgatggcacaggtgagaaaggtttctgtgtgtgtgtgtgtgtgtgtgtgtgtgtgtgcatgttttgcctgtttattgtaatgatacttataacttgataattaaaactcagtatctaatttttaagcagtcctttttattttatttatttatactattttactttaagttctagggtacatgtgcacaatgtgcaggtttgttacatatgtatacatgtgccatgttggtgtgctgcacccgttaactcgtcattacattagatgtatctcctattttataaattaagcatatggatatcatttttcatataaatacattttaaggatacatttcttaggaagaaggaagattctaatacttgtatctccctcatagttgcttatctttttttcttccctgtattatttctaactatgctttccaaaaatttatttttacatttatttcagaattatattttataatttaaagtttgctctgtggatgcatttatctggaatttgggaggagagaaaagaaccatgctgtgactgactgtgctgtgttattcttcctacagctgttcagaatttcctcattttttcatcccaagttgctattcgtgggatcccgttcaccttgtctacccaggaagatgtcatggttccagtttcggggaatccttctttctttgtcgggattgattttgacgcccaggacagcactatctttttttcagatatgtcaaaacacatgatttttaagcaaaagattgatggcacaggtgagaaaggtttgtgtgtgtgtgtgtgtgtgtatgcgtgttttgcctgtttattgtaatgatacttacaacttgataattaaaactcagtatctaatttttaagcagtcwtatttatttatttatttatttatttatttatttatttatttatactattttactttaagttctagggtacatgtgcacaacgtgcaggtttgttacatatgtatacatgtgccatgttggtgtgctgcaccygttaactcgtcatttatgttaggtatatctcctaatgctatccctccccctccccccaccccacgacaggccctggcgtgtgatgttccccatcctgtgtccatgtgtgctcattgttcaattcccacctgtgagtgagaacatgtggtgtttggttttctgtccttgcaatagtttgctgagaatgttggtttccagcttcatccatgtccctgtaaagaacatgaactcatccttttttatggctgcatagtattccatggtgcatatgtaacacattttcttaatccagtctatcattgatgaacatttgggttggttccaagtttttgctattgtgaatagtgccgcaataaacatacgtgagcatgtgtctttatagcagcatgatttataatcctttgggtatatgcccagtaatgggatggctgggtcaaatgttatttctagttctagatccctgaggaatctccacactgtcttccacaatggttgaactagtttacagtccctccaacagtgtaaaagtgttcctatatctccacatcctctccagcacctgttgtttcctgactttttaatgatcgccattctaactggtgtgagatggtatctcattgtgattttgatttgcatttctctgatggctagtgatgatgagcattttttcttgtgtctgttgcctccataaatgtcttcttttgagaagtgtctgttcatatccttcacccactttttgatggggttgtttgattttttcttgtaaatttgtttaagttctttgtagattctggatattagccctttgtaagatgggtagattgtaaaaattttctcctattctgtaggttgcctgttcactctgatggtagtttgttttgctgtgcagaagctctttagtctaattagatcccatttgtcaattttggcttttgttgccattgcttttggtgttgcagtcatgaagtccttgcccacacctatggcctgaatggtattgtctaggttttcttctaagggttcttatggctttaggtctaacatttaaatctttaatccatcttgaattgatttttgtataaggtgtaaggaagggatccagtttcagctttctamatatggctagccagttttcccagtaccatttattaaatagggaatcctttccccatttcttgtttttgtcaggtttgtcaaagatcagatggttgtagatgtgtgatatcattwctgaggactctattctgttccattggtctatatctctgttttggtaccagtaccatgctgttttggttactgtagccttgtagtatagcttgaagtcaggtagtgtgatgccttcagctttgttcttttggcttaggattgtcttggcaatgcaggctcttttttggttccatatgaactttaaagtagttttttccaattctgtgaagaaagtcattggtagcttgatggggatggcattgaatctataaatcaccttgggcagtatggccatttccacaatattgattcttcctatccatgagcatggattgttcttccatttgtttgtgtcctcttttattttgctgagcagtggtttgtagttctccttgaagaggtccttcacatcccttgtaagttggattcctaggtattttattctctttgaagcaattgtgaatgggagttcactcatgatttggctctctgtttgtctgttattggtgtataggaatgcttgtgatttttgcacattgattttgtatcctgagcctttgctgaagttgcttatcagcttaaggagatattgggctgagatgatggggttttctaaatatacagtcatatcatctgcaaacagggacaatttgacttcctcttttcctaattgaataccctttatttccttctcctgactaattgccctggccagaacttccaacactatgctgagtaggagtggcgagagagggcatccctgccttgtgccagttttcaaagggaatgcttccagtttttgtccattcagtatgatattggctgtgggtttgtcataaatagctgttattattttgagatacatcccatcaatacctagtttattgatttagcatgaagtgctgttgaattttgtcaaaggccttttctgcatctattgagataatcatgtggtttttgtctttggttctgtttatatgctggattacgtttattgatttgtgtatgctgaaccagcattgcatcacagggatgaagcccacttgatcatggtggataagctttttgatgtgatcctggattcggtttgccagtattttattgaggatttttgcatcaatgttcatcagggatattggtctaaaattctctttttttgttgtgtctctgccaggctttggtatcagaatgatgttggcctcataaaatgaattagggatgattccctctttttgctttgattggaatagtttcagaaggaatggaaccagctcctctttgtacctctggtagaattcggctgtgaatccgtctggtcctggacattttttgggttggtaggctattaattattgcctcaatttcagaacctgttattggactattcagggattcagcttcttcctggtttagtcttgggagggtgtatgtgtccaggaatttatctatttcttctagattttctagtttatttgcatagaggtatttacagtattctctgatggtagtttgtatttctttgggatgggtggtgatatcccctttatcattttttattgtgtctagttgattcttctctcttttcttctttattagtcttgctagcggtctatcaattttgttcattttttcaaaaaaccagctcctggattcattgattttttgaagggttttttgtgtctctatctccttcagttctgctatgatcttagttatttcttgccttccgttagcttttgaatgtgtttgctctcgcttctctagttcttttaattgtgatgttagggtgtcagttttagatctctactgctttctcctgtgggcatttagtgctataaatttccttctacaccctacttcaaatgtgtcccagagattctggtgtgttgtgtctttgstctcattggtttcacagaacgtctttatttctgccttcatttcgttgyttacccagtagtcattcaggagcacgttgttcagtttccgtgtagttgagtggttttgagtgagtttctggatcctgagttctaatttgattgccttgtggtctgagagacagtttgttataatttctgttcttttacatttgctgaggagtgctttacttccaactatgtggtcaattttggaataagtgcratgtggtgctgagaggaatgtataytctgttgatttggggtggatagttatgtaagcagagattttactaagcttcctaaatagttttagattgagaaaataaatttattgcttttttatggattaaggtaaaacaaacacctttcctttattttagaaacacgttatttttgggaaccgagacgggaggattgcttgaggccgggagtttgagaccagcctgagcaacatagtgagattccacttgtaccaaaaaaagaaaaaaattagccagatgtggtggcatgtacctgtagtccccactacttgggaggctgcaatggaaggattgtttgagcccaggagatccaggttgcagygagctatgaccataccactgcactccagcttgggcaacagagtgcaaccctatctcggaaaaaaaaaaaaaaaaaaggttacaaacgtgtgtgtattttaacaatgaccaatgttaacataaaagaaatgtcacgtgtatgagagccattaacagattaattgactagacactgtttttcatactcaagcagccagattgattaaaggggaagacatctcttcagggatgctggactatgtaaatgccaagggtttggtttgtaatagtaataaaatttgtaagcaatataacataccaactaagagagccagcttaggagctacactgcctggttccaaattccagcttcccacatttcctagctttgtaactttggggaagttactcaatttccttttgcctcaattttctagtctgaaaaatatgcggttcatatattgctcataaggttgttgagagaatttttggctaatgcatgtaaacacctagagtaatggctagaaaatagtaaatattcagtaaatgttggatatcattwtatctgttatcaatataaaaccatattgcccaccctcccctgcccctaatccagacctgctctggggagggaacagctcttttgactatttcttcttttgtttgtctccatgtttctaaatgctttgtttatacttctatttcttgatttatcatttttgatatttacttccttgttctaggtgagcgttttgctttcttacatcattcttctctcccagcttctgacttccctccccccattctccttaaaaagctagattataatttttggttaaattaatcatatgtgtttatattattaacataatataaatataaatattgttcactgctcagccaattagtattctaggatgacatttcttgacaatttttgacaattgccccattttcatttgcttagtttttaaatataacaatcatgtattttccccaaatgctctaatagctctatcaaatgcctgtacaaagacagaaaacaatctacaattttttttttctttctggagacccctatcctgtgttccaattgggacttgtttttctctggcctggtgcacagacttctctttgccactcccctgtgctggaacttctgtttgtggcaggccatttatttctttttctagatttatttcctcattttgctgaaacamgttacatgatagcttcctgagaaacataagtaggtggcatatattttgagtctttgaatgtctgtgagtgttttattttgctctccatcttgactgtttggstgggtacaggttgcaagttaatttaaacctggaatttgaagacattgctctagtgacgtctaatatctagtgttgagtccagtgccattctgagtaccatttctatggatatgactttgatatggatatggatatgacattaaaaattaatcttcctctgtttccattttctctggattccttttccttttgatttcttttcaactttcttctttttgatggaagctttttccaagtgtctgagttgctagtttggtattaagggtgaggttataaaacctgacccaaaagtctgtacatgtggataggccttgtcagctggtragcttcaggcaggaaggtggcttggttgccagattgctccccaaggcaacattagtgagtcttttctggagatggtcaatttctccttcatagatgcctccattttccttcrtgaggtaaggggaagatgtggggagatggtkgtctgttctgggggtgattaatttctcctccatagatgccttcattctccttcttggagtaaggggaagatgtgggaagatggtggtctgttctgggggtgattaatttctccttcatagatgccttcattctccttcttggggtaaggggaagatgtggggagatggtggtctgttctgggagtgggcagaggaaagggagctgagggcgccctttcagtattcctataatcctcctgtactcagttccacatccatctcagttctgtgttgaggactgtgccttgaacccatagccattctgcttcagctcctccagagaaaatctgtggtcccttagaggagatagaggagtggcgtgacactcaggatctgggagggacctaggcattggattgctccttatcttgctttatctgagccccttagttcctcgcccctgcctttgttaggacctggtgcctctgagtgtgagtgcactgaggcttctgcatatgtgggtgtgtctctcttctgttgacacttagtttgtagcattttccccttcttaactgagttatcactcctccaataccttacttttcaaacatttgttggaattactcatctgctgttattttactgtcttttaagtagaatttcggaggaagaggagataaacatgtttggtttgtcaatctgctattttgaatgagaaattatcttttttgaggacttagaatcaggcccactgagcttggagcactgcagtcgagcttagttctcaggaaaaggtagtattgggtttctagctgcatgcaggccaagtctcccacaggcacctccacaggtcagcttccttctgttttgttgatctggaattctcatagtatttttggtaaacttcaagttcgtatgctgagcaacctaccttttttwaatttttttatttttatttatttatttattattatactttaarttttagggtacatgtgtacaatgtgcaggttagttacatatgtatacatgtgccatgctggtgcgctgcacccactaactcgtcatctagcattagttatatctcccaatgctatccctcctcccgcgccaccccacaacagtccccagagtgtgatgttccccttcctgtgtccatgtgttctcattgttcaattcccacctatgagtgagaatatgcagtgtttggttttttgttcttgtgatagtttgctgagaatgatgatttccaatttcatccatgtccctacaaaggacatgaactcatcattttttatggctgcatagtattccatggcatatatgtgccacattttcttaatccagtctatcattgttggacatttgggttggttccaagtctttgctattgtgaatagtgccgcaataaacatacgtgtgcatgtgtctttatagcagcatgatttatagtcctctgggtatatacccagtaatgcgatggctgggtcaaatggtatgtctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgaratggtatctcattgtggttttgatttgcatttctctgatggccagtgatggtgagcattttttcrtgtgttttttggctgcataaatgtcttcttttgagaagtgtctgttcatatcctttgcccactttttgatggggttgtttgtttttttcttgtaaatttgtttgagttcattgtagattctggatattagccctttgtcagatgagtaggttgygaatattttctcccattttgtgggttgcctgttcactgtgatggtagtttcttttgctgtgcagaagctctttagtttaattagatcccatttgtcaattttggcttttgttgccattgcttttggtgttttagacatgaagtctttgcccatgcctatgtcctgaatggtaatgcctaggttttcttctagggtttttatggttttaggtctaatatttaagtctttaarccatcttgaattgatatttgtataaggtgtaaggaagggatccagtttcagctttctacatatggctagccagttttcccagcaccatttattaaatagggaatcctttccccattgctttttttctcaggtttgtcaaagatcagatagttgtagatayacggcgttatttctgagggctctgttctgttccattggtctatatctgtgttttggtaccagtaccatgctgttttgcttactatagccttgtaggatagtttgaagtcaggtagtgtgatgcctccagctttgttcttttggcttaggattgacttggcratgcgggctcttttttggttccatatgarctttaaagtagttttttccaattctgtgaagaaagtcattggtagcttgatggggatggcattgaatctataaattaccttgggcagtatggccattttcacgatattgattcttcctacccatgagcatggaatgttcttccatttgtttgtatcctcttttatttcattgagcagtggtttgtagttcttcttgaagaggtccttcacatcccttgtaagttggattcctaggtattttattctctttgaagcaattgtgaatgggagttcactcatgatttggctctctgtttgtctgttattggtgtataagaatgcttgtgatttttgtacattgattttgtatcctgagactttgctgaagttgcttatcagcttaaggagattttgggctgagacaatgggattttctagatatacaatcatgtcgtctgcaaacagggacaatttgacttcctcttttcctaattgaataccctttatttccttctcctgcctaattggcctggccagaatttccaacactatgttgaataggagcggtgagagagggcatccctgtcttgtgccagttttcaaagggaatgcttccagtttttgcccattcagtatgatattggctgtgggtttgtcatagatagctcttattattttgagatatgccccatcaatacctagtttattgagagtttttagcatgaagggttgttgacttttgtcaaaggccttttctgcatctattgagataatcatgtggtttttgtctttggytctgtttatatgctggattacatttattgatttgcgtatattgaaccagccttgcatcccagggatgaagcccacttgatcatggtggataagctttttgatgtgctgctggattcggtttgccagtattttattgaggatctttgcatcaatgttcatcaaggatattggtctaaaatgctctgttttggttgtgtctctgcctggctttggtatcaggatgatgctggcctcataaaatgagttagggaggattccctctttttctattgattggaatcatttcagaaggaatggtaccagttcctccttgtacctctggtagaattcggctgtgaatccatctggtcctggactctttttggcaacctaccttttaaaatattcctcatagtcagtggttaaactctgtatgctttgttgagggaggcattacattgttcttttttttttttttgaatgagtacacagtatatgcaggaaatgagttgtcagaaatcaaattagctaatgtggtggtgtggtgtagtgccagatacttgggaggatcacttgaggtcaggtgtttgaggctgcagtgggctatgactgtgccactgcactccagcctaggtaagacctgtctctaaagaaaaagaaaaagaaatcatattaaaagtcaggattagctgaatgaarccctcaggagaactccctccttcaatgataccttcttttttccaaattctctttttctactgacttttccctatcatcagatatgctcaagtttctcccatcctaaaaaatatgcaacttacccttcactccatgttcctctttagtgataaccccttctctgcatttcatggtcaagtttcttgaaaggttgttttgcactttcctatcccttcttccacatttctcactgattactcacctcttgcaatctgcccaccaggtggctgacacccctctcatcctggtcacctctaatccctttcttgctaaattaaataatgcctatcagtcctgtatttggtacttcagccatcttctctcaaatattctttcttccatgacagcatactcctggatttccttctatttcttgatcattttttttttttctagtgtaccctggagatcttttctttttctcctgttctataaaaaactgtaaatctgttgttcaacattggtcctcctctctctgaataatttcacacctttcctgcctttgattactatctatgtagcaactataaataattatggggagacttttataatagtgcatttactgagtgtttttcctcctaaactggggaatgagggaaagaccaagcaagcctttctgtaggtcatgataaaaatctctatgcaagttctctctctgaggttcagacccatagtgccagctgccttttggatacgtcacctggatatcctacaatcacctctaaaccaacatgtctaagtggatgcttcatccaacttctcacaggccttagaggaagggcatgaccactcaccccttccttggtgccccatccccacctggtggtcatcatgaacatctccctctcttttagcctctatcattaactcattaacctccagccacactcctagaacatgtagagttttcagtctctgtgtctgtcaaccaccccagacctctgctttgccatgtggcccattaggaatctgtgctctcagaccatcctatgcatctctccatctcagcactcattactcttttatttttgtctcttggcctagttgcctcctcctctttcaccacctcactatgaattaccttgagggtggtgtccacacttctttccagatgcttaacttctctttgacttggttcyctcatctgtagaataggaacgatactaatgcctacttgattgagtggctgtgaggatggatgaatccatgtagaatacttggtccagtttctgccacctastaagtgctcatttaatctaagctgtgattattaacactaytaacaatattgtgttttctaaatatatagttggctttctatcacatagagaactttcttttcacaatttgctgaataaatgaagagaaaaagtagtaggattttttcttcctactgcaaaagaaagaggtatggctgtttattctgattcagattttctttagtgaaaaaaagaaaaaagagggtaaaagaaagcataataactccataaagaggaaagcgtttttttttttgttgttgttktttttaatcagttctgatttcctttctggtatctctgctggtgttttcaaaacttggcaactttgtggctgtggaagactgttgatgagagggttgggcgatgatacctcagggttaccctcaggtcgtacctggtggtgtcagcttatcagagccgwctccgggtggtagtaggtgaactcaggtatctcttcttcagatattctacagtgagaaatttttttctggaaggttggacatgggagtaaatccaggccataccattcctggttctgtttgtcagtatcatatctactctttgagatccaaagtttgaggaatggatagattctaggtttgtctcatgttattgctcagcagcttacagagttttttttttttttttttaaagaattccacatgtgttcctgaaatatgctctaactctgacacaaaatttcagtgtgcattagtaggaaaattgatgccttacaaaatatacttagcttaaaatatgtccatattttaacttataggaagagaaattctcgcagctaacagggtggaaaatgttgaaagtttggcttttgaytggatttcaaagaatctctattggacagactctcattacaagagtatcagtgtcatgaggctagctgataaaacgagacgcacrgtagttcagtatttaaataacccacggtcggtggtagttcatccttttgccgggtaagtgtgttcatgttttcctaagagcttgaaactgtatgtcttttacagtcattgaaaagtgatgccctagggatttaggtaagttcagcaaatataagattgaactgtatwagttgaaatcaccttaaattttatttcttttttcctccraaaaactttattctgggggagtaaaaaaaattgtttttaaacccaaaacatttcttctaacttttggctttctcagtcttcactgaagagtagtttttttcacagttgcagaggaccaaacaatgtgatatagattcagtagaaaaggagtgaataggcaacagaattaacaggaaagacccaaattctttccctgctttaatatatttatataaagcttagcaaaacttgcttaatcattcagtagttttcagaataaaaagtttttcagaccacaaagtttcatgttttaccattctataattggtggtgccagacaaggaaagacagaagagttcacagtattcctttttggttcctacttttcttatttaaatatgtttaacagctactgtgtttatttagaacaaatctgagctatgtgttgtatatgagtggaatgataaaaaagatggctgctaacccaccaatgcctgattacccagggaacatccatacctgttcttccgttagatatataatctcatcagcttccaaagctagtttgtgaaggaggtatgtgtaaatacccattttagagagaatgaatctaaggcgcagtgagataaagtgacttgtgaaagggcccgcagctattaggcaacagtcagtattcaaattccagacctgtctgactggaatgcctgtgtgcctaaaaaagtctgtttgctgcrtctagagtatctgctttaatttcctctctgtaagataataaaagaaacacattttaaaactgatgttattattgataagaaatttcattgccctatagagagttaaacagtttagttttttaatgaatttgtcttaactcaaacttttggcctttggttttgaaaaactgttgaattcctttcctgatgactcttttgtttaaaatgatatgaagtagttacatttcagaaagttacattttggaaaagaataattttgattcctctggatcccataaaagagaaaaagttgtttttttattttcttttgttttttttgtgttttttktttttgtttttgtttttttttgcctctagacttatctttttcccactctttagaatattaaaaaaatgcttgggtcagatactgtttgcattgcattgatttggatgctttcttcatctgagatgaatggtttcctgcaaatttatcaattccttatggaagaatgactagaggatcctgaatgtttaatctagagagaaagagattgaaatgttttcttgctctgttcgttgtttattattttattttaataacgtggaatatttaataggtaacctgaattgtgtcttgttagagaatatgttaggcgacaatagttttagttcctaaactctgagacagtggttctcttctctcaatgcccatttaaatgccatttgtatttgtgactttggttacatgttaactaaattttaactgagaattacatgagttatacactaagtatgttaagttcaatagcatataaagaaaacaaaattaattgcagtatctggagaatctctgtttgttctaaatctctggaagtcatgtagtttgtcccagtgttaacagccttaatttactactgctttttctaggtatctattcttcactgattggttccgtcctgctaaaattatgagagcatggagtgacggatctcacctcttgcctgtaataaacactactcttggatggcccaatggcttggccatcgattgggcgtaagtaggaatcatcatccccgatacttagttctcttttactgcagaacacataatgaggcaggttgggtgatatgatggtgtaaggaaactggtactgcttgccctcgcggaattttaaataattaattggtgatgggagaaggatattgaacaagaacacaaaggacataaacatagttggccagctactgctggggtgaaaactaataaattcatgagtattctgagaaaattrctagagaaagctgaatgacaagatttagtggaaactcaagatgggggaggtgggtcccaagcagcatttaaagtagggtacagatttgttgaactgtaggcagtgtgtaatttcttacagggaacatcttgagtttaggaaatctttggagtcaattaatcaacaaatgcacctttgcttacatgcactttgggaggactttaaaagtataagctatggttctcaagaaattgatgatctatctaggaatataggaaaaggaatagagtaaataagcttataaagatgaaatgccaargtaacttatgggagaaaaaaagggaagaaatatatttcaccttttaaacatagattactaccamtgtttttcttaacttgttgatttcacaaggagaaaataaaatttctggctcaaagatagcaacattttaagttttctaagacaattgattgaaagccacttcatgaaaagtagccgtctctttctgggggacataaaactgttaaatttttaatgaatataatttaaattttaaaaactttgtttaataaatgtgtcaactgaccctactgtttttggatgccctttgtgtaaagggtgctctgatagtttttggataagagataactaaatattttattattttagtgcttcacgattgtactgggtagatgcctattttgataaaattgagcacagcacctttgatggtttagacagaagaagactgggccrtatagagcagatgacacatccgtttggacttgccatctttggaggtatgttttaaagcaataaaagtatgtattgtttttatacattgcaagttacaatagtaaactcatcctcatgtggcattttcacaatcccagaaaagctggccactttaaaatgaaaaaatttaaaatggtgctatatatttagacaaaacatttggtttgttgatggtgtatttcatttttagagtgtgatttttgttttgtatatattcgtataatgttgacagtgtatatgggtacagcactttgtagattacatgtattatacaattcaacatcccaagtacttagttatacaagtatcacgtgaggaaacagtaaattactgccttcattttcaagaataaaacagcaagagctgtttatagtaatcattgtagcatttcattattctccagtgtttgtaagaatctcattagaaatccttgtggaaaaaacgattacacatattcatcaactatatgctgactgaatgactttgaaacttttttattcaaaatgttggagaactgacatcrtctttgttttatggaagtgttaggttatgctttatgaagaacagcaagacataattttttttcgtcaacctttccaaataatttcatgctactagtgaagattgctgagaagcatgaattctggggaactacagtcacaatgagcacagccartgcttgcctgtcttctcagctccccatttgagtgcaggcatgctgctgtgagttgagtttctgggaataagaatgtagcctggtaccatgaaacaggtggtttgcttagtcttgaaaacaggagctctgtgaatggttgtatagcttgtgcactgcataaaaatgccaggccaagagggtgaggagacactgaaatctatcctgggtctgtttgacaaaccatgattactccagttagaggggtcatgttttgtttaagtctaccaaaagccctgtgtatatgctagttgtgtccctggttgaaacctcctactttgaataattaacacagtgcttgaaaagactagacactcactataaatcaaagactttctcacatgcatagaatgtatgtgtggaatgaatagttagtaagtatattgcatatcttgtcctgctgtctgtttatctgtggaggagtgtgtggtatttaaaaaatgctcatgagatttttgatgagttaattataaatactcctcccgtccccctcccgccgctgccatccatttactcccttttcactaatgatgtcagacacatgctatttgctgtcacatagaaacattataaaaagttgaattttctctgctctgggctgggatgttttgggattcgagaaaatgtagttttagtatcttttggtttcatcagtatgaaaaaaatttgaatgcatacccatgaggacaacacaacattcccaaaatagcaataattatttatttctttcaacattgctgtttttttttttttttattatactctaagttttagggtacatgtgcacattgtgcaggttagttacatatgtatacatgtgccatgctggtgcgctgcacccactaatgtgtcatctagcattaggtatatctcccaatgctatccctcccccctcccccgaccccaccacagtccccagagtgtgatattccccttcctgtgtccatgtgatctcattgttcaattcccacctatgagtgagaatatgcrgtgtttggttttttgttcttgcgatagtttactgagaatgatggtttccaatttcatccatgtctctacaaaggatatgaactcatcattttttatggctgcatagtattccatggtgtatatgtgccacrttttcttaatccagtctatcattgttggacatttgggttggttccaagtctttgctattgtgaatagtgccacaataaacatacgtgtgcatgtgtctttatagcagcatgatttatactcatttgggtatatacccagtaatgggatggctgggtcaaatggnnnnnnnnnnnnnnnnnnnnggaaatgcagaaatcaccgtcttctgcgtcgctcacgctgggagctgtagaccggagctgttcctattcggccatcttggctcctcccctcaacattgctgttttttgtgaatttcttttggaaagttcttttgttgtgcaacaccatagaaattgtgtacctttttactaaagggctagatcttcttgattgtgcaccacacagaactaaaagatttattgaactccttacttatttaagtatatgaggatgcctttgttagtagtgggactgggattgccaggctctagaaagatttagggagtccaatgactgattggtcattgattagaccacagataaggaaattggtcaaataaaatttatgacatcttaaacattttctgattaattagggttttctagttaaactatcattaaagagaaaatccacattgatgcaattctttcttttaaaaatatatgtttattttcctgctgcaatagttagtgtaaagtgaacatgattaaatttttgttgtttagaatcttatgtcgcctctctcttaccattgtgagcatcattctaacattagtagtgtggttgtaggtgaatccacacttgtgttgagatttttattgatcctcaaacatacactgaaagttccttttttgggctagacctgtacttttccttctcaacagcttcttatttaagtcaagggaaaaaaattacaatttaagcgctgtcattaaaacatagaatatgaactgtttgacctgggaaggatctcaggaatgattcagactgtctccttcacacagcgtagtatttgcctaagagcactcagcaggtgagtgctttagcgggtgcagacctatgaggcctcatttaatgctctgtagaagaattccccaattcttattttcactattacctatgcagawctaaatccaattgctactaaatgccatcataaaactccatatgtgcttgcctgaacctgaaccctgatattattaacatacagacttccacagagcattactagggagtaacaagtcgtggaaaatggttagagaaacatattacagatatttatgggggagatgatcgtacttgcaagaagcatttcaarcctattgcattttctcaagtgatttatttataagttagctgtgactgaaaatactaatctacccatgtttcttttcagagcatttattttttactgactggagactgggtgccattattcgagtcaggaaagcagatggtggagaaatgacagttatccgaagtggcattgcttacatactgcatttgaaatcgtatgatgtcaacatccagactggtgagtgagattgcccagttttttttatttttttgtatgggtttatttatttgttacagtggctcctgttctctttaagtacttattacttaaaggtctagctcctggtagttttatattcttgtcgttcacataatctaagagtgtaagacttgaaatctctgttcaatgctgctagccttaaacatgttgtcaggaaaaacacattttgggacttttccatacctaaatggaatgttgtatttggcgggttgatttccaagaggaagctactttttagtattgggtctgaaaaatgttttgtcctgtttgttttccttcacaaatcaaacccgtgacctacytagtgaaaatgtacatgactgactccctcggggctttgcttttgcaggttctaacgcctgtaatcaacccacgcatcctaacggtgactgcagccacttctgcttcccggtgccaaatttccagcgagtgtgtgggtgcccttatggaatgaggctggcttccaatcacttgacatgcgagggggacccaacmaatgaaccacccacrgagcagtgtggcttattttccttcccctgtaaaaatggcagatgtgtgcccaattactatctctgtgatggagtcgatgattgtcatgataacagtgatgagcaactatgtggcacacttagtaagtagctatgcactggcgatatttcctgggatgaatagagtagaggtgggctttaaagaaaataaataaaagcttgggctatttatatgggaaaaatatcttttagaatttcagattcttaacatgcactttgaaggyttttaggaagctaagcaagaaatttcattcataatgttatggatggtttctggccttgatttagactatcttcaacaatwtttttccttgacattggctgtttggaccaatgcagtcattatgtcttggcaaactcctcaaaaagtcaaatcgaaataaactagatctgaccaggcaaggtggctcatgcctgtaatcggaggccgagacaggaggattgcttaagtccagaagtttgagaccagcctgggaaacatgacgaaatccggtctctacaaaaaatataaaatggcacatgtatacatatgtaactaacctgcacattgtgcacatgtaccctaaaacttaaagtataataataataaataaataaaaaagaaatagatgagctcagaaaaaaatatgtatataaaattacaaatagctgggactattacaaaatacaaaattacaaaatacaaaaaaaacaaaattacaagtagctaggactacaggcacatgccaccacacccagctaatttgtattttgtattttcacaaaatttgtaaaatacaaaaatttgtacttgggaggctgaggtgggagagttgtttgagctggggaggttgaggctgcagttagccaagactgtgccgtgtacttcagcctgtgcaacagagtgaagccctgcctcaaaaaaataagcaaacaaacaacaacaacaacaaaaaccaaaaataaagtagacctaacatttagcaaccgagagaatagtatcacagaataactacttgcaatcatagcctttggaaaatctcatgtgttatattccttttctcccatgttagagtaaaataaattaacaatgaaatggtggtcttaacctttatattcttcttttgacggtaatctagtctatatagtttggggcctaataaacactattgcagaaggcaaaagtattacattcaaattaaaaaaaagatagaggacagttgaaatctcagaaatctctatcaaggtgaagttaatactaataataacctttcttttggagagaaagaggagtgacagatttgcaagagtaaagtgctcacttgtacatttttctgaaattttttaaattttcatctttttgtgtattatcttcttgtttctaagagcacagcattttaccttaatattttatctatttgcacttttcatatgacatattttcaagctttctatagtctgaatttgaaattgtggttggaggaagtaacagcttgaaagttaaggatgagctttagagtgaatccaaccagagcgtgaatcataggcaggttcctaaatctctcaaagactcaatttccttatctgtaaaatgcagacaattatatgtactttatagtattcttgtgaggatttaaagagaacttatatgatgtgtgtgggtgcataacttagaaaaatgccttttctatgataaataccaaataaatgccagccaataatgatgttagtgatgatgacatcacttgatgaacatttctccttattatatacaatgcctccattaaaaaaggtgaactgagcctttataaggcaagaactcatttaaaaggctgtaaaaacaaatgtcttcatgaccagtttgttactattgtagataatacctgttcatcttcggcgttcacctgtggccatggggagtgcattcctgcacamtggcgctgtgacaaacgcaacgactgtgtggatggcagtgatgagcacaactgccccacccacgcacctgcttcctgccttgacacccaatacacctgtgataatcaccagtgtatctcaaagaactgggtctgtgacacagacaatgattgtggggatggatctgatgaaaagaactgcagtaagttttgagctggtttcccttggttggtcagcctcstaaatagwcttcaacaaccaaatggccttgcattctttcctctaaggctcatgcaattttcattgtctctttagtacttctattccacttgtcaatctctgtgtcaataggttacaagaacaaaggcacgtgcctgcacatgggattcttagagtccacctacaaatattgagttctatggaagcaaagcaaggactgcctctgatgccaaacatttcaattcagataggaattgaaaaagtgaaaatccctcagctatctatttatatatttaaaacaatactaaaagtcatatagatatatccagacctttggctattgatgtttmtttttcatttggtacaagcaaaaagacatcaaaataaagaggcacagaaaatttaaatttcctttgatcttatccacctgttttccatcttgccagttctgctttcctttagcttgttgttttatttcatgtcttcaataatagtttaagatggagcaaagttccctgggctaagttctagtcctggttgcctgactaggcaagtcactatcatttggaatagatgagctttaagatcccttctagctttcataccctataagtgtgtatttaatataatttcatgttgtgggtggggccagccactgcatccgactccaaggctatggtcttaacagtaaggtaggaccctggtttttagaattgttctgttcagacttttaaatccagttttgggggtctgtctacacactgttgctactaggcatgtgggtcatgctggttttgttgcctgattgggctccattgcttggckttggtctagagtcatggacttcatagtattcatgaaatgtagtccaagtccaagcacatgatgctcactttctgaatgtggtctattttccaaggtgtaatcacagtttctgactctgccctgtaatctttttattctcaattctaaaacctatcctagttttgagttcttttgcttagctgactttgatagtgtggctgattcaaaagaattttgaacccatgtacaattgagataacttctgtagctatttagccatttttagtttggctctggtacttgttgcacaggaaataaacttgttggttttgttttcggatgacattagattcgacagagacatgccaacctagtcagtttaattgccccaatcatcgatgtattgacctatcgtttgtctgtgatggtgacaaggattgtgttgatggatctgatgaggttggttgtggtaagtgcattgcyttcktttttattcacaatgtttatttagaaaaatctcagtgttaacacatggacacagggaggggaacatcacacaccggggcctgttggggggtggggagctagagaagggatggcattaggagaaatacctaatgtagatgatgggttgatgggtgcagcaaaccaccatggcacgtgtatacctatgtaacaaacctgcatgttctgcatatgtactccagaacttaaagtataacaacaaaaaakaaaaatctcagtgtttagtcattttagccctgagctaatttctaatgcttttctctttcattcttagtattaaactgtactgcttctcaattcaagtgtgccagtggggataaatgtattggcgtcacaaatcgttgtgatggtgtttttgattgcagtgacaactcggatgaagcrggctgtcgtaagtaacacatacccagmatgtttcagacaaaggggtcatttcatttttgccagtattgatattgatattgccacacattttccctaactcagacaaactgggggaaagtatcctcaaaggaatgtggtattgaacatacagtaaaattgagtagacattgccatataatgtrtaattaacaaatcaagtggttgtataaatggacacttcaaatagtctcttagatgggctaaatatttcttagatatttttgttttcacttttagtttttcttaggacttcccactttagtaggtttaaacttttgaggctctactccatataaagatattttactggtttcttttaagtktcagtagagaagtcatatcatggtgtagaaatggtatggagctgtgtttagtattgactctgatgaattcattctttgtgctattatgtgttgaatatctgctaagatgttatctatggagattatagaaggcaagagacaattaagcaagatagacagttacaagggtcttagaaatggcacagataaaattctatggaggttcagagaaaagaaatttcttctagttggaggattcaagtaggacttcatacagtataattctgatggatctataatcttcacagactggaaacctatactcacatgatttgttatttgcccactttttgttttaaatggattttagacttgcaaaaactcatcagtgagttgatcatttgtttgaacaatggtgttttagaccaaaaaagtaagttttcatgaattctcctcctgcgtcagaaaggtagtgtgtaaagccatggattaaaaakaaaagttaaataaaatgcttatatactttatagtttgcacaacatctagaaattactaatcactaattttcctgtttcacattaaaaacataaaattctgtgatgagctgaggttaaactgtcaattgccgctggcttgctgttgccttgtgagatccctggtagagagttttggtttacccttgtcaaatagggaagcagttcttacgtatctctccaggattgcttgatgaatagtggaaagtttgcaaagaactgagtatttaccatcatctttagttagtgtgtgatggtttcattaggtatagttcatctgagggaaaataataacacccaaacatgatatgaaacacatgaagttcaaagtaatcatagctatttaagctctattgtaatgttctggtgattctttcatagaaagatagataaactttattattgaatctgcaattggaagtacattaaaaacacaggaaaaggaaacaggatgttcttttgacacaggtactcatctgctagtcagcagttgtgcgttctgtacttcgtttgttgtcagagccactagctgccacaaagaaatatttctatgtactagagtgtgggagaagactctatatcatttagccttaaatattaatttggtcatagttgttactataaacctactattggatccaaaatcatttcctctgagtctagactatraaagggatcacaaattacattcacaagccgatttaccccatgttttccttctagcaaccaggcctcctggtatgtgccactcagatgaatttcagtgccaagaagatggtatctgcatcccgaacttctgggaatgtgatgggcatccagactgcctctatggatctgatgagcacaatgcctgtgtccccaagacttgcccttcatcatatttccactgtgmcaacggaaactgcatccacagggcatggctctgtgatcgggacaatgactgcggggatatgagtgatgagaaggactgccctactcagccctttcgctgtcctagttggcaatggcagtgtcttggccataacatctgtgtgaatctgagtgtagtgtgtgatggcatctttgactgccccaatgggacagatgagtccccactttgcagtaagtttcctgaccacagtttactggccataaactcattctgaacagtagcctggtgtgcatcaccattgtcacagtcactgtgtagctttgtaggaaggatttcagttcctctatgagttcacatctgtgtagggggtaaccataattgaattcaaatacatcaccattggataattttctgattaaatcctttgtacttggttatgtgtttttacttctttttatgtctttgtttcaaaaaatgagactaaattgaggccattagattgtcaaattaaatttggttctgttggtaatgtgctcattaatttttctaactttaatattttctaatttcaatcagaacttatcacaaaaaaatgaagtccagggatttgtgttgctgtgattaaagtgctgtgattggcatgtaatcctaattactgtcatttctttctttcctctttaatcaatgctcactctcagatgaaccccagccaggtatgattgtgaagtatttcagattcttatgatttcatatgtgttgtgtttgttctgaaaatgtcctgattatattaacttacttccctttctaacgcatgttctgtgttatgactcttacaaatatgttagagtacacatggaaatagaaggcatttgcatcyccaggcatgtgaactgtcttagggtggctttaggcattttcattttggccctgaaagtaaggcatgacgatatgttaccggatctgtgtactctaatatttcaatgacctttcccctttgatttgttcacttcatagattttctggtcttttctcttaaatgtttgtctatcttccatttctgtatagatagtagaatttcagaggaagaaaacgagaaacaattttaagtgtctttgcatgctctatcaatgacacttttcttccttgatgtcaacaatattttcccaagggttctcattgcattaaatggagttatactattgggttgtagtgaagaaggtgatcatactccaatggatatgaaggatggtaaatcctcagacaaattagagcaaaccctgaacagcctgtggaactcacccaagtgcatgctgcacttagctcttgtctgggcatcatattgaaggtggcatgagactgcataataaatattgcataagagtgaatcaaagaagcaaagattcttgattttcttttttcattattctctttcttttytctagatgggaacagctgctcagatttcaatggtggttgtactcacgagtgtgttcaagagccctttggggctaaatgcctatgtccattgggattcttacttgccaatgattctaagacctgtgaagacatagatgaatgtgatattctaggctcttgtagccagcactgttacaatatgagaggttctttccgstgctcgtgtgatacaggctacatgttagaaagtgatgggaggacttgcaaagttacaggtaattgctgaactaaccygagccagtttatcagcacatcccagagcttaaaatcaaatggcacatgtaggtatttgacaatgttgattaggagttagatcgacttgaatcctggaaagattatgcaatctctttaaacctcaattttttgtgaggattaaatggggtaatacacattaaaatcctggtgtattttggaaaatagaggttaaaacatatacaagtcaatgatttttaaagtatttaaaataataccaaatggcttttatataatttaaaatgagttctatactatatttaagcatctttatataatgcttaattgaattcaaccagtattaattcaatttctgctataagaaagtgctttttactatgtattaggatattgatttgaccactttcaaagtgaccaaatagaggaagctaaaacaaaaacagaaagtttctttcttttacatgtagtaggagtctggatgtcagagagtccagggcatggggtctgctctgttatcctcatcatgtggcttacatcaagggttccaatgctccaggttttagcttctcttagaaagtaggaaggggaaagagaaagtggagggcaagcagcttcctttttagaatgtgacctgagatttgattcgtaatttctactcacatcctattggtcagaacttagtcatgtggtcactccaaacttcagtggagggagagaaatgtctctggctggagagtctgtgccaagctaaaacttggcatgctttattactaaaaagaaaaagaagagagggggtgttgggagaattagaactctctaccatagctgagggcctcagaaaacagaaatatttaagacatgattcctgctgtccagaagcctacaacctattaaatagtaaggaagataaccaaagtacaaaaatraatacagtaaaaggaagaatgtaagcatagtttactctagactagtatttagaaacacagttaaatataacccaagaaagagtctattttaagtactcatgaaaaccagctaactattaaggttaagaatgaagtgattaaaatcattcatatggggcttcctcccctccccaccaacttactatagtttggaattacaccttctttctgttaccaaaagtattgaatcaaaagttttaaagagttgttttgtgttttctcccagtatcattgacatttttgcatttttttcttgaacagcatctgagagtctgctgttacttgtggcaagtcagaacaaaattattgcsgacagtgtcacctcccaggtccacaatatctattcattggtcgagaatggttcttacattgtagctgttgattttgattcaattagtggtcgtatcttttggtctgatgcaactcagggtaaaacctggagtgcgtttcaaaatggaacggacagaagagtggtaagtacatttctgttgacctttggcctggctagttcctctgtcttgggtctgtttgctgttattcaccagtgagagaaggccctacctcatctgggtagctctcatggtaccttctgggccacatcatacccaagagacttgcgtgttcataactacgaatttatggctgttttagataggagggtggcctctgaatgcagatgtgtgattctgaattccaggtcaggtgatgcagagacctcacaatgtctttacggttccttttgcagtcttttcttgtggatgagagcagaggaaagtgcaggaaagttaaggggttgcttttcttagctttaatttagtgatatttctcaatccatctcccagaatttcagtttcttggctcctgatagttacatttcctctgcctcttacaactttattttgtarttcttggtccttaattaatagagatattattcgttgcatgcaaacactataacattttgtaatgttgccaactaagcaaatggatagagctttttcttaattgcaaaaacttttgaaaccaaaacgaaactatgcactaaccaaacaatgaagtcatcttagaatgttcagtgtgacaaaatcttgtatacttttctcagaaaaccctgctgttgatttggtggttagctacatgaggagacaaaattttctaatccccacaagtaattataggacaagttagatggtttaatctagatttttatataatatccatgtttgcattcatttatttgctctagaattcactctttattcacttttgtctttaggtatttgacagtagcatcatcttgactgaaactattgcaatagattgggtaggtcgtaatctttactggacagactatgctctggaaacaattgaagtctccaaaattgatgggagccacaggactgtgctgattagtaaaaacctaacaaatccaagaggactagcattagatcccagaatgaagtaagacttttttttaaaattatgttgccttgacatggttatgatgagggaaaaacaacagtaacatgatgtagctgatatgcatgttgctgataygcaaaatttaaaatgatcccttgtttaaacatggtaggtgtccaactgggtgttgctatctctccttcatctgaatcatcctcttcataaagtacataagagcaattgattgtttactttattttaagagcacattgatttattagcttggcaatacaatttttgaaatgtcatataattaaaaattaagtttctaattactgcatgcagtaatagtccayagaggggccagtttgatgtaactttgataactcatgattatacaacaaaaaagctggatttttctgcttcagttttatgttgtttattagagctcccttttaagtcatataaggaaggcagtttttgcctgctgatcctgaagggaagatagagaaattctcccatgtgtttggaaatctttgaggatttctttccctgaatttacttatattttataacttagattcttttctgcaggatggtaaattaggcaagttatgttcaatgtgatgttgaattcctagatattgtaaagtattacacaccactgaaatttatgatgaattcctgatgaagaataaattgatttccttatctaaaaacatgacagggtagacaaacaaggacagatggatttttctagatcaactatttgtggattataaacaaacatgaattggcattgagacatttcaatgtcataatgtactacattatgacattatgtattacatgttttatgaacattataaaaatacccagatgggttgtgattgtgttatgacagttttactttgtgacacttagaggaaacaataaactctgtgaatatattctgaaccagagatgatttattttaagcagggcataaacaggatgwtgtattatttaaaatgacagttatttttaatatttaaatacgtcccctccaaytggtaactcatttcctttcccagtgagcatctactgttctggtctgactggggccaccaccctcgcatcgagcgagccagcatggacggcagcatgcgcactgtcattgtccaggacaagatcttctggccctgcggcttaactattgactaccccaacagactgctctacttcatggactcctatcttgattacatggacttttgygattataatggacaccatcggagacaggtgatagccagtgatttggtaagttggtggtgaggaaaaccaaattaaaactacagtcgtggataggtagaaatcagacgagtatcagaaaagctaagaaattaatttttgtgtcatagacattgtcagatcaatccaggaaataccagcaacagtgagaggcagtctatcccatatgactaactggaaaatgaatattttcattccagttcatggtcagcttgtgccatatccaggaaggatttttatagctcgtgtgatttagttgagctgcagatgtgaatctgttgcttctatacctttaaaaattgtgtcaggtggccgggcgcggtggctcacgcctgtgatcccagcactttgggaggccgaggtgggtggatcatctgaggtcaggagtttgagaccagcctggccaacatggtgaaacctcatctctactaaaaacacaaaaattagccagtgtggtagcacacacctatagtctcagctattcgggaagctgagacaggaaaattgcttgaacccgggaagcagaggttgcagtgagctgagattgcctcactgcactccagcctaggtgacagagtgagactccatctcaaaaaaaaaaaaawtttttttcaagcaaaaatttataacttaacttggccaggcacattgtctcacatctgtaatcctagcactttgggaggctgaggttggtggatcgcttgagcccaggagttcaagaccagcctgggtaacatggcaaaaccccatttctacaaaaaaatacaaaaattagctgggcatgggggtgtttgcctatagtcccaactacttgggaggctgaggtgggaggattgcctgaacccagggaggtcaaggctgtagtgagctgtgattgtgccactgcactccagcctgggtgacaaagtgagaccctgttttcaaaaaaaaaaaaaacaaaaattaactagatttatatttctcagtcttgttcttcacataacattttttattctataaattctgttgaatttattttcacaagttaaatgggaaaataaagaaaatagatattttatcaaagagctgttattgacccccattaaaaataggaatgcttttacactgttggtgggagtgtaaattagttcaaccattgtggaagatagtgtggcaattcctcagggatctagaaccagaaataccatttgacccagcaatcccattactgggtatatacccaaaggaatataaatcattctactataaagacacatgcactcatatgttattgcagcactatttacaatagcaaagacttggaactaacamaaatgcccattaatgatagacatatacatcatggactactatgcagccataaaaaagaatgagttcatgtcctttgcagggatatggatgaagctggaaaccatcattttcagcaaactaacacaagaacagaaaaccaaacactkcatgttgtcactcataagtgagagttgaacaatgagaacacatggacacagggaggggaacatcacacaccggggcctgtcagtgggtgggggcaaggggagggagagcattaggacaaatatctaatgcatgtgagggttaaaacctagatgatgggttgatgggtgcagcaaaccaccatggcacatgtatacctatgtaacaaacctgcacgttctgcacatgtatcccagaacttaaagtaaaataaaaaataaaaaattaaaaacaatttaaaaaagagaaaaaattgctattgtatagttgctgtgacttgaaggaaagatgcatctaaactataacagattgatgtgaatcagtgagtggcagcacaagaccgtggaaatagccggcacaagtgtgctgatggtggagtgaaggctggggcgtgggagtgggagatgaggagtctctaagctctctagttccatctaacttttaactagtaggtgatccggatacatcaccttgctttttgtgcttcagttttgttttcatttgtaaaatagatgcccagtgtaattaccaagrcaaacataaagagtaaatggcacgtgtatgtgaaaggctcttgaatggtttagtgggatataggacgaattgtgtattttttgccgctcttttgcacaatgacttccttgtgtttttattaaataatgacatgttaaaggaaaccgtcttcttgagcagatatcctctttgactcagtgcaccttggctttsatttttggatgaggtctcactgttctcttctgcctcacagattatacggcacccctatgccctaactctctttgaagactctgtgtactggactgaccgtgctactcgtcgggttatgcgagccaacaagtggcatggagggaaccagtcagttgtaatgtataatattcaatggccccttgggattgttgcggttcatccttcgaaacaaccaaattgtgagtgatacagagaaacatcctgcctgggagtagcttgaaaaacactgaccctgggaatgctaaatgyacactgttacagacccatttgtttggrcaatacattttccttttctctttacaaaccaccccactatatactttccctagtcctgacattgccattacttttatttaccatggaaatttcaaacctaggatataataacagcacatctgaattatatcatttcagcatttggctgctacctctktgaccctcacatgagtctccgtttcctcagctgacaaatggagtacagaccagatagtgccttcgatcctcttaccgctaccactctgattgaaagcagcttacttttaggactagtttattatggcaccactgccttctaggtgctctgctgtagccagcacgagttgtcctaaagtgcatggtaygggtgtctaggtgaaagacttggcatccgtactgttctttctggtgggagagggagataagtcacttartcttcacttaatcctctctcctcaaaactctccaattgtttctcacacccttcagcatgtggctgctgctatttccctgctctcttctcccactcgctgttgccacattggatttcattatggtccaaaagcacagcaggcgactcctgcctctcagcttctgcgctagctcttccctctrcctggaacatctctcttccagatctctgcatgagttgcttcgcgtgcyatttaggattctacccaaatgtcactttctcagagaggccctcattgaccgctctacctaaaatagccaccccctcataattcttttgcyctttaccctcatgttctgaaacctctctctctctctctgagtttagttgtttctttttgctcgaatatatactccacttttatagcgtccccartgcttagaatggtgtttggtttacagtgaatacctaccatttttctggtgaatgaatggattaataatctattaataacatggtatgtgtaataaaaatgtataggatctaggaaacatcctgtgtgtggggaccacacagaatcctgattttcaaggtgcagagacacacagagatatcatcagtagaaaaataaaagattattatctaaccaaaatctggaaaactctaggtaaactacaaggtcacacatcaaacacacaactttttttttttttaatgcaaaaagatctcttttaggtcaggtaaggagacagattatttggcatcatatttctattacaagttccagattactcagtggctgtttgttcrtaatccagttatagactggattgatctgtaaccttgagtcattctcctctctcgtgtctcttatgaattctaagttgaaagcctgatgctagggaagttgaaagtgtgagtagttcrgtgaaaacaaaacaaaagaaaacaacagrggtaacaacgtacttaagcmcccctgtactggggcctctggaaggacactaagagcatgactctgttttgattttaatgtggaggttttccacttactggtgctttcttctctttctcatgcagcygtgaatccatgtgccttttcccgctgcagccatctctgcctgctttcctcacaggggcctcatttttactcctgtgtttgtccttcaggatggagtctgtctcctgatctcctgaattgcttgagaggtatagtatgctccttatgtgagctctgaagatggagctggtcatagtttgtgccaagcagtggaaactctaaaaccaattgcgactgaacatgtgctgtgtcctttgattcctcaggtgtctgcagaatgatgtgtgttgtatggggtgatgtcactgtgtgccttggttgtaatayagtttctgtatatggaactaatgttatctgtgcatgtaattgaacaatctgtaacctcatattttctctcacctgggtacagttagacttctctgacaagccatgataatgggaagttccaaattcttcacctaagaagtaaacattctcaacgtttgtgtacagcttcattttttatgtccattgtctctttctccctcttttttttttcttttttctttctttcttttttttttctttctgagacagggtcttgctctgatgcccagactgtagtgcaatggcgtaatcatagctcactgtagcctccactttccgggcccctgtgattctcccacctcagcctcctgagtagatgagactataggtgcacgccaccacacccggctaatttttgtattttttgtagagaccgggttttgccatgttgcccaggctggtctccaagttctgccctcaggccatccacttgccttagcctcccaaagtgctgggattacagacgtggaccactgcacctggctccattgtctcatttttattcttataaccaatagttaatgagtgttctagcctgggtcttctgactccaatttcagtactgttactattaccatctgatactttaagaaggagaattgtgttggtatgagatattacaagtgactgagcaatttaatatttatctcatcctagagatattttattgggtcgattgaagagtgtgtggaggattataccaagtacttaagggagtaagaaaagaaggaaaagttgcatccagttcacaaaagagatttcttctggagtgtgtacttgtatataatacacttaaaaatataattccttattgcttaaaaatctaagaagttactctaaacccaagttccctttcgtttctcagtgaagagaactgaatgaatatattttgatactgatgaaaattgctgtagacaagttcaacttaaatgtttaatgatcacatattcctaaattaagagataatagagtcctaatctagaaggaaatttagtcctaatctagaatggaaaatatatactgaattcaggaaacttttagtgtttagatattatgcagatgtaggcttactgaaaatcaaattccatcagcatgtaatattgtgcaatgatactttcatgatgaaagattttaattattggtaattctcacagagggactggcacttgccatttttcctcagagacttattatgtacctaatcctcgttgacattgtttaatttagtgtgttcctagagtctttcaggagaagattaaactgggctgtagacatttcggatacaaagcattctttcagcacacaaagactgttgaattgcacattgggggttggtgtaatcaatattactctctgatgatgattgataagtgttaattttaaatagtgccttttgttgtttcacaaataattccactagtggttttctcatgggttgactttaccgaagtggaactttttaagtatttcccagtaggtttcagagcaccagctgagtaactgattgccaatatatgttaaatgaaaaaaggtttccacatttttttttccccaacaagaagtttagaaaacttgttaacatttataggtggaaacattttacttgatttgattgttgaatagcttttcaactagtgtttactaagaggctggaatatatgtagaagtgcttctgtgatgctgttaagtaaaagaagcagatattgcacaatattggccttgtaaaaacatgcattaaaaaacacacaagtttctggaagcaaaaacacacaagtgccaatagtggttacagttggataggggaattatgagatggttctacttatttctaattttatgttataatgagtgctttctctgtatgagactttttaaattctttagaaaatatattccccacaatgccaaaaccaaatgaacaaacaaaactcaagccaaacatcacctcagcacccctaaaattactccaaatacaaatagacttctgactcggtctcaggggcacaaggcacttgcttcagtgattttgtgcaagataagagaacactccttgtccttgctccagggaaggctgcagtgctgatcagcttgtgcagggtatgacttaaggaggacctaggtttgggggtcatatatattgtcgttcaattacaacactgagttctcattcctgactatagtgtcttcatgactctgctgacactaacattaatgggattatgacatggaaaatagaaatgaagagatgatctttaacttcaaaagacagagacacactgacctacttaaccgtcaccacctcctgaattcctttccatccaaccctagatgattctgtgcctaccccttcatgccattgtcataattgtaagggctcatatacttggtcttgccctctagatgctgcgttccttgaggataaagcctctacctggtctgtagatgtatgcttattgcctgtggcacttcrtggtacatggtggcactcagtaaatgttgagtgaatgacaagctctccaatatccatttttgttacttccccagtcctctgatttttacccgtttgctccgtagaaatgtgtgcagtgttgtgaagtcacttctttttgctttcccatatagcacttttcaggcatctccctgcgccacctgttgtcttactggccagttcctttctattactcccctggcatcatcccccaccatgatgctcacagtttcagccagcgcagcattgcaggagatcctgttctctggtccattgcttgcaaatgttcattggtggtaaacgttctcagtacatcagcagttatcagataaagggcttgagacatgatccccaggaagcagtagaagcgggtggtgcttaagggaagagcaccatggaagagtcaagaaggcccatgcataatggatgagatatgcaaagtttttaggccctaaacaatgctttggttgagaattattccaattaagcaaagggagatgacccattcaaaagggcaggatcagatcttacgtaagtgagtaaaaatttaaagtyccccataaaactgggacagagatagtttctactgagccagtgaacattaataacagataatcaataaataattaaatatcatctcaatataatttcttggtacagctgaaactcataatctagcatttttttttttttttttactgttgcagttaaaccaaatgaaatgagtggtaatttgatactcaagaaatagtacctggcctgcggtatttgcagtgtagtgatgaaaaacgtagattttggagtccaggagtcctggttgtgtgacctcgtttaaattgcttgatttctttgtgtcttatttgcaaattgagggaggacctatctaacaaacaagattaggaaacttgagggagataaattaagggaaatacttacctgatgcatgcagtatggcgcatattctcaatcaatgagaagygatttttattgcaattgcagttgttcagaagagaggcaatgtggagcagctgagagaagaagggcctggaagtgaatgagccagggtccatctcctattactgtttcctgcagaagtcacagagctcctgcaaatctcatttgctccagctgaaaacaactttgcaggcttgttgtggaagactctacattgtagtacttgaaaaatgtaaagcattaatagttgcgaaatttacattagactaaatttaaatttgtcctaggttaataaagactgggttatttctcagtaatagaaatgataggaacaagaaaaagctaatgagatgtgaaaataagtaaagaaaaaatgaccaagtcatcctgctgaagatggaaagcttcccggattataaaaataatgaaaacatcatttttagcttatgaaagttgtgtaatgattaatcatttcatactttgtcttaatatgtgatatatcttatacatatatcttaacccaaaacttagattcaaaagttttccttttctcagagaggaattttaaaaccccactcttgatggggatcaggataaagattaaattatttttgaaaaaggaacttttattatctattaaggagataagtgaactgatagtttaagatattatgggaatgtttaaattacaatgtgtagacagttttgagaactttggaagatactgtttacttattcacttatacattcatccattaatgcagtcatatggtcatccatttagttakcaaacatttattgggcaactattttatgccaggctctgagtaccaggccctgggacacaataatgagcaaatcagacacagtcattgacctttgggagttaaaatcttatagggaagagagacactagtcaagtaacaactgataggattatacattggatttatttattaaagtctcaataaatactaggcaacactttgtagtgttgttttatttttggaacattcttaaaactagtaagctgcctttcacaagaatagtctcaatgatttttttcactttttttttttcaaaactcaactctcctttccctgagatcagtgtgagtgaggtttgtctgtgtgtagaagtggaagaacttcctgtctgtgaggtttagcaaacatgggtggtttattagtgtaagtaaggacttaatgaagagtaagataaataccaacctgccttgaaaaagtccagacagcgttgtatgtggggttggaggtcttgtggtccagcagcccactgaaaccctgggaaaggcccatgcttgtctgatgaagtacattatatttattgctgcaatgctgcaatgtcattttagcccatatgatggtaacaggctattgccttccattactctaaatgtctgggaatagtrggatatgattttgactgatattcttctattttcacagatgatcaacctttcttaataactgtaaggcaacatataatttttggaatctcccttaatcctgaggtgaagagcaatgatgctatggtccccatagcagggatacagaatggtttagatgttgaatttgatgatgctgagcaatacatctattgggttgaaaatccagtaagttttgaataacattcaaagtatataatttattcttgaagagmctgcctgcactgatgttttcttataagcaaacttttgtcatgtgagtaaaagggaaacaatgtggaaataaatttatccctaagttttttgattcaatgaggggtatawatktgagcttggcctggagcaaaaatcataacactctttagcttcagaataagaaacaaatttaagctattgtgtattatttactcattcagcaagtattttccagaagtgcctatgatttgccctgcactgaattacctgcttctaaccacagaatacatgccaagaagcagcagtcacaatgcttgcccctagaggagtcttaagctagtagaaaatattcgacgaatataaaaatgatcaaaactcaagayaaaagtagtagctccctaagggaatttagtgaaagcatttgatgtggtgctggggccttcctttagaatcctttagaatatttgcctctagggtaagaatgaacacttctccagttctcttcctcagaggtcattttcttcagccttcagggaaaaaacctgtaagaatagggaaagagcaagaagactataaaggaggaagagaagaaaaatctttgtgtttcatgtttgtcacctatatacaaaatatactcctggtcttctgatccacatctgtgacttgggtttttctcatgacttgtatgcttgtggtagttaagaactatctctgtagccagtactggagatagcctgaatggtaagccttgtgtattcctgtgacacactgaaaaatcgtttgaagcctacccagtggtgctgaacctttgtttgcctttcctctgagtgtaaggactgttcaagaaatacagcagctggcagtagccacagtgaagaaagggttcttttgyaggagccatggccttggaactgctcacctccccttgtctttctttccagggtgaaattcacagagtgaagacagatggcaccaacaggacagtatttgcttctatatctatggtggggccttctatgaacctggccttagattggatttcaagaaacctttattctaccaatcctagaactcagtcaatcgaggtaatgattccataatactacttacacaaacattggatttagattgatgtaaactctagtctcaggaatagatctcacgtggattttggaatcatttttaagcaaaaagaaaaagggaaaagatattagtgttaactatcaaagtctctgaagtgaaagaggaaaaccaccttaaaattttttttaaatttatttttatttatttatttatttwttttttagacaaagtctcactctgtcgcccaggctggagtgcagtggcaagaccttggctcactgcaacctctggctcctgggttcaagcaattctcctgtctcagccacccgagtagctgggattacaggcgtgcaccaccaagcctagttaattttttgtatttttagtagagacggggtttcaccatgttggccaggctggtcttgaacacctgacctcaagtgatccacccgccttgacctcccaaagtgttgggattataggcatgagccaccacgcctggctggcaaaaataaattatttgagctttctattgctctattttgtttcctcctaattatcaatactaccttgttgctataaaagtrttttaggtaatttacaaaataatatataagaagataaataaaagttgcataaggaattcaacataaagggaagattatggtaagcagagaattttactatgtttcctcatctaatcttcaatgctatttcagttctcaaccaaatttatagtttgcctctgttcttagatggaaatctttctatggctccagtacagtttttctaacagcaaaacagaaagtagaaacttgattctaattcctttgatactctcttcttcaagataagtgttctttttactctaattcccagaagaaattctagatgaggcacaggtatgaaatcacatgaagtaagtcagaggtaacttgactagtgttggtttgctccactctgagagaagggtaaaacatggaagggattattaattcacaataattttgaaagtgaaacttcccaaaacaaggagaagtttttggagggggatagttagcagagccctgacaatccactgctttaggtgggcaccagctggcaagacggtttttctctggagcattcagaaagatactgaagatgagcaaggcgcacagcagcctgctggctaatttagagcacctatctatactaaaaagcactctctgtagactaagaacacagcctatgtagagttcggtactatctgaggtttcatgcatcccttggtgatcttggaatgtatcccccatggwtgagtgcagatgactgtttttatttctgccaaatgaagaaatagggaaaaggtgtcccaggcagagaaaagagctctcactggaacagcgcttgagtttacaaagatctttcactagcatctaatttaatcctcacaacattcctgagggcaggcagktctggtagccatttgtgatgagagggaaatttgcagtgtgcacaagtatctcaagccaggtagaattatcaggtgttaacatgaagggccccttggaggctcctctggttcaaactcttttttttatttttatttttttacatcagaaaccaaggcccacaraagctaagaagatgtcttaaatggtcagcttcactgctctaattcctgagcagtattctctctttgcacttttataaactacaactccggcaatccagactggtttaaccctctttgacagtggcagaaaatatttttcatgatttcaactaagactatcatcctcccattaaacaggcaacatctactgcctaagacccttactaccaaactcacatctctctaaagtccacccagtgcaaagctgtcttaattccaaatggcaattaatatgctcttattttatctcttkgtctcttgattagtaaatggggttctcttcttttaaactgatagttttccaaaagcagggaacgtgtctttcccattagtgttaggtacaatgcagtagtggccagttggagaataactgagcgtgcatgtgtgtatggattggtaaggccactttaaccacatgaaccaaaagtttctaattatgccctgatgcagtgtggtacagaggaaagatattttgatttggagtccaaagacctggctttgagtctgggttgcttgctcattttattcattcatttaatgagcactaggaaatgctttctatggatcagttgatcctggatatcctaagatgaataaacattttttttctgtctttaagtagctcacatatctgtgagatggatacataaacaaatacctgtgctccagtgtcataagtgtgataaggccggtgaatataaagtgctagtgattggaggcagaggtataagtgaggggagagagcatgcagatttcccattcatggttacttgtgagctgagtcttgaaagatgactaatacatccttgcttatcggagggtttcactttccgaggtttcagttacctgcagtggcctgagaatatgtgagtacagcacaataagatatttaaaagggaggagagagagagagaccacattcacataattgttattacagtatatttttataattgttctattttcagattatggttaatctcttaccatgtctaatttataaattaaactttgtcataggtgtgtatatgtaggaaaaaatatagtatatatagcattcagtactatctgaggtttcaggcatccattggtgatcttggaatttgtcccccatggatgagggggatgactgtttttatttctgccaaatgaagacgtagggaaaaggtgtcccaggagagaaaaacagttgaataaagaccctgaaacatggaaatgcattttatgactggggacaacactgcattttctccactcatgagctattcgaccttggacaaattacttaacttctctgagcctgttttctcatctgtacagtggagtttatggctgaggaagtaaaagtacttcataacactraggtatcctgtaaatacagagygctgtttccctcaaatgatcaatatttttagaaaatccatgaaagacctgtgagaataatgatccaagggcaaactgcccttttaatggtttaactggtgtttccccttaggtcatttaaattgtaagtaagtcttccaggtgattgttggattaattaagaaaataggaatcrtattcactttctgtttacctgtataatattccttcctgcctaagagtagttcgtgtttaactccaacttgaaaataagagaaacattgaagaaactattatccactaggggtagctgtgttcccatccactaaaagaaattttatagctgaattttgtagtgaagcctacagaatggccgtgtgagagagagctctatatattccagaaagcaagaaaaggaactgtgaaccaaagagatccttagtcttaggaaaaggagagagattgtagcagaaagaggcaaaccgagaaaagaaaagctaccttagtccaagcaagagtgaaagataccagacaataggcagagaaaaaaatttagagaaaagaatgagggaaagaaggatatatgtgtgtgtgtgtgtatgtgtgcgtgtgaatgcgtgcacacacgtgcacacgcatgtatgagagacagagaaacacaaataatctatttgtattgaaaagcaattttatagaaaaaccttaatgcaaaaatcaacagacattttctaatttcttactaattgtctgttagactgtcttaggtacgtattaaaatagcttcattgctgtaagaaacttctttctagtccaataaactatatttctatgtgctgtatcagggccctgttaacactgtgattataacagtaataatcacagacagccttgggaaagccactaaacctctgtaggcctctttttctccatctgtattgagaaaaataatgggatctacctcacagaattgtttatgaggatcgaatacaataatgcttgctctaatacctcatatatagtaagtgaccaacagatggaccaattaaacaatagaagtttattgaacatagttgtgctgggtggtgtgctgctttacctgtattatctcttagtcccgtaaggtctacgcagaccttccatatttgactgataaagttcaaagaggtgaatttatttgcctcagattgtacagtcaggacctggcagggcagagatttcagctcatgtgtttcagtttagkttgttgacttggaacagaattcactgtacctctgagtaaatttggactattttgatcaactgtgttggcagtaactggccaccgagtgccttggtggggtgcaggaaagctgtggggttctcatttgtcttccagagatttctcttagctctcctgaaggatttttgcagtttctttaggcagtggctctgtatgttttcccaactgaatcttccttttatccataaaaatgttccctcctgaaattttaggtgagttggaagtaggaacttgggaggtgattttgctgctcttactctcattttctattgagctaatttcctcatttccctgaagtgcaatatagattatctgaatctcatgcaaatcctctctcatccatccctaatcgtgctttrgaatttgttttgtacataagttctccttcatctcagtttcctttggttccccttatgaaagtcagttctaataagtgattttatgctataggttttgacactccacggagatatcagatacagaaaaacattgattgccaatgatgggacagctcttggagttggctttccaattggcataactgttgatcctgctcgtgggtgagtattcataaatggcacgtgtcttccatgcagcattgttcttgttaatgtcagggtctgacaaaatggaagatttcaaatttaggacatcttctgatttcatatgtcaacatttgaaaaataatagatctcagtgagaaagagaaatagctctgacctatatttaatgtgcaggatattgtttgtattttgtcctatggtcttcaaatgaacaacactggatttaaaattaattccaaacaagcaagaattttaggaattttaaaatagcattataagaattgacaatatattctgactttgaaaggacacggaaagctctaagggattatgtaacatttgcaatagagcttgcaggatgagaagccttctagtaggtggagaatgggttgcaaccaggcagtgactcttgaggccaagggatccatgaaggcacagaagtatggcggcacttagcaggattgtggggagagccggaaccagaggcttagagtagggagctgttgaccacatgggagatacaacagataaggtcatttggggacaaatcaaggagggcctttaatatcatgctaagaagttgaactttattcttttgagtgataaggagcaagtagggattttttttaaaaaatttcaacttttattttagttatagggggcacatgtgcaggtttgttacatgggtatattgtacccagatagtgagcatagtacccratagttagtttttcaacccatgccctcctcccttcctcccctctctagtagtccacagtgtctgttgttcccatgtgtatgtccatgtgtgctcaatgtttagctcccacttataagtcagaacatgtggtatttggttttctcttcctagcaaggaatyctgaggaagggagtgaaagaaccaaattygtgttttagaaaaattggtcaggattgrtgtggagagaggccagggccagggagaccagttaggagaaaatggtcttaatggatgtaggctggagtcctccggtctgtttgattggctatttcattctgttgatctactataccatattataaaccagaataacaaattgtaaaatatgaacactgattttttttttaaagagattgtagcatcattccaagtggattttggcttaatgtttgaaagttatcagattcttaggcctagaagggcactgaagaagtaatttgtattagcgctctgtttcaaataaggatgacatggaaaccaaatccaatttttaaagggcacaagaagcaaacattctattctgtgcctgctggcttgtactagttttcagttattctttctagaagaaggactgtcttaggttcgaaattctacttttgaaactcaggctcactcattatttgtttttcgtttatcagacatttctgcattgtgtacctttgttgggtggtgtgttagttaagatagctaactgttgaagcaaataaactcctaaatatgtaatggctcaaagaaaatagaaatttttttgtcttttatatgggcagtggggtttgggcagaagatgggaggaagctctactctacgtagtcattcaggacccaggctgatggatgctctgccatcttcagtaggaggcttcctaggtcattctgagtatcaagatctttcgagcagtaaaggaaagaacgttcagaaatttgctgggaggtttttatgagccaggcctacaagtagtgcacgccacttctgctcacactccttaagctagaattgggtcacatggccacagctaactgcacggaaggacatgcagtccacctatttacccagagagaagaggaagacattaattttggcaagtggaggcagtctctttcatggggccatggtggggagttcagagggtggatacaaagattaaagacctaatttgcaaccttaaggatttatggcttagtaaggaggataaggcctgtgtataaataacaataacccagattcatataagattaagagccacaagagaggctaaaaaaattgggatgatagtgctataaagaggtgacatttcagcttggtggaagagatatcatttggactggatcttaaagcatacctagaatttcactgggcagagctagcttttaagatatatcaggcgatatgaaggatggaaggtcaagagcaaagggacagaaaattgagggtttgttcaagtgactaagagcaacccagttgggttgggagacaattagaagagcttagaattttgtcagaggacataggaggagaaacaagacagagacttgaggatctaatatcttggattctcagtgaagagaaagtcttgataaagttgtgataaatgttattgaaccagttgttgcagaaaaatatctttgtggatgatcactaataaagagctgaggcagttacagggtctctgatgatattcaagagaggatgttgaatagagatagtagaagttaaaagaatggaaggaggatgaggaaatgtgaatactcttttaagaattttgtattggaaagttagagaaagataaacttgtaggtcaaaatgtaacaggaaaatgtctttcagaatagagaaacctgagtgtattctttagcagcagatgaaagatcaaggatgaagaaataattgattgagagtgaaagttatggggaaggaattcgaaatttatgaagtagaatgacttgaaatagtcaatatgcggaacatgatataaagtctgctagggatgagaatcctcagcttagattagggaacttagatttttagtgaattcagaattcacgaaagttttgtgctatgtccaggaaactcttggtaccctgaaatgggagaggagaaagaaaaaaaagggcagaaacccagggttggagattagcttagacacaatgggaacccaaaagaataaataagaatattgttgaaatggttacatatgatgtccaggtgtagaagractggagggttgggagctcaggcagggcttaagggcaaagaacaagtttaataggaaaagttaaagcaaggaagaaatgagagkttttggtcgaagcagagcatttcagagtttgagaacttagaggcggagaagtttagagttgaagatgaaattcaaaggacgggtatattgatttggtggtggaagaggtaggtgaataaagactatttaaatgaaggggtttaaggacttttcagaaaagaatgtaggagaattgtctgttgaagatatagaaggaggtgcaatcaaaaggaattaaaagttgggttcaagtctagaacttacatcttcagtggaaatggaaaacagcccttaatatattttaatacattttcatatatcatggatttggcaatgctgtgtggtaattatggttcatgtgtacctgatcgctgtgaaatagaaagaaaaaagaagtcttccttaccccataacagcatgataatgagattccactctcacagaaaagtgttactcattatttctcctattttctgtgtcagttttcaaaattctttgcatttttcatcacagaaatcaggttaggtaattaagtagccggtcttgtggtagatggtgatttggrgaataattaaatgaggcctggtaagtgatcagggagtgtacttggcagctttttatattagctttggccttcactatgtactgaagatggagggattattgatgtaggtttcttccttgtcataagcttcccacacacctgaccatgctaaaagttcagctgccagtgggataccctagcttcttattccagacaccattttaagtggcctctactccagttatagctaggaaatataccgacattggtagaacactggtgaagtacccctccacgttgtatgcaacgagatattgattttcagcctttgcccattgtattgtgagcatcttgaggacaagtaatacacattgtcatttatgtcactgactcaaatccaccttctgttttgttacatgctggtgtttttcatggttgtaggaagctgtactggtcagaccaaggaactgacagtggggttcctgccaagatcgscagtgctaacatggatggcacatctgtgaaaactctctttactgggaacctcgaacacctggagtgtgtcactcttgacatcgaagagcagaaactctactgggcagtcactggaagaggagtggtatgagcaccctttcagtcttttggtctttatgctgagctggtgtagctgatgctgagtgttctgagctgtcaggcagtggttcttgaacaatcttacttggtaacttgtaccagtgtttcattgccccttctcccaataacttctctcccttgcacgtacctcgcccctagctgaagtccagttctttatagtatgtgcatagttccctatagggtaatgtttattaatttccccaccaacgtttktttttcttcaagataaattaattccatttgtcatttcttacttgtcatttcagagccatttctttcatggtttagtgatttcagtgtttttctttgaaagtactctgggttctccaattatagagaatatacatatacctatatatatggagagaatatatatataaaaaatatagagtatgtatctatactatatggtatatagaatctatatagattctatatatgatctatatagawtctatatatgatctatatagatatagaatatatattatagaatatagaatatatatttatagaatacagaatatatatctattatatatagaatatagaatttatatatctgtataggatataggtatattctatrtatctacctatgtgtgtgtgtatgtatgtatgtatctatttatttacgtagcaaggttctgaactcagcatcccctcgtagctacacattcttctctaatattttaacatgattaatgcacatgcgaaactttctttagtggtgattttcaactccaaggttgggttcattatattctacaataagaagcagaaactataaagtctcgttcactcattgaaataggatttcaccttcactgagctggggctaagcacatagacaatgctcaataataattattgatgaagcattgctttgggtgctgaactgaatatatgctagtcccttccttgctatttaacagtagttacttcagatcctkgacattgatgcttttcataatattgtgcagtaggtttggctttcagttcattgtttgttcaacaagtactaacttcactccgaatatggacctataatggtggtaagctttggagattaaaaagaagtgatgatgtgtgtgaaaacactttgcagagttgggtgcatgtgtgcaatgacgaggaagctcttgttacatggtatggtttctgtacacacatctgacagggcacagcttctaaatctacgtgcttgttagtggtgtgactctccaacctttctcctagtgtagttcccttatttctccttcactctcctggtttaatcatcaccaaatgctgcaatccatcctcagcctgtcactcatgcccagatcttttctgccacctccaccattctgagcaacctctctctggccttgactaggcatggccttcagtggtgaagcctgctttcatgttggagacatgttttcttcataaagccacagtcagcaagttggatcacggctcagcttggagccttgccctgaggagtagctcccaacacttctgtgaggttgctcagctaatctggtcctggcctccactctctccactctctcctccargctcatgtttcttatattctaaattctagaactttgatcagtttcatcagcataaccactcttgtaactgctgggctcccttttcagccatggcwgtaaagccacactgtgtctctcgccaatacccagcccagatcctggcacagagcaggcacttgaggcaggtttttggagtgaaattaaaccagctacatctacatttcatttttcttccagaagaagctgactacttgtcattttcccttagggactttattcttgtagttcttttccagtgtaccaaagctattttgattaaagcttgttatctgttcaaatttaatggcaccatttttggccctgtcctgtcttgctgtcctctgtggttgtttgggggcatatttccaatctccattacagaaattgtcagtgaaggtgttaaactcagggtgagtcagctcctgtgcaatggcccacgcttagatgtttgagtatatccttgaccagaatatcacatgcagggactagtggtttagctcccttttcttcaccgtgccacctgaaaaggttgactgactcatgtgagctccgtcttcattatcaatgaaaggggcacagtgacattttcctgacctgctgcttggtgtsgttgtgatgatcaaatcagaaaatagaagtgaaaaatctctgtaagggatagagggctgtataaatgtgagacattataattaggagaatattagtgtttaaatgttcaaaattttcactatgaatccatgaaactaatgaaaattccaatcctttagattgaaagaggaaacgtggatggaacagatcgratgatcctggtacaccagctttcccacccctggggaattgcagtccatgattctttcctttattatactgatgaacagtatgaggtcattgaaagagttgataaggccactggggccaacaaaatagtcttgagagataatgttccaaatctgaggggtcttcaagtttatcacaracgcagtaagtatttgtcaytgaaatacattcatgggtgtataatgcatattcacacataactcacatttgtaagcacacacccacacacagtttcacgtacatacacgtgcatacaaattgaagttacctgaaatatttaaaaaatgataatgaagtcttaaacatggttaagtgccaagggctaatttggcatctgaaaggccagattgacttcagagtaagtttattccctttctcttcccattactttcaattccttactttgcttttacttcatagaactccctgttttctattgtttgtgttacttattagaatataacctctgtacgggcaggcattttgtctgtcttgtttgctgctcaatactcggtgattagaatagtgcttggcacataaaaggtgctcagggcatatgagttggatgcctgctgggaaagtgctaatgggatggaatttttagtcttaaaaagaatgcttttggatgttgcctatttcaacatttttttcaaagataatctaatttctgatttacccctttaaattagtggtatgatacaggtattattttttgatgtattttatagctttcgtcttcagccaaagatgatcaaacaatttgtttcctgtcctataacctaagtttgtcactaggtatttttttaactgcatgtgaaagaaacacatgcaatagaaattaattttttattactataaagaatattcttttttttttatttttccataggtttttggggtacaggtggtgtttggttacatgagtaagttctttagtggtgatttgtgagattttggtgcacccatcacctgagcaatatacactgcaccctatttgtagtcttttatccctcgcccccctcccacccttcccccaagtccccaaagtccattgtatcattcttaggcctttgtgtcctcatagcttagctcccacataccagtgagaacatgcgatgtttggttttccattcctgagttacttcactttgaataatagtctccagtttcttccaagtcactgggaatgccattaattccaggactattctttaaatcttatttcatatatttaaaaaaaatcacattattgatcatgtaactgaacatattattttaagtgccagttcataggcaaattatgagcagatttatatactgacctccctaatcctcgcatgatttgtagaagaaaacaagtgaagccccattctctaactattatacaatagttgggttactggtttcatacctttaggtgttattgtataagctctagtctctccgatgttgtttttagattgctaactcagctactatatgttggttattaatttttagaataaattatttggtgacccaattaaagaaatttgagatggggtggcragtagctaggatcaaaagttacaaatggattttgttttcatttagatgcygccgaatcctcaaatggctgtagcaacaacatgaatgcctgtcagcagatttgcctgcctrtaccaggaggattgttttcctgcgcctgtgccactggatttaaactcaatcctgataatcggtcctgctctccatataactctttcaytgttgtttcaatgctgtctgcaatcagaggctttagcttggaattgtcagatcattcagaaaccatggtgccrgtggcaggccaaggtatgccaactccaatataagtaagatttgacttcatctggcaccaggttgaaatccctggtgccatgaaaacatttcttcatgtgtggattcagtgcataatgaagctttcctttccctttaaatcaactggcacagcctaaagtgtttttcaaactttagtgtgtctcagaatcacctggagggctcacgccaacacagctccagacctcgtccccagatttttctgattttgtagtctagggtagggccagagaatctgcactcctaataagctcccagggcatgctgacggtgctggcccatggatcacgctaagaaccacaggcccagagcaatatagaatgtaggatgggtttgcaagaagtactacagagttggtgttccaaagaactgtgccctatttctgattattaatggagatttatggtagaaggtatactactatttaatatggtaatgaaatagtccacaaatatgatttattaatatatatttggtgaattgaagcaaaagagttcacagtgtcastccctctttagtaatcatatttttgcagcactttgtgcttacatactgtgaatgtatgaaacgatcacttgcttcctagatgagccaaggtttttaggtataccttagcacaagaggaactaagagttttctaacatcgctaggagaatgtcacaggctaaagagagaaatagagggtagaaaggaaggaaaaaaggatgaagtsaatgaaggggttgtagagatggtcagaaaatacagaaatgcacctggagaagggaatcagagagcttccagtcccacacgtcctcctgcctgatggtcatgttcacgtggacccatgactcatctttgtttttccatatctaaaaagttatggatctaagttatcatcttgtacagatatgacaaattcaatagtttttttctcccagcttttcattaaaaaaatgttcaaacacagaaacgttgaaagatttaggaaatatccttataccctttaccaagatttaacagttgttaacatttcttcacatttgagctctcaatttgtatgtgtgtgtgtgtacatgcatatgcattcacattcattttttatgaaccttttaaaaataaattttaataccatgccactttacccctacatatgttagcatacagtttcaaagggcattatgaaatattcataatcatatttctccagttggcctcacaatattttatatatagctgttttgttccatccaagatctaatcaagattcatgcactgcactgggaatatctcattagtttcttccagtttggagtagttgcctctagctttttgctatgacattgatgttttaaagaggcagacctgttgtctttgagaatcccacactgaggatttgtctgaatatttagtctgtctttcattttttaccctgcagttctcatgaaatggaagttaggtctaattgcttgattagatcaaggttaaatacatttagcaataatactttataggttatgctgtgttagttgatacagaatcttattaggaagaacataatgtcagcttgccctgctcttagtggcatttgagtttgatcacttggttaaggtggtcactgctacactgctgctttttaaagctgtattttttttccttcttaattttggtggaatctatgcaatcacacttaggccctgtgaatgtcttggctcccaagcaccttttacccattggttttggcagccatggatgatccttgtttgaaatgattatttaatcgaggattgcaaaatggtgattttcttattttagcattccctttacatttgttagataatattcttctataaaggaaagctcttcgtgtctccccggtttactttttaaataatttattattattatgggctcaaatttttattttttaaattcagtgtgttacagtcaattactgtaatccttcttttgatgttttagtggatccattttggccagggagaacctcttcaagtggcgacctgtatatttctgtgtatgccttgtttcttggtacaataagatgtttcacactcacttcgtaccttccctgcctaaacctataatcaacatttctcccgggagccagagctccttattgtgggaaagagtagaaaccaagatgtgggtctgctcactgcaactgggaaaaaagggtttcattttgtaatggggagatgctcagagcagggggttgggaatgagggtttgagaggaagggcagacatttaaaagttctaatttcagtgacagcattttttaatgatcttttcttaacttccaggacgaaacgcactgcatgtggatgtggatgtgtcctctggctttatttattggtgtgattttagcagctcagtggcatctgataatgcgatccgtagaattaaaccagatggatcttctctgatgaacattgtgacacatggaataggagaaaatggagtccggggtattgcagtggattgggtagcaggtatgtaagctatatggtgattttaatatgtttgcatctctgtcatcttattttatgctagaaagtttagcctaactccatgtgctacaggtttgtttttctagacaattattaagaccatttaagatacattgaatctagattaagctacgtgtctatttgataaatgatacggtgtttcagtttacagatttataacaaattaatccttatcattttcttctgttattaacataatctggagacaaaagtggctaaaatattaaattatgtggatttgttttttttacacttagatttgcacctgatttctgcattagaaattttctaaattttcaagagaaagagatataaaaatataaactatggaacagcattcatttgctttgaagctgagcaattttagttgccaaattcttaattgcttccttttattcatatataaaaatcccttagatcatgagatattttattagtaatttttttaaatgcctggtccagtattatattaacttagttgtatttattcatgcacataagcttgaataacccctcatttttatcactcatctgagtaaaaataccactcataattagtggtattatatgttttggaatataatccaattctacataaaatcagtatcattgaatcaagcttggtgagtaggcatcacttagaaatattagcatgtaggcagggcgcagtggctcatgcctgtaatcccagcactttaggaggctgaggcaggcggatcacctgaggtcaagagttcgagaccagcctgaccaacatggtgaaaccccatctctactaaaaacacaaaarttaaccaggcatggtggcgtacgcctgtaatcccagctactcaggagcctgaggcaggagaatctcttgaagccgggaggtggaggttgcagtgggccgagattaagccactgccatcaagcctgggtgacagactgagactctgtctcgaattaaaaaaaaatttaaaaaaaggaaatataagcatgtattatgaaaatctaagtactataataagagtttattgcaaaaagtaaatatggaagtatggttaaataaagctttaattgggttcctaactcccgttcctgaatagaaattactatttctgagggtatagataaagcagtagtcagcaaactatggcccgtgcgtcaaatgcagcctgttgcctgtttttgtaaataaagttttattgtaacacagctatgcccatttatttgtgtattgtctatggctgctttcatgttacagtggcagtgttgagtacttgtgaaaccatatgctctgcaaagcctaaaatatttattatgtggccctttacagaaaaagtttgccaaccctggattawaggattggaaatgagcaaatgcatacatagcaagtagagttaggtaatgaaaaaatgtatcagtaacatatttcacattggcctsatttctctagaggtggtttgaatcagatataggaacaaaatatgtgtgtcttggtagtagcattgatagttcaacaacagactttcaactacatgaaatcaataatttgtggtcattctctacttattatactatcttcataaagttatctttttattctagcatgtacataaggcccaaagggaaatggacttttggtcacttttagaaggtccatgggatgaaaacacctacattagttagaaagactaaggaaaaacttcatgttaaccttaagttcaaagaccatttgataacattaataacaacctgagatgctgctggtgctccctctttgctacttttatcacattgggatggaagttgtgctatgaaaatgtatatttagagtgtttcaagtaggtattaagcatttagagcttcagatagaaaaggagggacattctggaaaatatacctttcagtagaaagtgggttatgatgttgctatgaattctaatctactttagaagctgaagataggcactttctctctaaatttgaagacacaatctctataattcctaggagtaagaacttatttttctaagcctagactgggacactatcatcttggaaaagacaacatatagtgacccagacttcaaccttatatattttgttctgaatttgtaaagttctccctttttttcttcttggttctccattgatcagcrtgcactttcatttttcccataggaamtctttatttcaccaatgcctttgtttctgaaacactgatagaagttctgcggatcaatactacttaccgccgtgttcttcttaaagtcacagtggacatgcctaggcatattgttgtagatcccaagaacagatacctcttctgggctgactatgggcagagaccaaagattgagcgttctttccttgactgtaccaatcgaacagtgcttgtgtcagagggcattgtcacaccacggggcttggcagtggaccgaagtgatggctacgtttattgggttgatgaytctttagatataattgcaaggattcgtatcaatggagagaactctgaagtrattcgttatggcagtcgttacccaactccttatggcatcrctgtttttgaaaattctatcatatgggtagataggaatttgaaaaagatcttccaagccagcaaggaaccagagaacacagagccacccacagtgataagagayaatatcaactggctaagagatgtgaccatctttgacaagcaagtccagccccggtcaccagcagaggtcaacaacaacccttgcttggaaaacaatggtgggtgctctcatctctgctttgctctgcctggattgcacaccccaaaatgtgactgtgcctttgggaccctgcaaagtgatggcaagaattgtgccatttcaacagaaaatttcctcatctttgccttgtctaattccttgagaagcttacacttggaccctgaaaaccatagcccacctttccaaacaataaatgtggraagaactgtcatgtctctagactatgacagtgtaagtgatagaatctacttcacacaaaatttagcctctggagttggacagatttcctatgccaccctgtcttcagggatccatactccaactgtcattgcttcaggtaagtgcactccaggtgctgcttgtcctgcaagtagacacaatggggtcaacacacatggatgactgagtgtttctaatgcatatgagactctaatgtctttgtgtgtrcttgtgtgtgtktytgcctgtatgtgtccaggtatagggactgctgatggcattgcctttgactggattactagaagaatttattacagtgactacctcaaccagatgattaattccatggctgaagatgggtctaaccgcactgtgatagcccgcgttccaaaaccaagagcaattgtgttagatccctgccaagggtatgccatcatcttccttgttatatttctgtctgcttatttctggaaaaaatggggcctgaaattatgttcatagatagccaatgtgttatgggcttataaaactatggctacagattcaaaaatgaaagcatattgagtgattttacgtgggaaggagggtgcagcgcatagctccctttgatggcagaaaggttggcaacatactaggaagtcaacaccctgacttactagatctcctttggacaagttgtgtaagtagaaatgaagtttcttttgccatgttactggcaatttgcaattaaagaatattgtccttttttttttttttaaaggactatgaggttccctgtgaattaattattgactccttttgtatgactaggtacctgtactgggctgactgggatacacatgccaaaatcgagagagccacattgggaggaaacttccgcgtacccattgtgaacagcagtctggtcatgcccagtgggctgactctggactatgaagaggaccttctctactgggtggatgctagtctgtaggtgtctctggttactcatgtgggtgttaagaagaggtttttcttccatttccaaagaagagggatttgcatcatgtgatgaaaatatagcatgccagatagacattgccagaatatagaatcacagttttaggaactatgtttatattggaacttggtgaacatactgtgaaaatttatctatatcatgcattgaataattatgaactaaaagacatctaaagatgcattgctaaatatatctataatttcagctataattataaatgtattttctcaatttagaattacaaatgaaattactcaacttacattctgcaggccctaggtaactgctataaaatctgaatgacttttaaatgccaattgatattatgtttttttctgggctttagcattcaatgtcttttagaaaattcttttcttaaaaaaaaaaaaagaaaattcttttcttcagtctttgactttttgtcatcttttcaaatagaccctttcttctctggcaagcttctcctcagcgcatttcttaatattttccttttgtcaactctaattttgtatgtaacttctccaagtaccccccatatgtctcacattccagtcatcctaatggaatagttgaagggatgaaatgattttgtttattatggctggtgtctacatatcgggaatcttaatttttcttgcatatttctttggaattttagtcttttgatgccaagacctaacctcctgatcttttctttattctcctatttgaaacaaagcagtgatgctttgagtctaagcttggattattctaggtaaacacctcaaggtactcaataaacatcaaattgaaaaagtcactaaggaagtgggatggaaaagttattgttttattgagagtctgctatgtgcttaacactgagttccatgcattacatggattatttcatgttttcctgtttctaatatcaacctgattccttttgtaggattactattcatatttggaagtcaatgattttatataggctattgtttgataagcaaacaagacctcccatcaccagaagaaacatttccagctgccatatgccccatttgaaaagaaagtttgcagcttgtgtaaacaatgatgaggcgcatgcattgggctgccagttgaaaacttaactcacttgagatttcaacttctaaatttttttttgcttcattttaggcagaggattgaacgcagcactctgacgggcgtggatcgtgaagtcattgtcaatgcagccgttcatgcttttggcttgactctctatggccagtatatttactggactgacttgtacacacaaagaatttaccgagctaacaaatatgacgggtcaggtcagattgcaatgaccacaratttgctctcccagcccaggggartcaacactgttgtgaagaaccagaaacaacagtgtaacaatccttgtgaacagtttaatgggggctgcagccatatctgtgcaccaggtaaggcactgaccatgaaaattagaacatggagaataatgatcacaataccaattggtaaggaaagctgaagttctcacaggagaaaaaattcaaattctccttgatgtcagggtaatttatgaaacagacctggggctatattttgagaggaagacttggcaggcttcttttctaatctatatggagcccttttatgaaagcattttcttttattttatttttgagacggagtctcactctgtcgcccaggctggagtgcagtggcgggatctcagctcactgcaacctccacctcctgggttcatgccattctcctgcttcagcctccctagtagctgggactacaggcacacgacgtgtccagctaatttttgtatttttagtagagacggggcttcaccatgttggccaggctagtttcaaactcttggcctcaagagattgcccacctcggcctcccaaaatgctgggattacaggcgtgagccacagcactcagcctatgaaggcattttaaatacaagcttgatggagttagaaagaaagatgaaggccttggctgccctacttcatgtcttgactaagaattctgtcaatgagctggccttccttataaaaggatttacattttctgcttaagaggtattatttatagtttgaaatatttctggtgatatttgcgggtgggatcatatgtgcttcattgtgcattttataaagaacaacaaattcacgggaagatgtgccttttgatgttgttgctttgcaaattttgctgagaagagtcgttgatatttcctgttgtttagaaggaatcggcacatttattagaaattggtgattgctcttcttgatggaaaagtgactcagaatatagttaaaaggttaatgggcagaacttccatggcgcttcttagggagcatttaatgtagaagctgttgcaagtgctattgtggaggggtcaatgtgaacsgtggctgcatccatcttttacttcttctgggattatctttcttcaggtccaaatggtgccgagtgccagtgtccacatgagggcaactggtatttggccaacaacaggaagcactgcattgtggacaatggtgaacgatgtggtgcatcttccttcacctgctccaatgggcgctgcatctcggaagagtggaagtgtgataatgacaacgactgtggggatggcagtgatgagatggaaagtgtctgtggtgagttggactcttggcgcttttggtaggagctaatggcatcttgatgtcaagtgtttggtatggaatcctgctrtgtgtgaatgtgtttgaaatgtgtgcctaggcatcctggtagagctgaaaaatgtttcctctgataatccagactgtttctgttaaatcacctctgtagtggttaagagcacaagcacaatcatcatcctggtgatcgcatttgtaatctgtatagacctgggaaagttacttaatatctcaagcctcagacatctcatctgtaaaatggagctactactagggttcttgygaggagtaagagaaacaatatgtaaaaatcccttagcatgaggcatggtgcaagctaagtctagcttagcttgggactaaggaaacgtatcattttaccaattttcrtagcacaaaggtcattatttcaaaaattttatgaaaataacttccaatcctcagcttccatctgaatagagtgaataaaacacagtggactttctcagggagttctgaggttggttaccttttcctagcagactgtgataggggctaggagtttttattttcctgaaataaactataattgcatgctttttgtgattgagataaattgagattatagagaaacagaatgactttgatttgtgcttaaattacttgatttgtgcctaaaacaattttaaaaatgtatacaacatattttgcttaatctaactaattaaaagtgttatctcactttgcatgcagtccattttgcagcgttttttgccttggaaggtaaattcaaagtgtctcttttatttaattrtatctttttaaaaattaggataatgttttaatcaagagggtttgttctcatgtttttcctgttcttagcacttcacacctgctcaccgacagccttcacctgtgccaatgggcgatgtgtccaatactcttaccgctgtgattactacaatgactgtggtgatggcagtgatgaggcagggtgcctgttcagggactgcaatgccaccacggagtttatgtgcaataacagaaggtgcatacctcgtgagtttatctgcaatggtgtagacaactgccatgataataacacttcagatgagaaaaattgccgtaagtttatcttaagtgcttattgtgattttgggtctgaagtcttggatcacaggagatgaaattattatataaaaaaaaggctttccaaaaatraaaaccctaagtatttatctaaaacgtaaatttttggctaggcgcggtagcaagtatcaacaaataccaatcttgtttcatttttctctccttttttctagtattttaaagtgactcctagtcmtgcacttcactgataacattttggaaaataactaccatgccattataaygcctggcaaaatcaaaagtgcttactaaatatccctgagtacctagtccatgttcaaattttgtcacttatccccaaaatgtatttttactgttctctgttcaagttagggttcagatgagatctacaactgattttgattgttatmattcttcaatctcttttatgccacaacacttcccactttttaatgtcattgattcattagaaagattaggtgatttgtcctgtagaatatctcacattctggacttgactaattgcataattgatccatttaatttatcttatccctcttatttcctatgaactggtatgtagacctagagttttgatcataacaggtgcaattctttgggtaagagtatttcagaggtggagctgtgcctttcctgttgcatcaccttatgaggcacatgatgttttgttgccccactttaagtggattctggtgtcagcctgaatcatctcttatgaagctcccatcatcctttcacccagtggttttagcatccatcggtggttgttccgtaaacccattatttctttaagagttatgaatgggctctttagaattctagtgttcctgccgcatttattagctgaagtttgataaagaagacatttcccttaccagcttttgttggtaattagaatctacaggataaataccttttgcttgtcaattttcagagtaatgagttggtgacaaaggagaattaactttttgtttagtttagtttagtttagtattatattgaactctttgatcttcatgtatttgatgagttttaatacagtgctgtcaactgttttttcttggtgcccagttgtccaaacttaggccaatgggagtccttaacttgaattttctgttctttggcatgaccccaatccatcttcttatagctcaagcttgtcttatatttcctgtcccagtcctggaattagccacttatccaaggagacctcattccctttgtggtacttagaaattatcacagggttgagttgctcattcctacttagctttcattgcttctagtccttttcaatggtcagagctaggaaatacagtttttaaggaaaaaaaatttttttatttttttgagatggagtcttgctctatcgcccaggctggagtgcagtgacgcgatctcagctcactgcaagctctgcctcccgggttcacgccattctcctgcctcagcctcccgggtagctgggactacaggcacccgccaccatgcctggctaattttttgtattttttagtagagacgaggtttcaccatgttagccaggatggtctcgatctcctgacctcatgatccgcccaccttggcctcccaaagtgctgggattacaggcgtgagccactgcacccggccagaaaaaatttttattgatatttcccattgaaatttaagattacaggttgtttacattttagattttataatgacatctcttcttatgcttaaaatcatagtttctcttgacatttagttgttttattatatagtaatttcaaaatgcctataataatttcaacattattataaccactcaaagaatactattaacaataagtctactaagtgcgagattcttcttgctttttagattatgtcccactagagatatgcagtcaaaggtatgactttaaagatatttggaatttttttttctgcagggttatgctatcaacctgatatatagttagctttatctattgctgtttccaaattttattttattttattgattttatttgtacaaaatagcatacatagttccaaagttaaaactacatgacgaggtgcatttatagaagtccttcatttcttcctctcctttctgcttcctctgtgctcttctcagtctatccagagagatgacaatttttgttagtttatcttttctttgttgttattgtttttaatataagcatctctctcttgctacacacacacacatacacttatatcgtcctttttcttacacaaaagttagcctactgttttgaatcttgctttcttactattaacaatatatcctgaagattatactgtcattacttatcagtatatagaaatcttctttattcctttaatagctacatattactccattgtgtggaaatgccatagtttattttaccaagagttggaactcttgttgatgctattaattaatgaaaacagatgatttaagttacaaaccagtgtctcctctcccttctccccagtatcagctggaaatatgtttttttactacagaatctataggtaacataagtatcatggatcctgcctttctgatggctttgaaaatgccgcccttccagtggtttgagttccacaatagatgtgttagcacggatactgttcataatacatatttggtggatatattcctaatatttatctggttgyctttttcaagctgatcgcacttgccagtctggatacacaaaatgtcataattcaaatatttgtattcctcgcgtttatttgtgtgacggagacaatgactgtggagataacagtgatgaaaaccctacttattgcagtgagtaagataaaactgctttctttctatcrttccagagrtgcatgttgtgagctaatacaaagatatgaagcgtgggtattcgggctgatttcaattgtcatttcacattgaccttctaagtagaggtggtaggcagttgctttcatatgtgattgcaggggtatgagaaactctttctctctgttccctggctagaattcccagaccctgaatatttcttccagagatctgctactattggagagccatttctcccagtgttgaaagccttttgccttcatgtacttaggcagaatttgcccgttaagcccttataatttactcttaatattattatagtggccatcagtaactgaaaattatttttttttcagacagtctcactctgtcacctgggctgtagtgtagtggtgtgatcacagctcaccgcagcctctgcctcctgtgctcaagccatcctcccatctcagcctcctgagtagctgggattacgtgcatgtgacaccatgcccagctaatttttgtattttttgtagatatggggtttctctgtgttacccaggctggtctggaactcttgggctcaagcgatccacccatctcagcctcccaaagtgctgggattacaagtatgagccaccgtgcctgaccagtaactgaaagtatctttatatcccctagatacgttggaatttcagaaatctctatttcgtatttagcaatttggttcattcaaacaatttcctgtatttatagctcaaattaaaaggcctttcttaagtttgataactttgagactattagtgtaaatagatacataatttaaggatttagtgattggacttccctgttctgtgtatatgtagttaaactcttgtcactggcccctcccaaggaaatcaaagggcatcataattatttgtcaccaaattagggtacagcacaggaagaggaatctgttgtaataacagcagcacaaggaagcagaattcaggttgcagccaccagatagggctagacagataggaattattgctgacttttcagggacctctgcttccattgtcagttctcccctggcaaatcatcagatatcaggggccaaagcaaaacggccttatagaccagaagaattacaagactttaattagatgtgcacccacataacaatttggaaaatgcatataaccagagctacctaaaattactsgagaaaagagtcaatgttcaaacataggcagagtttcccacttactcaactaaaagtctggtattccaaggatgaatacgaagataactttgccaactttctagagttattatctaacatagctaaaaggttgtgtgtggagcgagcttagatatgatcacattattgttttgcttttaattatcattgcaatggaatttatttaatcttacattatagtagaaaaaataaaaccaagacttataatttgtgatttcatttatcacaaagatagttctttggtatttctaacaaatacaattttttttttttgatttctggaatctagaaaaacaaattggggaattggggcaggattgacttccttctgtctcccatacttcttcctccccacagaaagcttacacaagcatccattttccaggctcagtcttccttttttggtaactattatctagctcagagatagaggcagattgttaagactgatgggaacatgcttrtgttttgctcatgggttttatcttctttccctcctgcagccactcacacgtgcagcagcagtgagttccaatgcncatctgggcgctgtattcctcaacattggtattgtgatcaagaaacagattgttttgatgcctctgatgaacctgcctcttgtggtaagagagtaagcaagcatgaaaaacatcacgatgcagctagacaacttcagtctcttccaactgcttcaaatacagaccagggtcatggctgctgaatgcttggacttcctgtcccagctttcatctggaatgctgacaccgctcagcggatattcattaagacctgttagtggagagcactgtgtggggagctgatcaggatacggaagctgctgattgatgctgataaaatgaaattatattggtgatgcacctaatacagtgcttagctggtagaacttaattttagttggctctcaattgaagtttctgaatttggttgagtgctggcccagaaagctgtcagaggacctaaaagtgattggagtcatatacatggggaaggagtatattaggagcatgcatcctcttcctgttctctctctgtgccagtttatgagcacaagaggcccaagaagttgcaggagcctttggttgtattcctggggacagttatgccctgtttacatttggaggctgctatttgccttcacaaattctaatctatatccatgcacattttttacataattgtaaaaatataaaaatacaatcttctacattgctttaaaaaacctgtcaataaatcatattgctatataggagtcagaaaactatggctgtggccagttgcctgtctttatagatagcattttactcaaatgcagccacatatggctgctgtccctctactatggccacgtcctgtaggtgcaacagagaccatagggcctgtaagcctaaaatatttactatctagttaaaaagtttgctcgtccttgtcttcatactgccttttaatgactataatattccattgagtggttatagtatcatcaaattaactgcctctattattaagcattaggttgcttttattttattcctctatagtatatatcattgcagtaaatattaacatcgtatttaaaacattttattttcaggatattttcttaggatcattagtatagttttatagctgaagtcaaactattttcaattccagttttctctcaggtttaaattctgtgttgaagagtggtatttggagtgcttcactaagttctttttccccaacactgaaagttttatagaaagcaaagggcacatagagttttgaggacctgtaaaggaaataactaataactgctggatgagtagaatagtcttagagattgtttcaaatgtatgaattattggttcaaatatatgaataattaatatgagtttttaaacttctctatggtaacaaaagccatagtaatagcagtgagtaccaatgacctgatatatttaaataaaaataagcacataatmtatatatgaatatatcctcattgtagtaaagtaataatattcagaaatatattttaaagaaataatacgatgtacaaaaaagtaaaatttacattttttcatccttctccaatcccctcactcctcaaaggtaatcactattaaaaggttgagtgtgaatttgacttacttttatcttttatatatcttactttacttttatatatcttgatatatagattttaaaaaaacagatggagtcttactatacatattttctgcaattagcttttattttttaagcttaacatcatgtcagcaaatacagaccagcctcattcctgtacactgccaaagaatattttaaaatgcgaatggtccatgtatttttatccttttcctagtggttggacatttaggttgtttccattttttcactatgaaaaacagtgtcagggtgaacatcctttgtgcacatgtggaaagatccttatggtctagatgtccagaaatggtgctgctgtatcaaaggagatatgtctcttcaaaaaatctggatcaggccaggcgcggtggctcacgcctgtaatcctagcgctttgggaggccaaggcaggcggatcacaaggtcaagagatcgagaccatcctggccaacatggtgaaacctgtctctactaaaaacacaagaattagccgggcgcggtggcacacgcctgtaatcccagctactcaggcaggagaatcacttgaacctgggaggcggaggttgcagtgagccgagatcgcaccactgcactccagcctggccacagagtgagactctgtctccaaaaaaaaaaaaaaaaaaaaaagtctggatcaatgtacacacttttcatagcagcttctgaaagagcctgtttcttgttactgttatgatataggctgtgtctttatcagttgcaactatactttctcttgccttaggctaattccagggtcccctgggtttgggagcctatgacaccttcattagttaaataggaacatgtggggttagggttagagcatctgaatcagtgatggctaatttgaagtagaagagtgacttattttaattcagtatttattgaacagtggtgttctaggaacttttgggctgtgtcagtgaataagacaacaatccctacccacatgragctaatattctaaagaggggagacaggcaaccaatcagtaaattgtctagtatgttgaaaggtggtgctaagtgttatggaaagaaggaaagggagcaaggaagcgggcatggggagtgcaggcgrggggagactttgcacaaaacaaaatggttttggatgaaaagtagattttaaaatagaaacatgtgaaatagtaggtaattcatatctttcctgggaaaagaagtgttctttctctaccatacacataagggaatattgtatctcattttagtcaccaaagataattagggctttgcactgtcagttgactacttttacctcaaactgttggtcgctggtactagtcttattggaggactaccctagatgtatataattaaataatgctctgtttcaggttttctagacaacccatgctacarccagcttgtctccagattcctggactgtaaaccactttttttcactgagaatgctattgatcttttcaggtcactctgagcgaacatgcctagctgatgagttcaagtgtgatggtgggaggtgcatcccaagcgaatggatctgtgacggtgataatgactgtggggatatgagtgacgaggataaaaggcaccagtgtcgtaagtgaagccaattaattcctctgcagagtcacattccagggaaacacagtagagttgtttttctgtgtttggagagtatgattgcagatttctctgtaattgaatggacactgatagaatgttacctttgtttctccatgctgggagtgtttgatatcatccacttaaatgcttcagagtgatgaaaaatgactttatgtttactttctttctcttacatttggctaatggacataatgtcctacatttctaggggaaaaaaaaaacccacaaatacttggttgtctccttttcttttttcttttctttctttctttttttttttttttgacaaggtcttactctgttgcccaggctggagtgcagtggcggtatcatggctcagtgcagcctccaccttccaggctcaagcgatcctcccacttcagcctcccaagtagttgggaccatacgcccaccaccatgcctggctgattttttatacttttttttttgtagagacgaagtctcactatattggctaggctaatctcaaactactgggctcaagcagtcctcttgccttggcctcccaaagtgctgggattacaagcatgagccactgcacccagtggttggccactcttaatagcaaccttcacagtataacaatgaactgtctctrgtttcctttgtcaccttaaagcggcatggagggaggggtgttatgcctcttgagtagataatggaacatcattttcattaccaacagggtatggaaatcttagctagttcaagaattaatctaatcggtgttagaataatgtctttctatggtagggcaatagactcaatggctccctgctgcttgcatctgatggcaccctcctgtgttgtgactttggtggtgggtcacaactccacatttaccctatccaccctatccactgacatgggtggttttcagctacacatacatggattgtggtgtatgcatttctctcacctgtctttaccaacatcwtcttctttcttttgtttcctattcacctgcaatgagtctggataaaacccctgttcttttattttgtggacactaatgatttgatgtcagcatctcacctctttcctcatagcatcatggtttctgacaactctgttagcatatgcctttcctctccaccccaatattgcttggggtggtagctataatgtagttggaaaagcactaaatttggaggagaaagacctaggtttgaagccccagctcttcacctagttctatgactttgagacatccagttaaccatctttgagcttcagttttctcatctatacaaatggtgtaaaaatacctatytcacattgtgcttgtgtgattatactttgtaaactaaaaaaagktaccaaaatataaggcattcggtatccagttaacaaaatggtagtggttttctgaagccctaagggaaaaagtatgaccattctaatgtattttatggaaaaataaatgagacattttattgtattgatttctttgaaaaagccagggtccaaagcaattaaaatggaatctttggaggtatttttattatgatctattattataatagcagtgtaatttgtctacgtgttttcctcccatttcctttcatacttagaatggtaagtaacattaaagcaaagagaattaactgctgcactgagctctcatgctttctgattcttgcgtgctttggtttcagagaatcaaaactgctcggattccgagtttctctgtgtaaatgacagacctccggacaggaggtgcattccccagtcttgggtctgtgatggcgatgtggattgtactgacggctacgatgagaatcagaattgcaccaggagaacttgctctgaaaatgaattcacctgtggttacggactgtgtatcccaaagatattcaggtgaattgaggattcagaagttacccagcatgcctcaaatgtccatgggggctgggctcacttacctatcaggcaccccgtggccacagtgcccagggcccatgatgcttttagtggcttatgaaaatgtttggattcctttccaaatcaaagggaaaaaaaacttttacatcaaagaaagtattttaatatataatattaatatatctggctttataccaatatgattgcattaaaatgaaaagaagttacttgaattattaatacataataccatattaacaatttaaaattaaatataatttttaatatttttatggaggaaggaacccaagaaggcaaaaatgcctagggcctgtgaaagacagaatctggccttgcacagagggccagggagatgaatggatagggcttgagataagaattctttcttgaagctggtgacccgcttagttttccacttggagtagaggcattggtattacaagaactgtttcactctcttctctctactacaagaaaaataacagcacaagcatgatgataaatagagcttggctcttaggctcagagtcaagtagaggcaggtggagtgaactgagacaatgtctccaactaaggatgcagacattgatcaatatcatgcagaagggctggaaggccagactttctgatgctctctttttgacagaagttggaaatctggattttcatttgaaatactctgattttaaatgctggaaacaaattttaaaattcttaaaacactgtgtggatcaaacagattcggctcacagcctgctggtttgggggacctctcctgcaatgttccattgtttgacttcttacctctttctccaaatgggcctcttcaaacagtttatatacattcttaacatcccaacttctcatcatcccacttaacaaatacttggattatggaaggaaatggagaagaacaatttgtaagtttcaatcctgattgactaggaaaatagtacgagcattagcaaaagtaggggagtccagaaaggcgcttgctcaaggtggaaggtgagtttgacatagtaggacttcctgaggtgaaagtatgtcttaggtatttgggcacaactggagccrtgaagagatattgcttgtgccaaggactgttaagggacacacacaggcacattgagagcatcaggaatggccaccttacagcatgcgaaggaagacagtgggaaagatatactaagtaggcacaagatcagagaagcagagtcacaggggccattgactggaggggcaggcagctcatcaacaggcgctaatgtaccrttggagtccagtgtggtgtacgattgtgtgtttattgtggtggtcctgaggaagaaggaggaggtgaaggagcagggactcagcagtaatttaaaaagtagataaatgctatcaggaaaatacactctgtgggtgattcatcctctgatgagtggacattgctgagaggtgrtagtttgtgaactgacaatgcaaagacattcaagaggtggagctgtcttcttttgtagtgaagctgcagtagaatatgctttgtttgtatttaagtaatatgaatgtaaagtgtagatttttattttttgcacctaaagtggataaatctttgtctatattttctccctactgctcaagagttctattgtgttgcacttctatagtttttctgaatttggtaaatagctaatagcattagtcttagatgtaaatatattctgaatacctaggcttagactctaggcacaagaatggtagcaggtgttgattttgatcagactccaagttatctcctttattcctcccattctgagctttctgggttcttcctttatcattactatgatctcacagcacagtaacatttcctctctccctttctttgttcgtccattgttccttccttcactttccctccctttctctctctctttctttttttccttgagctttctgaatttccttgaaaagggctatagtagaagagaaaaaaaaaatactgtttgtttgaaaacctgagctatcagcttctaagtaagtccaaaatctgtgtctggagtagcctctactaggtgtgctgttagtgtgcatctccttgcttgcttggcagaaagtgtgctccccatttggtacagtgggacaggagatcatttttcctattgaccttctttttttcttggctcactactgatgctgctgaaaaacatggatgataagactgaggggtgacaatttggtgatgagctggaatactgacttgcaatagtgtctgaaagcttggtgatttgcttgatgacttgtttttcctcctgcattggatctaaattagacaaaggaaaacattggtgttttcaaaccatttggaaatgagttaaatagctcccgggagaccaaatgaagctgagccagtctgccttgaccacagctttcttcacaattacatgcacacattttgctgtaaatcatgttgacaaggccctgggtttatggatggcagtgctggttagcaggcctggttataggtcrgttgtaaaactgaccacattcaccgttgttgccttcacattttgtaatgctctatgtgccgctcctatgctttctatgataaattgttcaaaaccattagctttgttcactcttatcaaagattccttgatgcatatgtgagaccccctttagacatcataacttttatgggatcttggagtaatatggagaagaaaggccagtttggctcacagaacttcaggaaattatattgttataatgatgcctgtgtatgttaggtcccgagatagcttctagtactacagcatgccttcttcctttgccagtatgccatgctaacctactagcttgcctttattcacatcaccatgaagactcacatctcatgatagatggcaggagtgtaatgaaagatggaaggaacaggactgacaatgtaaacgttattccagtgggaagatatgtgttcttagaggacacacccaataatcttatttataatatatagcactcaccctatgagtttccatttgggtatgggcacttttatcatgtgattacccagtacattgccagtgcctactggctatctcattatctgttgaacatagatagtgccactgttcataagctgtctcatagatctgatgtataccaaaattacaaaagttgtatttaattagtttatcaactaaggaaaaaatgaatgcaattatttttaatagctatagacctactaattatctatagctattaaatggtagcatttaatggtagcatttctaatggtagcagccagcccctgaggaagttgtgtggaatgccaaatattggattcttctagaattggcgattagtggggtagacgaagatgatgggggaaaggggatcaaggacactggtgatcttgtcgaaatggttgacctggcatttaggtagataaagaaggaagcaaaaccccaagtgggtaatagttgaggtttattgccaacctctctgaaagtggtactggatctcatgatacaggtgtgaccggcacaatgactgtggtgactatagcgacgagaggggctgcttataccagacttgccaacagaatcagtttacctgtcagaacgggcgctgcattagtaaaaccttcgtctgtgatgaggataatgactgtggagacggatctgatgagctgatgcacctgtgccacaccccagaacccacgtgtccacctcacgagttcaagtgtgacaatgggcgctgcatcgagatgatgaaactctgyaaccacctagatgactgtttggacaacagcgatgagaaaggctgtggtgagtacaacagaggatttgggaaaaggaaacaggggagactgaatatggattctcaacccttcacgacttagactttccaacctgtcctctaactacaaagttaccataaaatcactattcctgatatagcaaaaggttaccaaagtttcttggtatataagatggggacacacatttttttggaccaattctttgcttagatagtcattagagagaacagaagatgggcaaatattcaggccatcatttaacattattgccaaataaggtactcaagaatgaagggaaccaggttgattctctttgaattcttgtaatgactttttgcctgaagcatccctctgctagaactcgttggcctgttcttcatttttgtcctcaggtaattgaatgggagagtttaatatctctctcaccccaaccaccacaagtaaagcagttgagaatccacagcatgggcattgtttgcttagcaccatcttgaactccataatattggcagttcgtcctgtttgtggtgtttaatccttgtaaccattgtttcatgtatgttgatattgtctctgtaataacaatttagagaccatatcctttcatttattttgttttctttattccacttgttcattgtcagtactcattgaaagcatttgcctaattgacccagaagtatgtaatgtagtttttatccttatatgaaagataagatttatatgaaataacattaaaattaaatgctagacagaaactgctgtggaaatgtggagaagagattatctatgcataatattaaaaaatctgtgcagcaaaccaccatggcacgtgtttacctattataacaaacttgcacatcccgcacatgtacccctgaacttaaaagttgaagaaaaaaaaagaaaaaaatttaaaaatcatccaaaaactggcttttgctctattgtaagaaaaacttctataaatttctaccaaagtttcaaaaaccatttaataaattaagaaaaacatgtgctatattatacatttatacaaaaatcatagggaactttcttatgtttactcctaattcatatagattcccattgcattttaattaattttgccttacctcaactataagaattaaatcctcaatagtacataattcaaattaaaatttttagcttgaagacgaagtgatctcagtaggtctcatccaaacctatgaaacattcactcttacaactggaaggagtactagtgatcttctgtaccctgttctctttgcagataataagactgtagcccatagatgggaaacgaattgtttgggggtgcacagtgaactagtggaagagcttggcctgatatttggataatggattttgcaatgcatgaagttttaatctattgctccttgatgagtagagaactaataagaacttgctgtcctccctctgtagatcatttttgggtgaggttgcccatgtgttacaggaccagccagagggacatgtagtgttgtgttgcacctagtgttgagctcatgccatctcgtgagaggcaaatgtgtgtatctctttgtggttccrtgttcagtgatgtcacactggaagcctgagcttgaccatggtgtgaacagtcacactggaacatgctacaaatcagagcatttagaaaatttttcctgagtcctgtttgaccagcacactggccaggctcttttcttctcctcttctttctcatttctcctgtattagttgttgaaaccactgatgaaggagtaagttggtgaggaagttgaaaaatagtgacttttcaataatccacagtctttggaagtctttgttgtctgtcttagcmtgattcattaagaattggcactgtttagtagaaatgttgactttgaaccattatagtgagttggtcgttgatattttaggatctctaagaactgctttttacctacaggcattaatgaatgccatgacccttcaatcagtggctgcgatcacaactgcacagacaccttaaccagtttctattgttcctgtcrtcctggttacaagctcatgtctgacaagcggacttgtgttgatattgatgaatgcacagagatgccttttgtctgtagccagaagtgtgagaatgtaataggctcctacatctgtaagtgtgccccaggctacctccgagaaccagatggaaagacctgccggcaaaacagtaacatcgaaccctatctcatttttagcraccgttactatttgagaaatttaactatagatggctatttttactccctcatcttggaaggactggacaatgttgtggcattagattttgaccgagtagagaagagattgtattggattgatacacagaggcaagtcattgagagaatgtttctgaataagacaaacaaggagacaatcataaaccacagactaccagctgcagaaagtctggctgtagactgggtttccaggtaagaaaacactgatgagctttttaaaagttaaaaattaaaaaattctaaccatgttttcatcttgataggaaattaatttttcaacttgggttaatatgcagatacatttaatgtttctgcaggtttattttctgctttgtatctgatattcaaatgatagattcagaacagaatatctaattattttaaaaatttatagtatcatttttatggaaagaggaattgcaagggaagagagttcactgttgctggccattcacttaactggagatgatatgaagggacgattcatgcattcattggtgcattcagtcrttacttcctgagtccctcctacatgcccagcgtgatgacaagcagcaggggttttgaggggaacaaggcagacatggcccttgctctcctgaagtacatagscttgcttacaatacttgtcattggccgggggcagtggctcacgcctgtaatctcagaactttgggaggctgaggtgagaggatcgcttgagcccagaagttcaagaccagcctgggcaacatggcgaaatctgtctctaaggaaaatgaaaaaaattagccaggaaaggtggtgttcgtctgtagtcccagctactcaygaggytgaggtaggaggatcccttaagcccaggagatgcaggttgcagggacygagaacatgcatggcactccagcctgagtaacagagtgagaycctttctcaaaaaaaacaaaacaaacaaaacaaaaaaaacaaccaatactagtcattcccagcatgggctgggcgtgaaaactggagaatggctaacatgagactcttgttttgagattgcccttatggaaactgacagtctttaaggcaggccagtgatattttaactaaactaccagatgaaccacacttcttaacatctctattgaatatcaaatctatcggattcttggcagcataaactaattggctttgtggtcaatagacatcaatctgcaggcactgtaaagatgtatgctgtaaagattcttgttgcagtcagcccagacctccagagggctcttccccacatccttatatttgactcccttaagggtaaagatcctaaaatgggtggggacagttggcttcccagttctccctgaccagtagctggcctgacataggtgctgagtgcttgctggataataaatgaaacrttgactaagcattcctattgtatgtatcaattcctgttttacgtatcctacatgtcaaaaagtatagtgattaatgatttccaggaacagaactgagcatggtactgttcttgtcaccatcctttgttccactgcagaaaaaataatatttgaactgtaagacattgtcattcagccctctctctcagaaactgctagaatgacgtttctcttggatttcagctatttcctctctatctcggtgtgttctttatcagaagagaattaaatacatgtgaggaagatgggcaagaaagtctgggtgagggtagggtaaacttttcttgaaagtccaggagggtgcacaaccaggctcagtgttcctgaaaacacaaaggcagaatggagcccagttacatttacattggtagggggcagttctaagatactagctacactgaaattagaaacaacttttttctccaatattaataaatatttctgctgtcagcaytagggtgtttggtttccaaagcccttgcatttgatatarctttttaaaccaccattacgcacattggaagatactgttggctctcagttatcttaatttttccagtagtggagacggaatatcttctccatgttttcttgagaagaatctgttcacaggatgtcttttgactgtggaataaagagaaattaatgggaaagcagtaagctcaacagagtagagtgccctatggggtagccagtctgccaggacttgaatggtaatagcaacaggaatactaatacgacaagaataataatagcaactccttctaagcctgttgtgatctgaaataatataatgttttaaaaagtccctggtctgaggcctggcatttaacaagtgttcaataattagctactattattctcactgttcttagtgtctaccatgatggaatccaagattgtagccatctcattcatcaggatttactcatttacccaagtgaattaactggcaagacttgtacatatatggatactcattctttcttgctgaagcctgaagcgatgctactgtcctaactattcagatatccagcatgaatggttaagcgcgtacttgttgcaaagaggcattcaggtcttttggaagggaaatcattctccttcattctccttccggttggaattgattatcaaatcctaaatgaccttctcactataggtgcatttaaccctttggaaggttatggatgctataagactctggtgaaagccctgggcccctttagaaagtacacagatcaccaaagctggcttccctgattctgggtaaagaccttgggttaagaacacttaccttataagaaaaataaattttattgaataaaaatacatttataacagaaatgtccttgaggtagcagtttctaacagatcctaatatgtttctaaagcttcttaggtttgattaagtgaaatgtgtctcaggttgagaaactcattttgacagcctgtctgacagaggcagggatgtctctttatcctaaggatgtcataatctttatcttaagaatgtcataattcagagtttctctgtgcagtttcaatgacacacttagacaagtgtgtttccttgactccaccatttaaactgtaattcatgatactcacctctgcttccctgttctgctaagcctttgcactgcctggagagggtgccttatgctgcatgaggaaagtaaaaccagacccgtcgaatgaagtgtgtcccccgtattttctacatgacaccaycttaaagtgggmattattgcacacagtcttgcaccctctgttgcctcactgcaggaagacaaacttcctgttttcccctgccctcatttgcctgaagaaaggtgacttctaacaactgtctgtgattctcaggtagcttgggtaggaaactgggtggctaaatatgtaccatttcacaaagtgactgtattggttaactcctggctctccattttagaaagctctactggttggatgcccgcctggatggcctctttgtctctgacctcaatggtggacaccgccrcatgctggcccagcactgtgtggatgccaacaacaccttctgctttgataatcccagaggacttgcccttcaccctcaatatgggtattgtctccctgcaatcctgggcttttctttcacctccttcttctgcctctgttamcgagaaggctgttcatgtaactatctcaaggccaatgtcttgctggggtttgtcttctgcttttcctacttggtaaattgtttagtgtaatgagtagaagcatggcttcttcaaatcatcatcatcagctcttctgttttcttttccctgacacacttttgcacttttcaagtcctgtattttggctgcatgcaaagaaaactgtggtttcagaaaaccgatttctttactggactctcgaagtcaaagccactgaaatccagttaactatgtttatttgtgagcattttctgtacattgtccccttcctttttctttttwagattatttgctgttagctctctttcttttctgaatgcagaaaagaattcagaatgcagtctgctctacagaatgcagactccatttctctaaatggagaaaaggtgtgtattttggctactgacttcttttggcatcagggactgaccctttgtgtttgccctgacaggtacctctactgggcagactggggtcaccgcgcatacattgggagagtaggcatggatggaaccaacaagtctgtgataatctccaccaagttagagtggcctaatggcatcaccattgattacaccaatgatctactctactgggcagatgcccacctgggttacatagagtacgtacatagaaaagcataaaacaattgtgtaactgtttatttcaaacatcagagcttgtgattccagtctattagtcccctctattgtctaactggcctgtctgttggaagtcattcgggggaagtcacacttctaactaaaactgctgagctctatggtatggtgcagtagaaagagggtgaacttttaaatcatatggatcagggtttatgacctgatgttttcacttcttattgtttttttatctagaaaatggggctaataatctctccccatggtagtcagctcagtgtgcaactcatcttaattttttttatctctttaatttgctctcccctatgaaatatatgattaataaattttagtatttgagaaaaggaaaagaataaaaggatctggaaaactttccctaaaatactttggcacatttatggttaagtgcagtgcagtgttttaggtggcagtagagtctgttaacattaatccaatatgataaggcatttacatctttctggtaataggataatttttaagtgtgttaaatatactgttcaataaaaaatactcattgtaaaaagatgatacacattattaatcaaaaattaaacaacaatacccatattgaattttgctagttatggcctagttggaccatagtawtgtcttctgcataagcatttatggataacgatccaggaacagcctgttgcactcagaagcatggaaatgccattcattcagtagaactatttcaaatttttttattttatttttagaaattcctttcttctgttatatttattttgctgccaaagtcagtgtagtaaagtttgaagttctctaacaccatgctccctggggacatgccactgaaaaagaaggaatacctggcacacacgccagtgctctttcttcctgtgctcatggcaggcataattaatcaatccaagtactttctcttgttgaactggttcatttgctacactaaggtagcctttagcattctcattgcagaatttaccgtagcagatattaactcactcttagggtagagactaactttaattagaagcagtacaatattatttctagtttacttataccattttgatgtgatatgctgatggtaatacccttagcccttcccacagtgtgtgtatcctctcttaaaaggcacatcaaagagctgagttagctttccatataatcctatattgaattagtagaagcatcaagatgttcaaagaagcttcaacaactttctaactgacatttgttgttctttgggtcctatagattattcttggtcttgaaagcttagtaggtgtcactcagcatacatttagacagtgtttccaggagcattagagatgaaaaaaggaattttctagttacacaatattctgttcactttttgataaaatctaatatagattatttacgtagatggattataaaatttaggcagtagattttagtctaaaagtcaaatcataatatgaggcactgtgatctgggaataaaggaaactttaatattcatgagccatgttaaattggttacctcttggagaggtagcaatgcctgtgttcagaaatatatttcatagatgcataaagcaatagatttttatagagcatgcaattgattccttgtacatcttgggatgcaccaacacatcactggarctgtgcctgtagttctactcttacttttttttttgagatggaaattcgctcttgttgcccaggctgaagtgcgatggcgtgatctcggctcaccrcaacctctgcctcctgggttcaagcaattcccctgtctcagcctcctgaggagctggtattacaggcgtgcaccaccacacctggctaattttgtatttttagtagagacagggtttctccatgttggtcaggctggtctcaaactcccgacctcaggtgatctgcctgcctctgcctccctaagtgttgggattacaggcgtgagccactgcacccagctgtgtagttctactcttgacaaaaagtactcatagagatatctgagatctctctacagagattacagatgaactggaagggaaggtctcaggactactttctggtctatgatttttttagaaaaacagatggtggctaggtgcagtggctcacacttatagtcccagctctttgggaggctgagcagggcagattgcatgaactcaggagttcaagaccagcttgggcaacatgacgaaaccctgtctctacaaaaattacaaaaattagctggatgtgctggcacctgcctgtcccagctactcagaagactgaggtgggaggatcacttgaacccaggaggaggaggttgcagtgagccaacattgtgcaactgtactccagcttgggcaacagagtcagactatctctagwtaaataaataaataaataaataaataaataaataaataaatcagatggtgactaatttctggtcatttacctgcatccttatcaacaaaggccaagcacatcttcaagttttcctatgacttttataagttaccataaattatattttgggaaatatttttaacattgcatggctaacattatcaggtttcttagttgctagcttgttctatctcctgtttgagttttaggatctgttccaaatttttaaaatattaaattttcactattttagaaatgatttctgatatagacccacagtaatgaaagcccttggaactgagaggacttgggaatttggctgtggatcctttgtaacatcttgaaatcggagaaccttctctggaggtttattcatctgtaaaagtattcgctaatggtgccatggcacgattaataataaatgtcctgctggtgtttgcaaagttaaccctgcaggcctgtaagttgtgttcccctcaggttatactgagaatgcaactatctcctagaataacgtcccctcyggaatgttaatgagaaggtagaattccagtataatattgctatcttctgatttcttccaatggtgttggaagaaacaagaatggtgttcaccccaggatatcaaaagggtgcttaatgaggaacatcactataagaggccataaacctacaacagctataacagcttcatccgcaggaaagcagctgtggttaggaattagtgattatttaaactcctgacactattcctattttgttaagtattgctttttcacttctacatcttttgttcaatttgaattcatcctttaagtttaatttttgttttaattaaagactaggagttttgaggatctgaacttatattatctctaggaggtagaattttattgatttgtgaattcttttatcctgcaagacattagaggagaggaattacctttatcacataactgtttctgcttactgctgcaggtactctgatttggagggccaccatcgacacacggtgtatgatggggcactgcctcaccctttcgctattaccatttttgaagacactatttattggacagattggaatacaaggacagtggaaaagggaaacaaatatgatggatcaaatagacagacactggtgaacacaacacacagaccatttgacatccatgtgtaccatccatataggcagcccattggtgagtaggtgattgaggggtttggcaaggttgccttgggttatgtgcatgtcatgattgtctttaagcatgaacttcgtgatttacaaaaagtttrttgcacttgttagtgttttcttcaaagcatatgctgaaagttgacagtaggcaaatatctttagagtttatcccccttcccctgggaaagactacctagaactcttcatcttcttaaaactcgctcaattcttcaagatcrtctttttttttttcctttgtttttgataagatttaacagttatcatgttgccatatttacttcatctatttctatgggaagactgaagtattttaaaggaattaaaaatatggcatttcagccctaaatactaaatactaaataaatgcatatgatattgtattgtgtataaattagatattattcttatcttctagaagataatgtcaagagcagtgcgttttagtgttttttaagtaagagaacttgtttttatttgattgtgaacttatattccttttatgcaattaaagcaactttatgatttagagtctgaaataaagataaaggtctgaaatatattttggggatagactggtttttgtrggtctgctttgttgtgatgtcttgctaaaacatatgataaacttggaattaaggaaaaatgagaattagcaaaataaagaaatttagtatttctttctggaagttaatattcttcatatcatttttattagaagttcaagcaaatattcacctcaaagtggtgaccaggaaaattagtaaagatgctgctcagtttattcatccacattatttttggccaaacttgttacctgtatacttagaatgagggaatgaatatagcatctgttggaaattaaaactttaacctaggtctaggcaaatgaacataagctaagtttactgcctgctttcccaggacttggagaaacacatcttttctagtcagaaacaccagtgggtatagctcacttctggtagcatataaatgagctttcttaaagcacagggttgttgcttgtataactctatcatctgttttatttaggaacttttgggaaaatcataaatctaggatagttttttttttactaagaggtgatgagtttaaagtcaagatgtgtaatcagctaatctgtgcttgatactctctttcagcaaatgaacacatattttcttccttttccactagtgagcaatccctgtggtaccaacaatggtggctgttctcatctctgcctcatcaagccaggaggaaaagggttcacttgcgagtgtccagatgacttccgcacccttcarctgagtggcagcacctactgcatgcccatgtgctccagcacccagttcctgtgcgctaacaatgaaaagtaaggctctctttcccctctcctcagtgcctctctagcccgtggacagacattgaccttcaaggctccaagggatgggagttttctagtgagacaagattttggttaattaacttggttcatgtggaacacagcaagactctcagcctccaacttcagataatattttccatgaatagaaggagcttgctaaccaaactgttatgcctatatatgcaaactttcatagaaaggaagcaaaccatatatttctcatttctaattgtcttaagtattggagccagagtgtatataagtacatactgaaaaattgtccctagaagtaatagaatttcactgtcttttccatgtctatgccggcctagctccttagctgcctatgctaggggatccagggttacacattcaaatccatttttgatcatttgtgtttgctatgaaacatggccacagattattttcttaacaatgtccacaggcccattgataactaggggacctgagttagagagtggcatggagagaggcattaatgcagatcatagcatctaagatgcagaggtagacgattgtagtgattaaataagatatctgagattaagaatctagcatacatttatcgtgagaaagaccctcaacagtttttattgccctccaacttcccaaacaatacttttatatcaccctggcagacaatctcaaccaatcactgctcctagaacacagctcaaaacacccactctttatttgtttattgttttttttttgtggaggaaatttattcatcatattaagagcacattttcagtttgtatttggatcttaagaaacctgttctatcttgccaagttatgttttctctgaaaatacaccattgtaactgagatttaattgatcctcttctagggccacgagagagctcatgcatgtcatttcttggaattcagtgttgacttcttctctccagataactgttgcccctggtgctttgctaaagaagtgctgtatgttctctgtgcaggtgcattcctatctggtggaaatgtgatggacagaaagactgctcagatggctctgatgaactggccctttgcccgcagcgcttctgccgactgggacagttccagtgcagtgacggcaactgcaccagcccgcagactttatgcaatgctcaccaaaattgccctgatgggtctgatgaagaccgtcttctttgtggtgtgttgagtcgctttatgcctctttttccgacttctatgttgattgtatacgatcatgattctgtgggtatttcctgaatatcatgaactaaaaaccagttcaaagtcctagaaggaaactcaggctccatcctttttctatttttatgaagtttttttttttttttttttagaaatcttaaggtttttacaaggcaaatggttgaagtagacaataagttgtctctactggtggctcttcaccatgtgctgggcattgaatcccctttgagagctaacattgaggaggaaacgagaggtttccacccccatttttaacagggactctcagttgtcatatttatttatgtttccatttaaaaggcaaaaaaaaaaaaaaaagactgagcacagtggctcatgcctgtaatcccaacagtttgggaggctgaggcaggtcgatcgcttgagcccaggagtccaacaccagcctaggcaacatggcaaaagcctgtctctacaaaaaatacaaaaaattagcctggcatggtggcatgtgcctgtaatcccagctacttgggaggctgcagtagaaaaatagcttgatcctggaggttgaggctgcagtgagccgagatcgtgccactgcactcacttggtctcaagaaaataaataaataatcaaataggcacaaaataaaattcccccaaactaaaaacaacacatcaataacagtaacaaacacaaagtttgaagactattttccagtaggagaatagggacagaggaaggtatgcttaacakgtcagggtgttcagttcttatctcttaagtctgtatgcaataaagagatatttaagaatttgggagacagtaatagtcaaaagaagaagtgctccrtgtagtagtactgactgataagtacattaggaaataagtcctctaaaaagaaatcatgatcctgctatccaggattcactgatgtcaattaggagctttcattcttgatgccttccaagctgataaccaaatgtccctgctctcagagaatcaccactgtgactccaatgaatggcagtgcgccaacaaacgttgcatcccagaatcctggcagtgtgacacatttaacgactgtgaggataactcagatgaagacagttcccactgtgccagcaggacctgccggccgggccagtttcggtgtgctaatggccgctgcatcccgcaggcctggaagtgtgatgtggataatgattgtggagaccactcggatgagcccattgaagaatgcagtaagttcctgtgggaggaccaaggcatgaccagagcagggagacacgaggaaacttccatggggactgagagaggacatggagctttctttttcagctgatgggatgctcccccttggcactccctgcaaactctggcactgcaaggcagagtatagctgtgtggcttgcaggtggaaccagactctgtttctgaagtggctaatacctccttttgatacatagaatgtctaaccaaccagaatatgataccaagaacttatattttatatatctactgctttctcacttgagccacagagaaatgttatgaggtagggaaggtgggtgtgaaccaattccattttacagatgaggaaactgaggttcacattaagtggatggttacattactgtttagtgtcagacctaacacttcaacccaggttttttacttcaaaccctgtccttccccaaccccacccacaaagttatactgtaaaacaaatgagtggtgctgacatattgagaaaacttaggactatttttctgctcatggtaaacagatcacatctaaaacagacacatatcgccagaggcggtttgcttggtaacatggtcattgttattcctcagtaccacaacctcaatgtgacaatggaaaggtgctttcttgtacyttcagttctgactttgatgcctcctcccttttcagtgagctctgcccatctctgtgacaacttcacagaattcagctgcaaaacaaattaccgctgcatcccaaagtgggccrtgtgcaatggtgtagatgactgcagggacaacagtgatgagcaaggctgtggtaggaggggccacaggggagtggagggagggacaagaaagtgcacatgtcaagtgccatttattagatgagagatgagagtgtatttcccatgtcatcttttctttgtttacctctgtaaaaaaatggttgattcttctaataacatgttacatttttgtagcattttgcagggttaccaggggtatttaatttgtagcactttaagtcatgctgtcattgaggaagacgttattaagatgttagaaacttgtgtaatttcttccaaatgtagaatccttattcatacttgacaagtttaaattgtttctctaattttataaattggttgaaattggtggaaaggggttagagaaaagacttcgtatctatctctaaaaaggatatttccaaattaggatatttcttatttggggattttcatattctgaatgtctctctgattttccctgttatctattggacatctgtagtctctctggtaacatgggaaagccagataaattaatggaatttgtcaagattagtcatagtctaacttgaaaccaaagcatctggagtatgtgtgttgggtttagttggaagagaagtaaggaagatactaaattcttttaagaacactgagtccaattgactgaagataatatgatcaaaatatttatttattatggcatcattttagcctcccataccaggcctttgttgcaaattacaaaccagataccatttcattctttgcatggtttctaccaatgggaatggatcgagtttcaagtggtaggataggctcagggtagctaaaagagggaatgttgaccatgaatgttgctggcattcctctctttgggagcttcaagagtgagctaatacaattctcagactgtctcacaaggaagccartactactttgtgcatttctctgccaatggtttatgaagtctttgcaatgactgctttgcagaggagaggacatgccatcctgtgggggatttccgctgtaaaaatcaccactgcatccctcttcgttggcagtgtgatgggcaaaatgactgtggagataactcagatgaggaaaactgtggtgagtgttcacagtcctatggtccttatataccaccagagctgtgatgtttgctttttgtccataattcaactgtctatgtcattgatcctcaatgggtaggatgatatcaagctgtctgatctctttctttctgctggtcagtacatttctactttctcttccactaaagacataagcatctccttctgagatgtttcaaatcaagcttttggaggaaggtatttactgaagaatatcttttatgtgttgaatttatttacatccaacttttttttccaaaagaagttgaggtgacttatgataaaggaaaaatgtaataagataaatagaatagaaatagaaaaccaggaccagagaagtagagggaggaagggtgctaacccagagacactgcttcttaagctctttccccaaaatggccttcataggagaggagagagaacttgtgtttgcattattacccttcctagaatagttgactattttaggagggctaayagttaattaacaggacaggttttagtttctctctcccagtcgaaggtattgactacaaggcattggatagggaggttgaggaaaggaagccaagaggctgagatcatatcaaattagatggtcagaacacactcaatgtgtgttctgaaaacaagcttaatgaagccctgcccagagtgtatatcactgacccatgatatgcgtcaatttctaattgactaatgaaacacattctaactttgtttaccttttggaagaaaaaagtgatcaccacttgcgataagcaatgagagatttaggaagctgactacacctgcaaatatcagttagctaaaaacttatacaaaagggtaatccaattggcattttgtcttttattaataaaagtcaatgttgaatcctataagaggttatctagagtttcacgaaatagaaaaaattaagataaaatcaagctgggcatggtggaacacacctgcagtcccagctacgcaggagcctgagcagggaggattactttagaccaggagttcaaagtcagcctgggcaatgttgaaagatcctgtttcaaaaaaaaaaaaaaaaaaaaaaacagagagagagagcaagagagaaagagagatcagatcacctttggacaaacttcttaataaaggccattctttacagactcaaaattaaggtgaaaggtctagttttggagggtgaatgatttgcccaagcacacctctggggcttgggacacaggagggtgctgggcacccagggcactatggtcagctcacaagatgtctcctgtatgtgattcctggtgcacactcatggccaggtgcctttcctttccagctccccgggagtgcacagagagcgagtttcgatgtgtcaatcagcagtgcattccctcgcgatggatctgtgaccattacaacgactgtggggacaactcagatgaacgggactgtggtaactgtcatttgagaagctyaccatagaattttgtactgtgacagtgtaggggcttcaaattagtgtttataaggcttttagaggaaaattatttttgtatatgtgtaatatgtaaaccttagcataacacagtatcttytgctctgtattttctatgcattattcttaactcatagcagtctagattagtcataattgaggaaaatagcaaggaattttaaacatttaattttaatatcaacacttcttaggagcagattttaatctgcgttagccttgtaaacaaagacattgatcttgctactattccacggaaagtcaccctaaggaatatgcatgtgctcctatgactctcttgtgtagagatcagatcattgacagagtaatcctaaacccaaagtaatttttatagctctttactgatttggtgttgggtcttaggaaaattagaaaacattgaarattggggaattccgatttctgaggaaaagcttaagagctggagattatttaatattagggagctaggtacttccatctctgtatgttgagtggggaaagtgtgagttttgagaatgtattaatttgctaaccacaagttgtgggtttgctgtgagccagtcacagggtgtagataggaatgtgatggagtaaccactatactccaggtacctaatatctgtctgaaaatgacaaggccttctyggaatgacaatcttttctcttcagagatgaggacctgccatcctgaatattttcagtgtacaagtggacattgtgtacacagtgaactgaaatgcgatggatccgctgactgtttggatgcgtctgatgaagctgattgtcgtaagtccctagacacatatgtagtactgcttacctgagagcatggatatgatagtttagacatcagtccgctgccgcttcttagattaaaaggccataagtattgtctgttcagcatgcactgataatgatcagttcacctgagttctaagtcatcataatcatacatttcacaatggccgttcaagtgtacttccttgctattttaaatggagaatatattaagtaatctgtgctaacaaagtatttatatattatcagctactatacaaatcattaattagataaaaaacatttcaggtaaaaaaatattcaagcaacgaatacattagtataaagaacttgggttgggtattcgaacatattgaatttatagcattaaaatttttctcagtcacacgatggagtataaaaatgattaaaacttgaagggggccagcccctccacacctgtaggtatttctcctcaggtgggatgagagactgagaagactgagagagatcaaaatggagtttcttatgtcttccttttctacatagacacagtaactgtctgatctttcttttccctacaaaaactggaaagccaacatgattactcagatttgagtctttatggatcacttgaatcaatgcaaactgtttatacatcattattgctgatccatcaacaataaccatcatccatgataaycatccatgatggttatcgttgatgatgtggttgccaaagagactttataaatgtatgtgggtaaaaccagtcttgacatttgcctgtagagattaagtccagtgctgtccatgccatggatgattcatgccattggaaactgactgggctctgacaactgcccttaagacatagtccrttcaactttcagacaggtcaaggccactatacatcttgatgaataaagaagagcaggctataatggcaagagccaaaggagaaatagcaggaagcttccccaaagtagtcaatttgtataataatttgaatatgtttttttcccccatggcagccacacgctttcctgatggtgcatactgccaggctactatgttcgaatgcaaaaaccatgtttgtatcccgccatattggaaatgtgatggcgatgatgactgyggcgatggttcagatgaagaacttcacctgtgctgtaagagggagagaaacggagtgaatgggagtggtgttgtctgtcaaatctcattgkttcttacgtgtagcatgtgagcctggagagcagttgtacaattgtttaggaatggacacaggatcagcgttggtgttatttcactgggtcttccagcttcagttctctctgtaacctgagaaagttgggaaaacctccatgtttttaaatgtattatggccttagaaaacaatgtctttaagggaaatgttgcttgaaaacctagtatgcataaataaaggcaggtctgttgtggttgaagtctgaggaagggtagggaggaggctgtacctctcctgctgtatcctactttgggtgcccctgaagtaccctctccaaacccctagagcttcctggagcacctttagaaaatgctaagactttcttaatctttacagtcacttccttttaacatggtaattcaaggccatctaattccctcttgctgaatgatgcatatatatatatatatatatatatatatatatattttaaaccctgcttgtttgtgagtctcaattcaggtacatgtcagtagcagaggaggaggggtatttcaaaatcacatgccctggcctcaccctaggcttagacctgatggagcagaatctccaagaatgaagcctgcacatacgtatttttaaaaggcttcttagccttttagtttagtcccctggttgagaactactgattttaatgaagtgaacgtaaatagagtttgttgcagtcatwttgctacatgctttgagtcattggaggaactctagggtaatagttctcaaaagtgtcttacctggactaggaatgtcagtgccacttgggaatatgttagaaatgcaaattcatgggatgcaccctatccaaatagaaattaaaaatcaagaccaaaagaagtagaggaaggaaaggcattaactcaaagaccctgctttttgagctctttccccaaagtggccttaattttgtgggaaaattaagggcccagcaatctatacattaacaggcccctcaaatgattctgatgcaaactaaagtgtcaggattttgtgtaagtaaaagcccttaacctaggagacaagacctggagaagcactcctgttggaagttcacgttgcatcttccatcccctttcccagcttcatcactactcatttttagcccagagatttgacttgtgaagatgatatatcttagtattttgtttctcctcagaaaactttaattagtgttcattatatttcacagttgcatcccaacatttttctttacttgttaggaactagccttgttttgctttgaacttcatgaatcttgagacacatcttagacatgtttaactttcaaagaagtccttaggaaatctcttctctccataaggtaaaatgcccatagctagtaaaaataaactttggagagtcagagacacagctacattaaaaggtttccaatactgttttataatattgaacttgcctttcacagcaaataattattgcaatagttctattaacaatacttccaagaatcagcccttagatctgaccctttcccctcaaccaatcttattataagtctctcctcttgatccctgtgtgtgataccaaggcggaaggaaaatcagacagcccaaatcctccatgtgaaagacagaccacatgtgaagaccacatgtatgttgagttcactgcatttgtggtacacgcatagtgaaccatgttccctgtaccaaacaagtaggggacctggggactacccttgagttcctcacatctgtacaggcagcagctagaggtctcactctggacagcaagtgtgtcagggtttgattgtgagatatcgattttaaatgtaagaggtgagggaattcaggaaggaaaatccaacacaatttaaagcttcaataaaagactcatgcggtagagactctatgacaactgccatcaggaggatcaaacaaatggcttcctggctgttaggataagagtccatgtactgccagtctgtccagcctcacagccaccattgtgctccacgatccatgctccagccaccgaggcctttattcaggtccagagacctgccatcctcctctctgactcagaatctatgggaagtttcttccaagccttcctctccctaacttaagtcagatcaccccagtagatgtttcatagttgtaattgaatggttaatttgaaaagcctgtttctctactagaatgaaagttccatgaggacaaggactgtgtctttcttgtttcccatcatatctactgcctagcacagtgccttggtgtgtactatacatgtaaggtgtatctgctgattgattaatcaaatgagtaaatgagtgcatgaatgaagcaagcctggtgctgacactggagtattttagatattgacacttagattctactgttaacttgtaatttcatttttctatctttcctttcagtggatgttccctgtaattcaccaaaccgtttccggtgtgacaacaatcgctgcatttatagtcatgaggtgtgcaatggtgtggatgactgtggagatggaactgatgagacagaggagcactgtaagcaaaagtcaaaagggagaaggaaaaaggaaggaccccaagtggtctgcagtttggaaaatgtgcctctgggatttcagtttgttctatagagttgtgcccatgactgcagatctctgctgacataattgtttacaagrccatgcaaacacatgcattgcttacatgtaaccctgcctgtttcttcctgtctcatttgagcatgatgctggcaaatccattaatttttcagtctttgtttgaacatttaataagccttcccctcctcttttctcataagaaactgagaacaaacactaaatactgattgagccacacctcgcaaattaatagtttattttttcaaatatgagatttgatcatccttcagccttcaggagttgctaattgctaatctaggcaggtgcccagctgcagagatcatgtgaagcaaggcagcactggtgttaacagagcttatctaatatccttgttgaaaatgaaagttcatttcccagaagagaaaagtgatagattagtttaagatagaagttccaaactggctgcatttaacaatcgaggcattgaaatagctgtactttttctgcactttcaaaatgttttaaaatctatccattgaaggggaaagttgaccaattttctgggcaatttaatttgcctagaaaatgtcagtgaggaaaatcatttccccgactccaattatttttttccccaaaaagacattatctgggaaaattaagataaatgcctgatttctccactttctatttcttgtattgatgtggtcttagaacgctttgccacagaatgcttacttccagcccccatcccagaggagactgtcagggaggactttgacactaccacaaccttcaagttcgtattcctgttatcattattactggcagagatagcattaatacattatagcattaatatgtttatttgaggcatagcgcaaaagcatgaaagcccagaaataaaatatttttaaagaatttgagcagatttcccccttccccaaaatctctttccatttcccctgctaaaaatgccattttttaaaaaatggagcaagacatttgtagcacatggtcaaatcccagagtggaaaaaagaatccataaacttctattcttttcaaggaacagggttttagtctgggagaccactaccagtcaccacaggaagcaacctgcaacatttcaatggcttaaaatggcaaaggttcatttcttgctcatgtaaagtttaatgacagtcaagcaaccctcctccatcccataattatgccatcagggacacattcaaggttgccaaggcaggagaagatcaacatggtggaggcacacagcttcttaacttcctgagcctggaaatgacagacatcctcttgctcatagtccattggtcagaaccagtcacgtggccctgctctaactgtaagggagactggaaaatgcaagaatatgcattctcatacaatttacccttgtgtcactaaatactcctttatgattttcttctcacacacagaacacccttaaccccttcccaagggacatagctcatagtccattcmgaaactgaaatccaggacctctgggtaatgggcagtagccactcaatcagttccagatgtggttcctcttggttgrgagacccataaactaataaacaatcagtgccttctgygcctgataggtattggcggaacaggggcaacacaatagaaataaacactcccattggaaagaaagaattggagactcatggccatcaccaatgtatagcaattctgaagtcccactgggctgggatgacacatgttagcacaggacagtcctgattcatgtctgctgccccagtggaattatgaatagcaccaccttcactttcaaaagcacactggcttggaaaggagagtaaattacatggccactctgggcagacattgtaaaggtcccttctttggggagtggagggtatttattgattagctcatgcctctgctctgggaggagctcctgtgttaaaatgtctctcactgtttctgactctaccctttgagagttttttcttgtctattttcctctgcaaatgaagagggaaagggaaatatgctaccattagggccagcacggcagctttctcaccccacttcttgcttatagaaggtcgggagcccaggagttgttttttgtttttttttccaagtctcaaacagtcatagtattttggtttatttggttatatctttctctcagaaacataccaggcatttgatctgtttgcttctagcctgttctaaaagttagtaacctgacctagtgctcttttggagacatagttctcaaatctgcttttttctttgctttctttccttcatagagttctgtctgaacttattgtcacttacatccaatccatgtagaaaaatagatgggcagtcattttatccaatgaggaggttttattgggccttcgtgtctcacagccttttaaacttcagacttttactgtttgggatgtagatacaggtggcttttctcacacagcaaatttctgggctttattttatttctgcttgtaaggtaaccagttcttcccttaggttctctctttcttatactatcttgccaaactcaggaatggcaatcaatgcacattactaacattctatcttctaacctcgctccatgattgacaggttcagtaagcatgtgatctgccttccagtttttccgaggtgatagctttatcaaatgctttgactttgcataacatgatctccacctttcctgcctccactatcagtgtccttgttgcttgcctcctgactgttaatccaatgccaaatattttatgtttttattatggcagtactctacttccctcatcactctatgttattcggagtaattaatactagctgttgcaaccagcatatcctgaaatctcaggggtgtaacataatgaagccttattgagcactcataaaggccaacgctggtttcacagccctcctgcatcttgcagctgtgctgcctggaacacatggcttccaaggttgctgcagcagcacaggagacacggaggaggcacgtgtgcttttcattgcttcagcccagtagtgacacrtggcacctccaactgacagtacgttggctagaactggtcacatggtcctaacccagctgcaagggagactgggaaatgtagggaagcactygtttatttggtaagcacaaactgtctctgtcaaagaaggaagtatcttgcttcataaaagaaaaagttttgattttaacttgtttttacatkgcaggtagaaaaccgacccctaaaccttgtacagaatatgaatataagtgtggcaatgggcattgcattccacatgacaatgtgtgtgatgatgccgatgactgtggtgactggtccgatgaactgggttgcagtaagtaaacacttgtttttatagttcattgtagtaactcaggtttacctaattaaaacatgcaataacataatgtagacactgaccacattttctccttaatgtactttttgcttgaattccagtcaagcccatagctagctgtgactgagtgcttatcctagaccagacattgtgtcaaacattctacatgcctggtagcaatcttatgagttagatgttattatctctttcttatgtacaaatgagcaacgaacttagaggttaaacgaattggccaggtcttactgtcattaagaggttgactcaggatttgaactctggtctgtttcactgcagagcamgtcctcttcccagtccactgggtgcctcttagcactttaaggctacatattttgtttattagtctgcacattatggtgggaggatgggggagggatagcattaggagaaatacctaatgtaaatgatgagttaatgggtgcagcaagccaacatggcacatgcatacatatgtaacaaacctgcacgttgtgcacatgtaccctggaacttaaagtatatacatgaaaaaaatcttaagccaaatgcagtatccttggtacctgaaaatccttctgagggtgtttgatcaagaagggaacgccacaggggacctgggaagggacatttatttttatttttaaagttgagggagtggctggatgcagtggctcatgcctgtaatcccaacactttgggaggccgaggcagacaaatctcttgagcccaggagttcaggaacagcctgggcagcatggcgaaactccgtcttaacaaaatacacaaaaatttgctgggtgtagtggtgtgcacctctagtcccagatactcgagaggatgaggtggaaggatggcttgagtgcaggtaggggctgcagtgagctgtgattgtgccactgtactccagcctgggcaataaagcaagaccttgtctcaaaacaaacaaacaaacaaacaatcaaacaaaaaagaaagtagagggagcactttgtgtaggaaaaggatgatgaacataaccaaggaacaattctagctcaatattttgatggaaatgttaaaatgacatgttactaagttacacctttgtagtccatttatgactcataaagtgctttcacatacattatttaatgtgttactcaagttagccccrttgagttgctkttattgtctatgtaataaagctcagagagcttaagtaacttccttgtggtcacacagaatgtcagaggcagaattggagcagtcatgtaagtccaggttaggagggctggcctctggatccctgccactagctgtgccactttgggcacatactgacctctccagtctttggtttcctcacaggaaaaaggaggcccttctccaaactctaggagcctgtgacttagtcatcctagtgagctccatgtgctttcaacttcttgggctctaattgactttttcctgaggcatccaaaggattttctatcaatttttctcctgcgtgagttacgaagaggtatgaataaccagccatattgagttggcttgccatttatttcacatacgttttctgtgggacttggagttattgacagaatgaagtgacttgataaaatattttaaaagcctgaacatgatagaatttgcaaaactgaatggcaggtttgggttctgactcccagagactgataggtggcttaaaatagactacagtactttcttttcaaatggcatttaattagtagcaggtttttgtttttttttttaaggaaataagtagcacaaacaattcgggtatggaagcagcttctcttttcagatattaagtgaatatgtgatatggaattcagtcttatttctctgggctaataatttgaggcatagaattcttttttaatatactagttcttgggtgctgttaatttatttgcctttgtcttttttctccttcctcctcttctccttcttcttcttccttctcctcctcctccttcatcttcttcttctccaaaagcatcactgaagtgtttaagacacattgttcgattttttaaaattgaaggtatacaacatgacattttgatrtacttatatatagtgatgtgttataatcaagcaaattaacatatccgttatctcacatagttatctttaaaaaaattatttttgtggtaagagcacctaaagtctactgtcttggcaaattttygggaatgaaaatacattagcattttttctagcaccattcaggtataaaggaaagaaattaacctcaggttgcaaatattatttatgtgatcataaagatagattgacttgctgtttctctggtagttcttattccttcttcataaaatggaaagtagggtatttcttttataaatagagtgccatatgtttgggtttggggaaatcagttatacgggttaaaatggtgatcattttcaaatgaaaacaatgataagaaagccctcacattttaggaagaatcctacagtgtcgtgtggtttctgctcttgttaaggactcttgcttcacaaaagggtgactcatttagtggatcacttggtccagaaattcttgactcctgggacccctaatccctttatagatttcagagctaggaggaaattacaaagtctagtgatgcatgtgagacccatggaggttatgtgactggctcaatgatatccaagttaataaacataggtcagattcatttagcaatgtagaggggatatcactgctaatctcacagaaattcaaaggacagtaaggaaatactatgacaaattttatggcaataaatcaaacaacttacgtgaagtgaataaattcttagaaagacacaaaactctgaaaatggctcatgaaaaaaatagaaaatctaaatagatgttttaacaatgtacagttgttaagagctcctataataaaggctaggatctttattataagactttcatgcatacagctttgaagtctgcactccaagggcagcattccattgaatttcattgtactttattttggttatttttctttttgaaacccagtgttcttaatgtactcagaccacatatagtgatatgatcatttaccctaaaggactctgagagtgattaagttcacctcattgcatactatggaaaacagatagatataaatctattttgatttgaaagaattaaatcaggagataccacagtctctttggctaaaatactcagaagcctatgaccaggagactttttatttgagaggtagatgaagcttaaatccttaatggagataaccactgcctctctttcccccattatcactcactatctatgttcatcttcgccagtttttctgtaagacctaggtttggggatagatggaggataaaagaagcaaactgataagaatgacaaggatgaaagccagatggcttggatagatattggtagagacaagatcttggggcaatgatgaacaatgaagtgttagggtaaagtgtgagctgttaaaagtctgtcttggaacatctggatcagaataacagggatcatttatatgggctctacaaaaataaactgtgtttttttttttttttttactgtgaaagttcaataaaaatcaaaagtaaaaatcatttgaatcccatcactaaaagagaactaacctttaaagtttggtgtacttttgctatcttttttttgcatatgtatatgtaagaaatatttcttagtattttgaaaaattaagaaatattctatactaaatggagtttttcagtctttttttcaatttattataggtatttcccatgtcaaagtatcatttgaaactataaattttaataatcacatagcaattcatcatgtagataatcataacttattgcttctaagatgtatttttttatattttaacatctttgaaaccaagatatatatcttacaattaataacatgtcagcgtaagttccagacatattcaattttagtgttacataaagtaatggtgcatcattaatgtcttagtttttttatactataacataatttattccctatcactgaacatacattcaagttgtttacaaatgttcttattgtaaatatttttataatccttaaacgtaaattatactgcatattccttctcaagggaaaattcattaacatggaataactgggtaaaagagtatgaatatttttaaagtccttggtgcatacatacatagtacaaaatttctttccttgtgtactaatttatggctctaagagcagttgtatgatttagaactctatgtattttactgcamcctggtcaacacttgatatacatgtatatatttgtgtgtgtgtgtgtgtgtgtgtgtgtgtgtgtgtgtgtatataatcaattggtcaatgttagggaaattatagtcttcttaaaattttataatttcctcctatttgtaactttgttctaacctatctgtatccatgtcttttattwatttatttatttatttatttatttatttatttatttatttctatctgttatctatctatcgatctatcatctatctctctatctatctattgatctatctatttgcaataggattaaagatagtagagcaggtggtaatagctgtagagtgtcaggcttcatagttgtgcagtccagaattggatgctctgaggataagcctaggagtgctgcatataatgtgaaaattgcctcamagttttagcattatatgcatttatctaaatggtattcagatcacgatcagaaataggaatcctgactcccccagtgccctctgtcctctccaaggcttatggaaaggggttatctcaagatgtcctatagttggttacgagtaggtgcttcttttgatacaccacttgactgttatttgtggctgatctggtttgtaatgctgggattttgtttttcagataaaggaaaagaaagaacatgtgctgaaaatatatgcgagcaaaattgtacccaattaaatgaaggaggatytatctgctcctgtacagctgggttcgaaaccaatgtttttgacagaacctcctgtctaggtagagtatattttttccaattcctgtttaggtgaactttacatctaaggttctccacccactcccctttgttaaataaatcactatttaattcccttaatggtaccatactcatggtttcatggttctaggtcattaaactactcaagaattgctttcccccacctgcatgcatgctatctgaccagtgcctacctgagtgcttgtcagatactgtgtgctcagtagagtctgtggaattgatatgaatgatgaaggccttggtgatgatggctgcttattgcaccagtgtgtgaaatcaaagttaatttaaaaaacaaactaggcttactttcttcattgtaagtcaaacaaccaacacgtatttattatacacctacttacgccagacatagatgagttgtaaggtatggagtcagaaggtagcttatcaagatggtgagtgatgagcatgattttaggtgccttttagtatttgaatttactgtttctaattcatgatatgtcatagtcagaagattgtaagagttccttttggacttgaagcttaagaactcaattgaaaaactaaatcaatgactcctgttcctgaagctggttagcagaagtgaagagacaccgaacaatacaacacaacatatgccttctgaaagggaaaatgtgctctgctattgcagagtcatagagtttaaatcctgtctccattgcttatcagctttgggactgtgggcttaatcgtccatacctcttaaagtcttttggcaagactaaacgaggaaaatatttgaaaagcatgtgaaacagtatctgaaacttagtgtttcacaaatgtttgtatcattgcttattttcatctgtacccttctcggtcctcattgctggtgaatatgggtttaaacagaagcaagatctctaaggaatggatgggaacagatgttgcgtatttggttttattttgcctacagatatcaatgaatgtgaacaatttgggacttgtccccagcactgcagaaataccaaaggaagttatgagtgtgtctgtgctgatggcttcacgtctatgagtgaccgccctggaaaacgatgtgcagctgagggtatgatgggttcatgttgggattaattgacttttggggaaataaatactgctaagtacactatacgatgaaagaaacttcagcttctcatagtttttcttttctttctttttttttaaactcgccagctgcttctcttccaacacctctttagtcgctccttctctctcctcccctgccagcttaaaacaatagctacatcccccaacaaatatgtagcaattaaaacaagagccaggtgttacttattataatggatttagcctcttgtctaccttgataaaaacttcaaaaagtggacaagatgtcatctttcttaaggctcaaacaayaacaaaagcttgcctatgggatggtcatcaataaaaggaaggtaacaaggccctctagctcccactccactgagaataagatttgaggcccagtagtccaagagggctcgtgaattggggcaaatcaaggacatatcccttttgtattgttcatggactactgatcacaggcagaaaggagtctggcacagtcataacttcaatcatgagttttacgttttaggttgatgccagtgtctgacaatcgggcctaataaaacagagaaagaatgtaagtcagatgtattatactccaaattccagaggcctgatctaaatcatcatatcctagttaagaggcatgggtctttattttgaatttgaagtttgtactagagtttaaggaacttgataagaaaatagcactttattttgtaaattaagagtaaatggccaaaatggctgttcaatttcttcatacaaattgagcttttaaagcatacatttgactagcatacttacatattttaccctcaaaacactgttgacagtgaatgaaaactagagtgaaagcatttgaacagttggtctggtaattaagcagcaattttttaaatgtttaaatcctttaactaaggacatgactgaaacaaattggaatattcatataaaacataatgtcaagatagaggaaatatataaaatgaacttttaaaagttacttaaattggattcagttgacattatgcaagtaaattaaacttaacaaattctagacagtgcatcttgggatgagtcaccattaagtagctgctttaggttaaaaaaattaaatcaaggacaagctaggtttattttgtcattagctaggagctaaattgggtcatagagctgattacctgctaaaaagaatcataaaatctgtcaggaaacagtaaggaatgagacttttctggtaaacttttagtaagactataaaagtatttcttctgtgagatagaatgtctgcagtctwgtctgttttgatgtcagtaaataaaaacaattcagtgaaaatgaggactgtacgtagggttctcagtctagctttgttccatactaccactgagtacaaagaataaagaactgataatgtccctaagagacatattagctttccacttgaagtggagaatgtcaagtcacggattttgtaacccagttggagagtcagctttattgattaacagagatagtcagattcctataaaaactcatgttctttaaaaaggggacaggtacatactgtgcattttatatcctactttatataggaaagtataattcaaacagataaagtagccctttgtttgtttacaggtagctctcctttgttgctactgcctgacaatgtccgaattcgaaaatataatctctcatctgagaggttctcagagtatcttcaagatgaggaatatatccaagctgttgattatgattgggatcccraggacataggcctcagtgagtataaactttggcatctttcattgatattaagtgactttatagaattttaaggtgttgacttttaaggaatttattgtttaatgagtgaattttgttgcattagtggaggaggaaactcttccaatccagcatgctcctgatgccttagcgtggccttgaatcccagccaagctttcctgatttctttctaaaactcctccgatcactggggtttatcctttctggaccatctcacatcttcttgtattttgaaatttccttgtccttgatactgcagatcttgttccttcctaccattgtacaccttgaaaatttctactcagacctcaaagacccagtttaatgtcaccacctctgtgacaacttctatcactccttctggcagagttctwtgattgctcaccatgaatctatgtcattttatggcacatgttactctaagttatatagctagttgaccacataatatctttctatcctctagacatctgctttttggggacaaagactgaatctaatttatctctaaatgcctagcagctgacccaacatctagtacactctatgtggtaggtgatcaaaaaatttagttgaatgaaggaaaaagatgaataatgcttattgttgaatctctcatggctctatctggtgttgggggagatgacagtagggtaggagtcagaaaacttgtcttctgtgcctgtaaacttatcttttatgccagtctcccttatctactagctttgtgatcctaaataattgtaacgattctctgaatctcaattttttttctacaaaatcaaagtagtaatcttgttctgtctgcttacctctgagagttgtttggaagattgaatgagatagtagatatgaaaggctttgaaaactatcaataactataccaatgtaggatttattattggtgtattttcacacatattcatgcaatacaatacacttttcaagaatggtgcatacctaggaaagcagcaggtgtccagtgcatccctctacagtcacagtcttcctatgcttttaacatgcctgctgtccaccatccttctgtctgtatataaaataggacttctcgttgacatggcttctttattgcctctgatcttgagtatgctttcaaattctcaacagcctgccctggtttatctctatacattctgttttggaaactagaacttgatcctaataagagtaaataagcactttgttgaaatacgtttaaatgaatcacttttaaatagagatgactaaatctcactaagttctcagttgaagcatttgtagctcatagctcaagtttgataggttttaaagtttgattatactgatgtcattgaattattcatattataacaacagtgaggagggaggtagagatgtcaataaacgaacagtacttcacctgattagacccctgttcttcctttacttgatgctcttgacatgaaactgacctgtgtgtcttcctctgtaggtgttgtgtattacactgtgcgaggggagggctctaggtttggtgctatcaaacgtgcctacatccccaactttgaatccggccgcaataatcttgtgcaggaagttgacctgaaactgaaataygtaatgcagccagatggaatagcagtggactgggttggaaggtaaatttgccatacattccccccttacctgttctgttttcctggttagagttctctactgcactccatgggccatgagtgagtctgggcctggatatgagtacactcagccatgggtgcagctgggcagtggttgggcttgctgaagccccagcaactacctccacttaccccagcatgtcatggagacattatcatatcctgtattctttgtgggccatgaaaaaaattgggaaagcacccaggtcaatatctggatatagatattatatctaggatataatagtgaatattatatttactataagtgaatagcattcttgccaacagagttctggattccaaaagtaactttcagtatggcagcactgctcattttgtgaagaaatgggacagcctcacaattctcccagcaaagcagttgagatgaaactttttttctatggtagttatcttggggacgaacaatccacatcttgtgtttttagcaggcttctagttaaaacagattggaaatttgactaaagaagtctttggaattgagttaatagaggtgtcagtctcttctgttcttctagaccttctagtggcccagggaccagagccacacattttggatggtttttaagtagaacttaagtagggttatcatcaggtaggtgtgcgaggtacaaatggatgtggagaagttagtaagctcattcttcaaggaagaggtttgcactgacttacattggtgggaaaatgattccttgaaaatgaaccaataatgcaaacatgtttgagggggaaggttcaggagwcactactctcctggagaatggatagttattttcagtgtaaattctttttcaccttttaaaaaatgtggctggtgttcctggaagagcatctttgaagaagctaattgggtcccgctgtgyctgcaggctaacaggagactcattttagcattttcagtcaagaaacagggccttagagtactgttgctagagtcaggaactcaaaactccagacattaacactctcttctgaaaaccaaccagggaatggcagatctgtcttcttgtttgaagttttacctctktctcagccttaatgaataagagaattaagaaagtggtggaactttttctgcttgtaagagactgagacctgcagcctcagaagtggaaataaggcaggacagtcttgccgagtttgttattttaaaaggctgtttccactcatctttgagctgacaccaggttcctattgattctaacggggctctttcctgaggaggaaacagactcatgggcagtcagagttaaggcaccagccccaccgtgccttatgacttctacctagaagcccatgtctcataataatgccagtcagaggccagtctgactgctgtgtctatggtagttatcttggggacgagcaatccacatcttgtgtatttagcaggcttgtagttaaaacagattggaaatttgactttcctgtttagtctttggaattgagttaattccattgtggatcctgcgtgattcaggtgctttggctgttgggcaggagtcccctcaattccttactcttccaagtgtaacctgccaaacatgtccccttggctgtagttcycccaagagagggggactatggtctgatgatagktatctgagcagctgtctcaccagccaaacgaaatgctctcatcttcaaacctcttacccagtaatgattactctaggctttgcagttgtttaactttgtccctctgaattcaggcatatttactggtcagatgtcaagaataaacgcattgaggtggctaaacttgatggaaggtacagaaagtggctgatttccactgacctggaccaaccagctgctattgctgtgaatcccaaactagggtaagtacttggagaagtcttcaacatctagatatttctccctggattctcatcaaattccatgtttcttataatttttttttcctagtttaactgaaattgtccttcaagtttttgggagtagcgtctatgactgtttcaagaattataacatgcccttgagatcatatagaaccaaccatttctgatggggaaattcctttagaacacatctgagaatctttctagttacatggattccttgccaaatcagagctctgaactctaaagttctttgtggatataactgttttaagtgaaggtttcaacagaattgtttttcctttcatttggatgttttaaagtaactcattcattgaaatccagctagggatttggtcatatttcatttaaaaattaaacatttatatccaaaatatataaatatttaaaatgacacatgtataaatatatattatccatttgtakaaatattccaatttgcaatttatctataaatcatctcagtgtaaatgagaacaagttttgttatttttctctacatttcaagacatttatttgaataatcactaagctgaaatgacttggtatttacatattagcttagcttcagaatagtgacactttaaaaaagttttttgaatgaccccaaataattttcctacttgggcaggaccagtctagccctctgtagatatgccagtatttgtaggtagaaccctatgagctgttattactttaattctgttatatttcatatgttaaatcataccctcagaaactcagcaatgaaatatgaaaaatacttgactgatgagattaacctgtagtgaggacttgtcctcagcattagtcattgctgcttatatcttatctacacaatatattaggagcaaagagatgcagtgtgttctatggtgtgaatgatgtgactgtttccagtgtgccgtttaattttttcctctgtaactaatgtttaaattcatctgatattattatcatactctgatatccctccactgtttttttcatagaaattcttttttttttttaatttttttggagatggagtgttgctctgttkcccaggctggagtgcagtggcatgatctcrgctcactgcaacctctgtctccaagattcaagtgattctcctgcctcagcctcctggcagctgggattataggcacccaccaccacactgggctaatttttgtattttcagtagagacagggtttcaccatgttgggcagcctggtcttgaactcctgacctcaggtgatccatctgcctcgccctcccagtgtgccgggattacaggtgtgagccaccacacctggccagaaattcttattttagtctttgtaattcctttctctctggaatggctcagtgtagtcctgtgagggataggaagtaagaaaggagtgagaaagggtttcactgcctaaggcctgcagacccgacctacaacctcctcatttcatgatccatttgaaaggctcatcatccataagttttataagcataagcatatatgatgtgttgaaccttcttacagcttctgcggtataagatctgccagtgggtccaaaggatgatgaagatgataactactgataataccagcaacagcaatgagaagtgccaacatttattctattcttgctgtgtgccagctactctgctaagtgtcctacatatataaactcatttgaattgtacaaaggatctataaattagtcataggtttctatcccttatttacatagatgggtaaaataacaccatgctccttcagacagcaactgttgactataatataagatacaaagggagaattgtcatgaggacactgctgaaaaacactgtgatagttctcctaccttacaagggttcagggaagctctatggaraaagtakcactgaactgaatgttgaaggttgggatccactggtagtataaccagtgataaagtatgtgacatgtgaggtcaatgtgggtgagagtgagaagggccacttcccagagaaagtgggactgacatagaacctagatggatgtcttgggtactgataggcaaaggagccaggccggctgttcagaagcycaggcaatagcataaacgaagtcatggaggaaacaaaaatcattctgtgtaccttttgtgtgttttttccattccattccctacgttttgttttttttagttttgagtatttaatactttttaatttaaattaaattgaattaattaatttacttatatagacagggtcttgctctgtcacccagactggagtgcagtggcatgattatagctcactgcagccttgaactcctgggctcaagcagtcccctgcctcagccttctacttgcacaccaccatgcctggcttattatctttaagaaaacagcttatataattcacatatggtatgtatggtatgatacaacttacccatttaaagtgtacaattcactggcttttggtatatgcagagttgtgtatccatcatcataatcggttttaaagcattttttcatcaccctacaaagaaaccctgttcctctgagccaccattttyctgccctcagtacctgctaatctgctctctgtctctatagatttgcctattctggacatttcctacaaatggaatcctacagtatgtggttctttgtgactagcttctttcacatgtgtgtcctttttaatgaaaaccaaacaaggtggtatttaccagttgttgagactttaaaggcccctggctgcattttttccagagcccagtttgtctaaaatccacacattcgtcagtagaatttaaaacttggcctatgcctgatgactggtttagactacaggctgcaaagcagcggctggtgggccaaatatggyccataggacatatttggctgggacaacacagagctttaagatttttttttttttaacatagtgctgacatttaaaatttaagaaaagaaagaaaacctgtatttcttgctttggaaatcagaggagcggattacactgggtaggtctgccttcctgggcactgacaggagctcttacacagggtcttgctctccgcatcacttgatatttacaaccgggatctctcctcattcatcttacatacctgttcctctccaggtatttgaaatcatgcaatccctggtctaggtaattcaatgtgagatcatctttgcttacatagacccttgctctacaattaattattaattggatgcaaaagacatatttaaaaagagttgctgggtgtggtggctcactcctgtaatcccaacactttgggaggctgaagtggggggattgcttgagtccaggagttcaagaccagcctgggcagcactggtcaaaccacgtctctactaaaaacacaaaaaactagccaggcatggtggcacatgcctgtagtcctagctactcaggaggctgagatgagaggatcgcttgagcccaggagtgtagtgagctatgattatgtcgctgcattccagcctgggcaacagagtagctccatgaagatagaaatctttgtatgttttgttctctgatagatcccaaacacagaacagtgcctcttacacagtaggccttcaataatatttcttgaagagtgaacagctttcataatacagctttcataatgcattttaaagggtctgaatatccatccttcggccaatttctattaaggaggtgcagttttcaagaaggataaatcatatgtgctcttgygcccctatttttgctccccatcttctgtaaaatataaaactggtgtcactgagcacccaggtccctgagataaacagttggtttccctgtaggtaatgccctgtgctctgctgtagtggagaagtcttaycaggtgagatgctacagtgaagaaatcttctgttataggcttatgttctggactgactggggaaaggaacctaaamtcgagtctgcctggatgaatggagaggaccgcaacatcctggttttcgaggaccttggttggccaactggcctttctatcgattatttgaacaatgrccgaatctactggagtgacttcaaggaggacgttattgaaaccataaaatatgatgggactgataggagagtcattgcaaaggaaggttagaaattarttagaaagtaatatattaaattaataattaacatatttctaatgtctttgcctgttttctcaagaaggagccctgctcttaggaaatggcttatatagttttttagataccacccctccacccccaccaactcccacctgctgaattaaatgcagatgagttcattagcaataattaaatccttttcgtcctttttacacaactttaaaaaaaaatgcttctcagcagaagatattgaaataactgagtttcctgttaggttgccccagtagaggtggtttcatgtgtaccaatgttaattcatgtctaaccgcttctggacacattcattttcactttactagattgcccagtatgcacaactgtaaatatctaggagatgaacattttttgttgttgttgttcagactctgcagaattgcaatgacccagcacatatcacatttttcctatttggtcagatagatgtcttatgttcaaaagaaaacataaaatcttgccatttaaattgttttccaaaaatgcagtaaaatcagtaacttgaaagtgagctagggccctgtgattggtgtcgggtggtatacatcaatgtggtttaatttctatcttcttgacctcctaatgcagcacactttcacagtcccatgtagctaaagtcagcctgaatattcccagagcttcaaggcattgtatgagggaataattcaagcagaatgacatcagatctagaagtggcggtagggtgtagtgggtattttcttttcaataaccttctgttttgtttttcccctgtgggtaagcagcaatgaacccttacagcctggacatctttgaagaccagttatactggatatctaaggaaaagggagaagtatggaaacaaaataaatttgggcaaggaaagaaagagaaaacgctggtagtgaacccttggctcactcaagttcgaatctttcatcaactcagatacaataagtcaggtaatcaccaactttggtataagatgctcctcattacttggaaatcttatttcaaaataatggctatattgctggaagatggcagtagataacaacaagctaatctcttggtgcatgaaaggggtatatgtgtatgtacgtttgctgggggagaggaacgttttaaccattttmaccaaagaaagataaaattggwggtcaaatgaaattatgcaaaccatcagcaggtaagtaaaaatattagccctcatcattgtttggagtgatggatatgtacttctaggccacagaatccagcagacatcagtcccctgctaartgtgagttgggttaacaagtcacaaaatgggtttcataggcatcagaaatcttatccttcccattgcaaggctaggctagtcaggtcaacctgagatatgtaggtcttagtttaaaatggccagtcatgtgcattcctacccgctcccctctgtctcactttcccacttctgggccctgcttcctcaggttacctgtgcgctaatttatccttcagcagtgtgtggagcaagatgaaaggcaaagggaagtgaggaaaggaaatagccttttactaagttcttrtgtcaaattctctcttcagtgttaattcagccatctattacttcaattaccttataaagacctcccaaaccttataaagacattttattctcatctcaaataaagaaactgaggccgagacagatttagtaacttgtgtgcctaagtcacataacaaatgggtgagttttaatctcagaaatgaaataatttttaggttcaattctatccaacccaaaactcagcatcttgctgtattggcccagtgttcagtatgccaaagtcccaggttgaatgctatggatatgtggcctttgacaagttactcccttcctgtccccatatgtgagtcatgggtggagtcyggggttgtcttgagtctgctgatattttgagaccttgatcagccttgaaaaattgcaactcaaagctgagactcccatgagatgacaggggtggcaaatgccttttctagggcatggcttccttgttttggaagtatatcaccaaaacactccagaatactccagaccctaccaatagaatagcttttgtgtcctaagtgcccttgcggctctcacacttggcaattttaaaggtaggagaggaaggcacagtacacctggaaaggctatctcccctccctaccgcctctggaccctgaggagaaggcagaggaaagtctggaggctgcccctgaaggaaaagcatctccctccggcagctgatgctcagggaaggcggctcctttggaaagtgctggtggagtgggggtgggggtgggggtggggatggggagtacagccccagcccagcctgtttgaaccaagagttctgaaagttgagcatgcctcagaattatctggagagcttgttaaatatagattcgtgggccccatctgttgcacttctgatgcaatatgcctkaggtggcctaagaatttgcatttctagttctcctgtgacgttgatgctgctggttcagtgaccacattttgagaaccgctgctccagtcccttgctactcagagtgtgggccatgggccaggagtcttgggatccttatgggagctggctagaaatgcagtctctcaggcccaccccagaccttctgaatcagaatctgcattttagcaagattccccaggtgatkgatagcacattcaagtttgaaaatctccactctggagggccgacgaaatggtaatgagacagatattgatggaggcttttggaagatgtgttactaatttatagctatgctttgtctgtggttacatcttgaatgacagacaatcaggatcacagaatgttagtctgagaaggaatgtaaagattatccactccagtacaacccttggataaatcataatacatgctaaggtagaattaataaggctctagacttacctagggagcttttaatggtaatacttgaactctaccccagaccaattcaaatctgaatctctgtgaatgggcatcaataggtttttttgtttgtttgttttttgtttttgagacggaatcttgctctgtcgccctggctggagtgcagtggtgcaatctcggctcactgcaagctccgcctcctgggttcacaccattctcctgcctcagcctcctgagtacctgggactacaggtgcccgccaccacgcccagctaattttttttttgtatttttagtagagacgaggtttcactgtgttagccaggatggtctcgatctcctgacctcgtgatccgcccaaagcggcctcccaaagtgctgggattacaggtgtgagccaccgcgcctggcctggcatcaatagttttgaatagctcccaggtgattatgaggaaccattgctctaaattcccttttcttgcaattaaggtaactgaaacccagaagaaatgtctccttggagggttggggtggaaatcacatccagtatactttggatagaccatatgttatgatctgtccagttttgggtagtgacaaatcttggtayaatatgtggatctcactggtcttttgaaccatckcaagttgtttagcactgagtagattttgaggttaggcagtgaaccagatacccaccttccaaacctctcagggcagcagagaagataagtgatgccaatagaaaatgtgagtggtacagaaattggctggagggcccagagagggactatcccactgcagtgtggtggcagagatgatagtgtaaatgagggtgagtggccagctgacacrtggaygagaggtattgagaggatgcctaggctctgctgtcacctggcagagccacttccagttgctgggtattcaggttattcattctgtcaggacctaactgctgttctcacccgctttccagtgcccaacctttgcaaacagatctgcagccacctctgccttctgagacctggaggatacagctgtgcctgtccccaaggctccagctttatagaggggagcaccactgagtgtgatgcaggtaggagcactgcccaagcagctatgggggcctgggagcactcctctgctgccttcaggagtcagaagaatccctgtatgctgggtcctttgcagcagagtggggatggctggaaggagggttaagggatgtgggaggtatgaacagagttgagtgggacttagggggcaaacagaactgtgttccagtgactgctgagaattatttgctaagatctgcagaaatatagatccagtgtccctaaatctattgctgtgttgttttgtaaagacattttgaagagtgagtttttataagacctctacctcaagctggattcccattgccccagaatccactcaaccttaattgtagctcctcagggtagagaaccatgtycagttttgacaactgaaaaagggctaccttttgaaaagtgctttatattatcaggagacgaagaccagcatgaggaagctgtggtttaattctagtcccaaacgctgtgggtgatctattcttggcaagactttttttcaatgactcttttaaggagttaataagccggatgggggcgaataactagtgtccctaactagcatccggtgctggaaaagcctgtgaaaaagtcgtcctgcaattcactagcggcccattttatggctcacatccttggggccttcccccagttttagctgatggggaaaggaaaacgcttaaccaccttctaccaccagggggagcaggcagttagaccaggaaccaccctttgactcattccaaacaggctgaggagttggcaggtttagggaatgaatccagggagaaaaaactgtttcttgtcacccctcttcccctactcttgcactcatcccaacgctactggggaaatattggtaggaatccaatatttcgagccatatttggaacaaaatgacaatttcaggctttgagatttgttccatgctgtggatagattgttttgccacttactgcaatttcacatcgtgggagcagtgtggtcctggttgtcacctcatctactacttttctcatttaaactttttgccaagtggattttattaagattcttgttttaaagaactttaaccgaagtaagcacacgaatgatggcagtcattccatatagggcctcggtttggtataataattaagcaattagtccagtgagatttcttgagtgccagctatgtgccaggcactgttctaagtgctggaggtaacagaggtgaacaaaacagacaaaaccccctgtgtgtattgagtttacattctaagaggacaataaatagagaagtcaataaatayatggtagttcaggtggtactatggagaaaatgaaggcagaggaagagggatgaggatggggtgagtggggattgtcctttagatagtgttcagggaagacctgtctgatacagtgaacattgagtggagactcagattgaaggactgagccaggagggtatctagactctttaaataatatacacatgtaacctatacttattaagcatcttcaatataaaagacactgaagcactaattccccatcaggcacaycctgggagtatgtacaggcctagctgggagcagggacttggagtaagggcagtttgggaggacttgaaaactcaggagctctctagctaactgcctatcaaatatctctatatctgtagctatgtgactgcctgtggactgatcaattactgatgctttggtgtctttagttgaagtttcaaggtgggcctacattaaactcttgattttaactgggttcayggaggagaattctgaaaacttcaaatgagaatgtgaatattttaagagattattttaccactaggttcttgtaactattaatatatgtgctccagagtctagtacctctccattgttttttgggaaaaattctataaactgccccctttctttccactaaatgtatgttactctccaagaccttaaggaaactcactggacttagggggaaggtaagctttgacagggagactaattggctggcctgcccctcctcccacccctaacctgggccggtttgcatggtgtgggcactctgctgagtacagctgactaacacctgcatggctttcccttcctgcagccatygaactgcctatcaacctgccccccccatgcaggtgcatgcayggaggaaattgctattttgatgagactgacctccccaaatgcaagtaagtctgaatgttgaggtcccrgctataggccttgcctcttctggggaaatttgagaccttaaagtagccaggaaaacaaatacaggaacctcaccagttcactaattcttacattttaaccagcttgccttcccttgagggagtctacagagaactgaggcagtgcttctttaactagaatgtgcataagaatcccgtggagatctggttcaagtgcccattctcacgcacagagattctgcatttctaacaagctctaggtaggccacagggtcttggaccacactttggggagcaaggagttagaraattggcagcagcattttcctactcacctggtattgttgattacaacagggctgtgggagaagagctgtctgcagggctgctttagtacaaggcactsgtgatgagcagaaagactgggatggattcggaaagaagatgactgtgttgcgaaaactctaacatggagcaagataaatggatgtctttaaaaagcatttaatgaaagcatataaaagaaagaaacataaccatggtttccatttgtactctctaaggaagcattgcatagattagacaccaataggttttcgtggccagactcaccccctcagtgccacagctactccattacaagtgcatttctaaaatcagagcactgttctttctgcttgtcttctcttggcagaatgaacaaaagtcatgcaggatacattgtctgttcaacatgtaatttatgcagtcaaagctctctctacttcaggatgtgctcagaaaaatgcagtagaagcctaagawcataacagctagtgaatgatttgctttttcctttcaggtgtcctagcggctacaccggaaaatattgtgaaatggcgttttcaaaaggcatctctccaggaacaagtaagttttaagaatgtgagcaacttggaaattactcatggcccctacattgaatgctgtcacagcttttctacttmacccagtctttgaaggagtggttctagcccccagtttctgccaggattgcgggctcccatgtgttgatgtgctctctgctatcttcttctatagccgcagtagctgtgctgttgacaatcctcttgatcgtcgtaattggagctctggcaattgcaggattcttccactatagaaggaccggctcccttttgcctgctctgcccaagctgccaaggtcagtttcattatggggaacgttgatgtttgaagcctaagaaattcatatgaagccatgtgaaggacttagttttctttctaagttaaaaaagcacaatacgcagttcaccgattccacagaaacaaaaagtagtgaggatgtaaagcagtcacttcaaatcccaacttcttagtcaartgcttctctaaagcctgagtgacaagctgtgttttgtagtccaaatggttgtgcctactggtaggtgttcaggtcagagaggagtgaaaaggcagctgtgtgatggcccaggctttatccttctatgtgctggactctttttcttttagatctcatggttcaggaatgtgctttaacgtttccaggtagctaagggaacttactaccatatttgacagtgtaaatttagagtgggaattgagcattacatttgaggaagatttggcaatgtggaggagagggtactattgtgaaaggttgtatttgttgtttttgttgttgttgttttaaataacaagacactgttttggttacttctttccagcttaagcagtctcgtcaagccctctgaaaatgggaatggggtgaccttcagatcaggggcagatcttaacatggatattggagtgtctggttttggacctgagactgctattgacaggtcaatggcaatggtgagtatggtttcaaaatgattatttgaaggttgtcatttatagaataaatactttttataaagaacaaaattcacctagagaagactgaaatacagtattaggcctctcagaataaggtctgcactacacaagttaggaaacattaggtttgttgctgaaaggtgtctaaaaacattggtaataacattggaatttacccctgctctaagccacgctgttgaattggaatcatgaacagtctgaagtttaacttgaatattgaagagctttctggtttttttgagggtggtgtgtgaggaggacatgatattttgtttttatttgatgacttttatatgtataaaaggagtagggaactatatttttcctagtgtcatatatttttctgccaatgtatagtgatgaaataaacagtgattttagagttggcgttggtccagaccacggctctgccacctactaagtatgtgacaatagacatggagcttgatatctctgaccctcattgtccctatttgtaaaacaggtaaaataatacctcctgggaggaccaaatgaaatactttatgagggggctgccacagtcttggcactgagggggctttctgtaatcagtattgggaaaccactttcagaattttgtctctccctcaaatctttcattgttttccttccctgagaatattatattatccattctttttccttcccctctctccttattcttcttttcttcttccaccattatccttttctctgtggcccagacccaattcccaagtgagttatttaagagaatttggatataagaagaatgttaccatttccttgagttggtaaattagtgcatgttatgttactttgcataataatttgccatatggaggtcttgtgttttgctggcctttttttttttttttttttgcaagttctcttttgggtaacttatgacgtagcacctagcgtacctccaggtgtgaggaaggcacctttctttgtgtgtgaaccagattagtatggtgtaatctctctctstgtttctctctctctctctctctctctttctgtctctgccatcagagtgaagactttgtcatggaaatgggraagcagcccataatatttgaaaacccaatgtactcagccagagacagtgctgtcaaagtggttcagccaatccaggtgagaaaccatacagtcttttctttcagttactgctgtcgctggatcttaatctattgagtcatgtcttaggattttcctaaccttccctccaaagggaaggaagcatagtgagtggtccatgctgcagctgccctatctgcaggaacaggaccaacccaaggacataagacctgaaaacaatcagaatcctgttctgttgcacagtggtggaggtttggcagccatgccggggctgctggccaagaacctttcattttgagtggtgtcagagcaagagaggtctgagtcccttcaggggcctgggaaacacagtgcctgaagcaccacagcttctctacaaatacttgtgaaatgaatgagtggagaattgtcaggtcactatacaggaatttggggacggggcccactctctggttcttgctgctatcccaagcatgtggtttgaggtggattaaagggagagggacctcttatgcttgctgttgccatacttttctgaaaagtacaaaggtctctagagttgatgggcagatatctaaatttccttgttgcagccttgttgctcagtcatctttttttgtgtgtgtgagcaacaaggctatttatttcacctgggtgcaggcgggctgagtccgaaaagagagtcagcgaagggagataggggtggggccgttttataagatttgggtaggtaaaggaaaattacagtcaaaggggggttgttctctggtgggcaagagtgggggtcacaaggtgctcagtgggggggagtttttgagccagatgagccaggaaaaggaatttcacaaggtaatgtcatcagttaaggcaaggacmggccattttcacttcttttgtggtggaatgtcatcagttaaggcaggaacaggccattttcacttcttttgtgattcttcagttacttcaggccatctgggtgtatacatgcaggtcacaggggatgcgatggcttggcttgggctcagaggcctgacattcctgccttcttatattaataagaaaaataacataaaatagtattgaagtgttggggcaaagaaaaaaatttttgggggggtggcatggagagataatgcgcagtgtttctcagggctgctcaagtgggattaggggcggtgtgggaacctagagtgggagagmttaagctgaaggaagattttgtggtaaggggtgatattgtggggttgttagaagaaacatttgtcgtgtagaattattggtgatggcctggatacggttttgtatgaattgaaaaagtaaatggaataagagaaggagaaaaacaggtattaaaggactaagaattgggaggacccaggacatctaattagagagtgcccaaggaggttcggcatagccctgccagcaaagattatttatttactttaagagggagttaagagtggcggtttggggatagcaccacgagatatcagctgtgacggcttggagaaacagtgtaaaccggtggtataaacaagagcagggcatttatgagtagttgagaacggtgaataggagtatgactagacagaagatagtagggatgacaagttttttggggtgcagtccaagttggtctggtgtctggaatgagactggggcttaataaaaaggagcgtctatacaggagcttaaatggctgtaccctgtagcattctgaggacaggcctgaattctgagaagggcaagtggtaaaagtattgtccagtcctttttaagttggtggctgagcttggtgaggtgtgtttttaaaagaccattagtccattctacctttcttgaagattgaggaccgtaaggggtatgaaggttccactgaataccaagagcctgagaaactgcttgggtgacttgacaagtaaaggccggtccactgtcggactgtatagaggtgggaaggccaaaccgaggaattatgtctgacagaagggaagaaatgaccgcagtggacttctcagaccctgtgggaaaggcctcttcctatcctgtgaaagtgtctacccagaccaagaggtattttagtttcctgacttggggcatgtgagtaaagtcaatttgccagtcctgggcgggggaaaaaccccgagcttgaggtgtaggkaagggagggggcctgagaaattcctgaggagtagtagaatagcagatggaacactgagaagtgatttccttgaggatagatttccacaatggaaaggaaatgagaggttctaagagactggctagtggcttgtaacctacatggaagaggttatgaaatgatgacagaatagaatgggcctgtgaggctggaaggagatattttccttggtctaagaaccatttgccttgtgtgggaagagattgataggtggaagtttcagcgggggactaggtgggagtgactaatgtgaaggagaaaaactgacygtgagggacagaagttggaacgctagctgcttttttagctaatttatcagcataagcattgtcctgagcgatgggatctgatgcctttttgatggcccttgcagtgaatgactccagcttcctctggaagtaaagcggctttgagaagcgtttttattaaagacgcattaatgatagaggacccttgtgtagtgaggaaacctcttgcatggtggtgcaggatatggaaggcatatatagagtcagtataaatactgacatgtagtccctttgcaagagtgagggtttgacttaaggcaatgagttcggcttgctgagaggtagtggagcggggcagagcggtagcctcaatgatagatgtgsaagatactatagcatagcctgcctttgctggtgagtggcgattaggcctggtggaactgctatcagtaaaccaagtgtgttcagggtgaggaacaggaaaaaaggaaatatggggaaatggggtgaatgtcaggtggatcagagagatacagtcatgggggtcaggtgtggtatccgtagtaatgtgggaggctggattgaagtctgggccagaaacaatggtaattgtgggagactcaacaaagagtgagtacagctgaaggagctggggaacagacagtatatgcgtcaggtgggagaaagaaaatagattttggaagttatgagaactgtagagagtgagttgagcatagtttgtgatttttagggcctctaaaagtattaaagcagtggcagccgctgcacgcagacatgagggctaggctaaaacagtaaggtcaagttgtttggacagaaaggctacagggcacggtcccggctcttgtgtaagaattctgactgcactaaccatgcctaggaaggaaaggagttgttgttttgtagaagggattgaggtttgggagattagtcagacttgatcagcagggagagcatgtgtgtttttatgagaattatgccgaaataggtaacagatgaggatgaaatttgggcttgactgaagtaatgggggctgtctgtgaagctttgcagcagtacagcccaggtaatttgctgagcctgatgggtgtcaggttcagtctaagtgaaagtgaagagaggctgggatgacgggtgcaaaggaatagtaaagaaagcatgtttgagattcagtccgtcatctttaagaagagctgggagatgaaataggaatataggtgaagggaataactttacataaggtctgcatcaatagccccagcgccacttttactgcttgtcaactgcgaacatgtatctcctttgtcacaacaactatggccttagtgacaatgaataactgtcattgttaacacctaatgctccttttgaactcgagatatggcacattttaatacagaaactagaaatgtttattttacaaatattttgtgattttaagatcggaaatgtttaaatcttgaaagcattttccctgatcctctgataaacagatatgaaaactttaatcacatgataaaagagatacgacatttcatttgacatcttcacttaaaataaaatgaggccatgtatacaaatgcatatccaagtttcagaataaacaagtaatgaatgtgaaaatataggaaaaggagtgaattgtctaccttgtagtttattatgcattcatggtaatttggtcttaaaagggaaccttggaattgtatgaatgttatagaaaaatgcgtagaagattattaattctatcattctcatcttttcaaaaattcaacctctttttagtagtactatgaaatcttaatttccgaagataggatttattaatattcaaagaaattattaagatccaaagataggattctcagttcatcagtgaggttggggaattattcttgctgttcttctaggatttggcttccagtatataactagagtatgattatccaaaaatttggtcaacagtgggagtaagaaggtatagagaatacagtagaaattgctagtaataagtgagagtgtgaccagtgagggatgtatttgcctcccaggattaaggtatgaggtgacttagtggttgctgctcttgattttggggcggtgggagtgatgtttagtcctggcctactgggtcatgcaataaaaatggtgcctgatgatgtctgtgggagaacaagatggcaaaaagagccagagttggtacaaactttacagcaaatttatttactactaaattctttcaaaattgggtaaaggcctttaacatgtccacaggtgactgtatctgaaaatgtggataataagaattatggaagtcccataaacccttctgagatagttccagagacaaacccaacttcaccagctgctgatggaactcaggtaacagttgccgactcctgaaataatgtgggatttggaaaaactttgggatgactgggtttttattamccttaagcaaacaagggagattctggaaggctcaaagatctcaagatgtgttgacagttaataaatataattttttaaaaagtcatagattgaaaaactttccaccaaataaagctacattctaacatcgagttgggaataatgttccttgtaacataggaggacatgtcacaaagaagaacaaatagacttctggatccagtatcttcagaccagagacatttaagttgagaaattgactcagtatgaataaagatttcacggtgtcaaagatacagatgaaagatccgtctgtgtgtgccgtgatttctctacagcatgcatctttattctttcaagctgttcttcgctctcctgctattacagatctttaccactagatggcactaatttttccattcatcatccatctattcattattggccaaccaatcatctaactaacgttattcccctcgatgtgtcagggatggtgtttaatactggagattgaaagaaaaaaatgccactagatggagcttcttaaacatgcctgcaggtcctttgcaattggtacactatttggtctgcaggaagaaattcaataaatatatttgatattaaactctgtattaatgtatatcattagttttaatgaatgcatwtgcagctataccagatatagctgtttgaatctggacaaactgttttacttctggggctagagtcctcaataatatttctcactgggggcgctattggcatattgagtgggacagttctttgtgctacaaaactgtcctatgcactcagggaatttcagtatttctggtccctgtccactaaattccagtagtgtctcccctaattcagtgtgaccccagaaatcacctcccctccccaacacatgtgcactcactcctggttgagaaccgctaggatctggaatgtctctgttctaagattctatgaccaattttgtgaagtaatgtaaagaaatgaaagtctaagagtagttggaaattttaccattttatacaatctttatttctcaaatttcatagtctataaacattgatatcttggtaacttggcagtctcattatcaccttaaacattggtttctgttctgctgatttaaatcaaaataaaatttgacctaaattgatgctgagaagagtctatatcaaggcttctgtacaccttctcaaattcccttatttcttcttctcatgtcacamacacacacacacacacacacacacacactcatacactcacagacatacataaatattgtctagaaaggaattttcagtttcagatttttcaagggactaaacattttttctttaagctrtattaaaaatggattttgaagattaattttccacagacacacggatgcttgaatgtcatatatytggtcctccaagcctgagtcaaccccaagctagtgccagatttattttatattttcaacattttttctcagtccatctctagtctagtgatcttcttcactaaatagacattttccccagctggtgcaggaaggggactgtggtggggaggctgtaacctctgatctgcatgtctgttatcagaaacaaaatgtaaactgacagtctctttcaaaggagagcagatcttcaccaattgtagtcctttctttctcttcccttttgtaataccttggttcctcctcttacttttttacattagtgaggctgagaccctctaaaatgtgtcttccatgttatgtccagggatctcactgtatttcttccctcctgggcactgagttaacagccagcatgctttaaaagcagtagaggcgcttgggtgagatcacctaggttgatttgaatatgccagagtcccacaaatgtatctttcatccataaatatgttgaaagactaacaattaaaaacatgggctgggcacggtggctcacacctgtaatcccagctctttgggaggccgaggtgggtggatcatgacatcaggagttcaagaccaacctggccaacatagtgaaaccccatctctactaaaaatgcaaaaattagctgagtgtggtggcatatgcctgtagtcccagctattcaggaggctgaggtgggaggattgcttgaacccgggaggcagaggttgtagtgggccgagactgtgacactgcactccagcctaggcgacagagtgagacttcatctcaaaaaaaaaaaaaaaaagattcagttctatcattttccaaaagttacattgatatgcataggatcccccaaggagacaaaaatgaaagtcaccgtccctttcctcttgttagtaattgcttaacttcaagttagccatttcattttgaagcaatgacatctaagagactttggcccgccccacttaactgtaagcgcccagaggcagggctctgacctgaatgtcttcatgttccccttgggggcactatgtacaaagcaggttctcacttgaatgtgggttaaagtgaagacctcttctacttctgtagccctgtgttccccactcctccacaggctggtcccctgctgtcacagagtaagagacaccccataaaacctgtgggctccctcagctcctgttgagagtaggctgtctgttcccttgtctcccaccaggtttttatctggcagtcagcatgacaggcaacttttcagtaaagcgtgggccacgcaccatggtccagggtgattatctttgggttctccagtttatgggcctctgggtcccctgagtaatcattacctgcccttctacctgcaagttagttgtataatcttgctgtgactcagcaagtataggataataagtgtacctacctctggggtttgttaaaaaaaatcagaaacttgtaaaactcttagaatagttcctgacacatagtaagcactcaataaatgttagatgtttttgttattattattgtgacacaggagggaatgatgaagggagaagggatactcttgagttgaccaaagaatgttactttagggaataagagttacagtttggctttgccatctccacccaattttcaggcagccccagaaatctctttttctccagatgcatcttgtgcatgtctgttttatgtgttctctctgtactgaggtaaccaggtgatttgcttgtagatactatggcacaaattctataatatataaatttgaagtcaaagaagtgtttaaaaccattcgattaaaagagcccagagtttcagttactgttcagggaccataggaggaattgaacaatttaccatatgggctgaatcacatggtcccaggtcccaaattgctttacccttcagtaagaagaaattttaaaactgagacaggaggaaaagaaacccacaaaataattccattactgagaggtttttgttttccccttttcatttaggtgacaaaatggaatctcttcaaacgaaaatctaaacaaactaccaactttgaaaatccaatctatgcacaggtaatttttaacaatttttcttagcacagacattttttcttagaaattatttgcttggttaaattggacacacacttagattattctgagcagagtggccacaartagtcttctttatgaaaaaccgtgtatggtgaccttgggggaataaatggctgattcctgttacattgtattcttagatrgagaacgagcaaaaggaaagtgttgctgcgacaccacctccatcaccttcgctccctgctaagcctaagcctccttcgagaagagacccaactccaacctattctgcaacagaagacacttttaaagacaccgcaaatcttgttaaagaagactctgaagtatagctataccagctatttagggaataattagaaacacacttttgcacatatattttttacaaacagatgaaaaaagttaacattcagtactttatgaaaaaaatatatttttccctgtttgcctatagttggaggtatcctgtgtgtctttttttacttatgccgtctcatatttttacaaataattatcacaatgtactatatgtatatctttgcactgaagttgtctgaaggtaatactataaatatattgtatatttgtaaattttggaaagattatcctgttactgaatttgctaataaagatgtctgctgatttggttggtgatcattatagtaaatgatccaacaagaaaaggaattgactggggacctttagccgtgtctaaagaagaggcaccactcatatttcctataaaattatctaggaaaggaatccaggccccgctcttgggtccatttttacacattagcacttaattaatgttcaatattacatgtcaatttgattaatggctatgttgataggggccactatgtgttgtatagacatctggacttgactgtagactcctcagataatacagaaggtaggaaaagcaattcagtttggcccttctgtgtgttggcattgtctaaccagaactctctgtttcatgtgtgttctctcactagctgccaagacaacatttttatttgtgatgtctatgaggaaatcccatatcattaagtgccagtgtcctgcattgagtttgtggttaattaaatgagctcttctgctgatggaccctggagcaatttctcccctcacctgacattcaaggtggtcacctgccctagtagttggagctcagtagctgaatttctgaaaccaaatctgtgtcttcataaaataaggtgcaaaaaaaaaaaataccagttaagtaaagcctcaactgggtttttgtttctatgaaaatatcattataatcactatttatttcctaagttgaacctgaatagaaagggaaaccattcttattaagctttttattaggccctgtggctaaatgtgtacatttatattaraatgtactgtacagtccagatcttttctttaattcttattggttttttttttttttttttttttagagatggagtcttgctatattgccaaggctgatcttgaagtcctgggctcaagtgatcctcccacctcagcctcctgagtggttggggttacgggcgtgagccactgtgcctggcttccagctctcctcttaaatagtgggtatagtctgcacaacaggaaccatggcaggaatatacactttcccatagcaaatagcatacctgactctctgtgctaatattgcacatttgttaaacaatgaatgaadggatggatggatggatggatgaatgratgaaacatatactactgattattttattccagagttctcaaaatatttgttgctgatattttgagtgctgactgtaattactttgattagataaacaactggaaataatgctgctgaaaaagttctaataaatgtgtattttatcagatgttttctgtgtgcttcataagccccagtcatgaatcagttgtattttgctgtgtaaaaagcttgaggctttgagtgctcttagtcacaccaattctgtaccactccttcttggaattgaatccagagcaatttgattgaaaatcaagcctctgcattcatttttttgtgtgtccatgatattctggggtaagttataggaaacaaataactctccagaaatgagaagttatcagagtcgcaggtaaccaccagtatagccagtccttgaatgctgtccatggctaaggcagagcagggaggaaaggtgcatattcctgtttctctaataactagcgttcccctaacagtcatttgtcaagaggacaatttcccagccagctccgttaagcatagggtatgggccatcttcccactgttaatctctctgagcctcagctgctgcctctataaaatagggggctcggttgtgagaccccagtgtgggagtgtaacccaacacccagcataaaatataccttcaatcaatggaagccatgactattatcatttatgaagtaaagggaaaatggaacagccatttgtgtgttttaaaaagttccttgggtcatttaacgaagagccttggttgaaaatgacgattctaaatagaaatggctgctctttcttttttagtggaggaggttacagaggtgaacaagattgtgtctgggcctttgaaaggattaacacgtatcttgtctataatgaggctgaagagcagatgataaaaagtttggtcttgctttactgtcatttgaaggtgataggaagggcagtaaacactcctgtacatagaaatgggaaaaggttgagaagacggaagtgcatattcacatcacagcacagggaactgaggcaccgctgaaataaatatacctttcccagattcctccaaggatcccgaggagttgtttgagtttgttgtatatattctggatatgagtcccctgtcaagtgaatagtttgcaaaaattttcttccatttaacaggtggtctcttcattttgttgattgtttcctttgctgtgcagaagctttttagtttatcataatcccatttgtctatttttggttctgtttcctgtgcttttgagttcttagtcataaattatttgcctataagaaagtccaggagagttttccctaggtttttttctaggatttttataattttgggtcttacttttaagtgtttaatccattttcagttaatttttgtagatggtgaaaagggtccagtttttttcttctgcatgcagctaccgattttcccagcaccatttattgaagaggatgtcctttcccccgtgtaggttcttgttagctttgtcaaagatcaattggctcttaaatatgtggctttatttctgggttctctattccattctgttggtctaggtgtctatttttataccaatatcatgccattttgattactatagccttgtagtcaggtagcgtaatgcctccaactttgttctttttgctcaggattgtcttggctattcgagctcttttttttggttccatttttaaattttttttctaactgtgaagaatggtattggtattttgatggggattgtgttgattctgtatattgctttggacaatatagtcattttaacaatattaattcttccaacccataagcatggagtatttcgccatttgtttgtgtcctcttcaatttatttcatcagtgttttgtagtttttcttgtagagatttttcacctccttaaatttattcctaggtattttttttgtagctattgccttcttgatttttttttctcggctagctcattattggtatatagaaatgctactgatttttgtatgttaattttgtatcctgctacttgattaaattcatttatcaaacctaggagtttttttggtggagtctttagattattctggatagaagatcatattatcatcaaagagggacaatttgacttcctcttttacaatttggatgccttttatttctttctcttgtctgattgctctagctaagacttccagtactatgctgaattggttaaaagtgggcatacttatcttgttccagttcttagagaaaattctttcaacttttctccattcagcacaacgttatctgtggatttatcatatatgttttttattattttgaggtattcctagtttgttgagagttttcattctgaagggatgttgaattttatccaacgttcttttctgcatctattgagatgatcatatggttttgttattcattctgttaatgtgatgtatcatgtttattgatttgcatgtgttgaaccatctttgcatccctggtgtaaatcccactggatcttggtgtattatctttttaatgtgctgttggattcagtttgctagtattttattgaggatttctgcatctgtgttcatcagggatattggtctgtggttttcttttttttgttgtgtccttgtctggtttggggatcagggtgatgctggccttatagaatgaattagggagagttccctcttttttggaatcatttcagagggattggtattagttcttctttgtacgttgggtagaattcagctgtgaatctatccagtcctggacttttctttattgggagactttttattatggattcaatcttgctactttttattgatctgctcaggttttctgtttcttcctgatacaatcttggtaggtagtgtgtttccaggaatttatctatttcctagattttccagtttgtcagcatatagttgttcataatagtttctgatgatcttttgtatttctatggtatcagttgtaatgtcttctttttcatttctgattttgtgtatttgggtcttttcttggttagtcttgccagtggtttatccattttgtttatatttttgaagagcaactttcattttgttaatgatttgtatttctttaagcctctatttcatttagttctgttctgatctttattatttcttttcttttgttcatttggggtttggtttgttcttccttttctagttccttcaggtgcgttgttaggttgttagtttgtaatttttctacctttttgatgtaggcatttaatgctataaacttctcttttaacactgcttttgctgtgtcccacagattttgatatgttgtgtttccattttcatttgtttcaagaaatgtttttatttccttcttaatttctttatttacccagtggtcactcaggagcatgttatttaattcccatgtatttgtatagtttccaaaattcctcctggtactgatttctagttttactccagtgtactctgagaagatacttgatataattttgatttttaagaatttgttgatacttgttttgtggagtaacatatggtctattctgaagaatgttccatgtattgatgaaaagattgtatattctgtaattattggatagaatgttctgtaaatgtctgttaggtccatttggtctaaagtccagtttacatttaatgcttctttgttgactttctgtctaaatgatctgtttaatagagtgggatgttgaaatcccccactattattgtactgcactctatctctttatatctagtaatatttgcttcatgaatctggctgctccagagttggatgcatgtctgtttagaattgttatgccctcttgctggattgatccctttatcaacatataatgacctcctttgttttttatttttgtttctgttttttactgttcttgccttaaggtctattttatctgatataagcataatactcctgcttgcttttggtttccgtttgcatggaatatgtctttccatccctttactttcagtctatatgtgtctttactggtacagtgagtttcttataagcaacatatagttggatcatgtttttaaatccattcagccattatattttcggaatttaatttttttatgttcaaaattattattgatatgtgaagctccattcgttcctgtcatattgttagttgttttctggttgttgtaaatattctttgttctttactttttctcatattgattgtcattgtagtttggtgaatttctgtagtggtaccattgagtcctttttcttccttctttatgtgattactttaccagtgaattttatatgtttgtgtgttttcatgatggtaaatattgtcttttcacctccaggtttagaactcccttgagtatttcttataggtccagtccagtctagtggtaaacaaattctctcagcatttgctgtgtgggaaagactttatttcttcttcatttatgaagtgcaattttgctggaaattgtatcctcggctggcaggtttttgtttttttgttttttttctttcagcactttgagtatgccatcccattctcttctggcctgttaggtttctgctgagacatctgctgttagtctgctgagggttactagatagattactagatggttttctcttgctgtatttagtattcactctttacctttgactctaaacagactgaatataatgtgccattgagaagactgttttgccttgtgtgtttttggggattactgagtctgctgtaactgaatgactaaatctcttgctagacttgggaagttttcatctactcattaaataggttttctaatcctttgtctctttgcccttgaggataccaataatgcaaatattcaattgctttatgttgccccaaatattacaaagattttgtttattcttttaaaattcttttttctttatttttgcataactggattatttcaaaagggattctgagataatgagattctttcttctgcctgatctagtatactgttgaagctttcaaatgtattgcgagcttttgtatttccttcaatgaatttttcccttccagaatttctatttggttattttaaaaaatgtattttttggttaaatttctcattcatatcctgaattcttttctgatttttttttgtattgtttttcagaattctcttgtatctcactgagcttctttaaatcaatgtttaaaattctttatctggaatttcaaaaatttctttttgattaaaatctattgctagagaattattgtgttcctctggaggtgtcatattttcttgctttttcatgtttcctgggtccttatgttgctatctgatgtgatggttggtgtaacagttgtttcttctcatttttgaatttacttttgcaggggaggactttttctgaagttgcatctatggagttgcttgggtaggatacgttggctttgattctgagtgcatgctgtagtgtagtctctgtatgatttatttgactgtaaacagcatagtagtatctgtgctttccttagtgagttagggtgtggttattactgaaggctgtggtgaagttgtgttgggggactagcatgccgtgtgtgccaatattcaggccccaatggtggcagctgtgggctgaatatgcctatattttagccccaaggtggtgtacaatggtgcctgtgttcatggttactggtgggccaattcttaggcttccaaatggcttgcttagattccagtagtggcagcgatggaccaggtgagtgggtgggttctcaggcaccttggacagctgacatggcataggtgatagcagtagcagaggtaaggtgattctctgggtcacaggcagtatgcattgatgttggtggtggctccaatggactgggcaggccagtctccaggcctgcatgtggactttgctggttagcaccagctgaggtggtag

SEQ ID NO: 17582 - DNA, 41662 bp, Homo sapiens
gaatcatcagcaccctacggaaaattgttagaaaagcaaattctcaaagcacatcccagacttactgaatcagaaagactaaaggcgggactctgcaaatttagttctaattagatttccaagtgatacttatgcatgttaaaatatgggaagcactattttactctgtcaaagcaaatactgagttttatttaggcaaacaataatttatatggtatctggatgttttctaattaaagatggtacctttcatcagagactataataaaatgaaaatgaagacaattaaaacaaaataaagaacccaaaagctgtaaacaccacacagactatgaaaagatgagaatttactgtagcaagtgagatttcaacaaatttgagaaaatggaagggagaggcaaaagtgaaactgattttgcaagactcagaaagtcacaacctaaagtgtgtaaaaaggaaaataagattcaggagatccaccttaactccacagaaatccaaagaggctgaggacttagtggtgtcaaataaaaagacaaagttataaattagcaagtaaattgaggatgcttgaaggtctattcacaagccaattcacccagcctaacttactacctccacaaagagaatgtggtaccaccctaagcaaaggatagatttcttctgtgtaaaattggcagaaaagttttgggattcaaaatacactattcatcagggaaggagaggttgaaaaatatagaaaatgaaagctactggatttctactgtctcctgcccttttgcagcagaagtccattagtcaggaaggtaaacccaaagcaaatgcttaccctgtggcaggcaccaccctaaaccttttatgtattttaactttctgaagtttcaaaaaatgttatgaagtagatactattactaccctcatttatagatttcaaaaagaggcacggaggctgtcaggtaactttcatgaggtcacagggatggtaagttgaagagaaagagatcaaacctaggtggttcagttttccctcttcctttttccaccatgttttctcaatttctttttccaccttcctgttctctcctctcacttctcttagtaaatcttcaaacatgtgttaaccttggttagcaagataatgggaataaaactagggagtgaaaaggacaagatttcacttcttttctgcatttgcagctttattgtttggaaaaaaatcacattacttttgtaaataacaaattttaaaggaaaataattattccttcagttcaataaatatttatttattacatgtctctatgccagctgcagggctggaaaaataaacattctaaacaaatctggttggtttgatttcaaaacatatttaaaatatcatttggtatagtcccatttatttatttttgttcttgtagcctgagcttttggtgtgatagtcaagaaatctttggcaaggtaaatgtcaaggagcttttctcttatattttcttccaggagtttaacggtttgaggtcttacatgtaggtcttttatccattttgtttttgatttgtttgtgtggtgtaagacaacagttcaatttcattcttttgtatgtgaaaatccagtcttcccagcaccatttattcaagagaccatcctttcctcattgtgttctcttggggcccttgtgaaaaattagttgaccgtgtatgtttggatttatttctgagctattttgttccattggtctacatatctgtttttatgtcagtgccattctgttttatataaatttgtaatataatttttaattaggaagtgttatttctccagcttcaatttttttctcagaattgctttggctatttgaggtcttttgtggtttcatacaaatttgcattgaatctatatattactttgggtagtatgaacattttaacaatattatttctacatcaaaccaaaaacttctgcatggcaaaggaaacaatcaacgaaatgaaatggcaacctatagattggaaaaatatatatctgcaaatcatgttctcagaaaagggttgagtttccaagatttataaagaacttatacaactcaatagcaagaaaacatataacccaatttaaaaatgggaaatggacttgaatagacacttcttcaaaaatgacataaaaatagccaacaggtatatgaaaatgtgcccagcatcactattcatcagaaaaatgcaaatcaaaatcactatgagatactacgtcatacctgttaggattggtattatcaaaaagacaagagataacaagtgtcggcaagggtgtagagaaaagagaatccttgtacactgtaggtgggaatgtaggctggtgcagccgttatggaaaacagtacggaggttcctacagaaattaaaagtagaactaccatatgacccagaaatccctcttctgggtatataccaaaagcaaatgaaatcaccgtctcctgaagatagccgcactcccatgttcattgcagcattattcagaatagccaagataatagaaataatctaggtgtccatcaatagacaactgtataaataaagatacatatattccatgttgtgtgtatacacacacacagatacacacaaaatagaatattactcagccttataaaagaaggaaattctgccaggtgctatcacatggatggacctggaaggcattatgctaaatgaaataagccagacacagaaagaaaaattttgcacaatctcacttatatgaaattaagaaaaggtcaaatatatacaatagtggtttatagcaggggtccccaagccccaggccacggacctgcacatgtgagggatctaggtgcatatttcttaggagaatctaatgcctgattatctgaggtggagctcaggcagtgatgctagcatcgggcagcagcggcaaatacagattaacattagcagagagttttgactgcacagagaccataataaatacattgattgcagactcatatcaaaaccctatcagtgaggggcaaatgacaagtgacaattaagctgtgtctggaggcaggctttatagtggaaaattgatgtacttcaattgtacagttgcatctggtggcaggctttaagtcagaatccaacacttattttagtctgtgcatggcccacccattattttaccacttccatctgcacctcttttccacactgtgcacttgtcttagtcacagttttgctaagcccacaagctaacccttgtgaaaaacaagggtttttgttaaaaaaaagtttttgttaaaaacatcaaagtgagtgaaaaacaaacatcactggacagcttctttgaaaatggggaaaaacccaaaggtgagataacagaagactctaagactgctaacaaaaagaaagctgcacttaaaggaaaatgccaagagtcctacttaaattacaggttcactgcaacaggtggttcacattctccaatcctgctttgtataatatgtggtgaccaactgcccaatgaagccatgaaacctgcaaaactactttgccacatggagaccaagcactctgcattaaaagacaagcctttggagttttttgttttgttttgtttaaaaaaaaaacagaaaccatgaaaccatgaacacaaagaacacatagaagcaattattgaaggccaccatgtcatcaaatgtgtctgcactgagagcatcattcatagtggctaactgcattgctaaagctaagaagccctttactattggtgaagaattgatcctgcctgctgctaaggacatttgttgggaacttttaggagaggctgcagttcaaaaaatagcacatattcctcttctggctagcaccataactagatgaattgatgaaatagcagagaatatcgaggtacaattgttagagaggattaatgagtcaccattaatcctctctagcaattggtatgcaatccaggttgatgagtctactgatattgacaacaaagcaacaatgcttttttgtgtgtgatatatttttcaggaagatgtgcacaaggatatattatgtgaatttttgttgccaatcaaaaccacagctgaagaactatttgtctttgaatgattacatatcaagaaaactgaattggttattttgtgtaggtatatgcatggaaggagtggctgccatgactggatggctttctggtttcactactctggtcaaagagaccagaatgtgagtctatgcactgtgtcatccacagaaaaatgctggctagctgaaaaatgttacctgaacttaacaatgttttgcaggatgtgacaaaaataatcaaccacattaaagtacattttcttaactcacatctgtttgtgcagctctgtgaggagatggacactgggcatgcatgtcttctcttatacacagaaatgagatggctttctaaaagtagatcactggctgaaatttttgaattatgagagctgctccagagatttattttagaaaatcagtcaccattggcggcacatttcagtgacacagaaagggttgcaaaacttgcttacttgtgtgatgtattcaactcgatctatgaactcaacttgtcgcttcaggagagaaggacaactgtgttcaaggaagcagataaattggttgcattgaaagccaaactggaattatgggggcaacgaatgaacattgagatttttgacatgtttcaaacattagcagagattttgaagaagactgagccagcagcttctttctctcagctgatgcatgatcacctatcttagctttcaaaagagttcgagcattactacccaaccacaaaagaaccctgaactgggaatgaatgtatccatgacccatttgtgagtaagtcaggtgaatcgattttgtccgtactagaagaggatcaattgcttgagatcacaaatgatggtggccttaaaagtatgtttgagacagcttcaaatcccatgttctggattaaactcaaggtgggatatcctgagattgccacaaaagcactgaagagtctgcttccatttccaacatgctatctttgtgaagcaggattttctgcagtgacagcaaccaaaacaagattacggagtagactggacataagcaacacacttctggtgtcactgtctcccaccgttcccagatgggaccttctaattgcaggaaaacaaggtcagggctcccactgattccacattatggtgagttgtataattattttattatatattacaatgtaataataatagaagtaaagtgcgcaatacacgtaatgtgcttgaatcatcctgaaaccgtctgccacccggccctggtccatggaaaaatcctcttccgtgaaactggtccctggtgccaaaaaggttggggaccactggtttatccagggtcatccaggttggagtggggtcaggagaaatggggaaatttaggtaaaagtatacaaagttacaaacacgtaggatgaacaaatgggaagacctaatgtacaacatgagggctatagttaatgatagtggtattcaggatttatgctaaataagtagattatagctgctcttgccccaaggggggaaatgtgtaattataggagttgatggatatgtcatacaaataacttaaatacacagaataaaaactattttagtttaaaaaggaacaatatttataaaaaaataaagtgagctcgaaaacattcaaataactgcttaaaaattaaaaagtaatatcacataatttaatagaaggaaagaaagagcaagacagcaagaaagaaaaggcaccataaagaaaaacaattttggcccctcctcatttgtagtcttaagctgcctctactccctcgccttgaaaagccacgggcttccgagggatggaggtcaaagccagagtaaagaaagttcccgggggaggccactccccagctgatgactttccagttccagttagtgtcggagtcccagttcctctccttaaccaccggacaaacgtctctggagtctctccaatgagcaagaaagcaagtcgggggtaggggaggggcctcacaccagggggtgggcgcagtccctcctccagctccttcaccctccagtagtctcgtgggtccccgagcgccagcgcgggaaccgggaaaaggaaaccgtgttgtgtacgtaagattcaggaaacgaaaccaggagccgcgggtgttggcgcaaaggttactcccagacccttttccggctgacttctgagaaggttgcgcagcagctgtgcccgrcagtctagaggcgcagaagaggaagccatcgcctggccccggctctctggaccttgtctcgctcgggagcggaaacagcggcagccagaggtgcgcgggcggctttctctgccgcctcctggggacttgggcgcgggaactgcgcggagcctgcgctggggccagggccggggtcaggtgtggagggcaacttgtggggaaccggcgcgagggcccgcaggttgtgtttgctgctctgggggtggaggatgtggggtgaaggttggggccagaaatgcaagaggcctctgaaagggaccctggaagtggagcaggtacacggyaaggggccccaggcggcccagcggcacccgggctcaccccagaaccattcgaatgacaaggggtgccctgcctgaaaacgccttgcggggctcagcttccccttagctacactgctttacaggtagagagcggccctgaatcctgggtagagtctgggctcaggagcatgtgccagcgtagtggggctattagaaggaatggttaatacagcctgcaagctgtcatttatcagtaagtattcaatgaagtccgccggagcccacatctatgctaggccctctacaataccagcttaggaaagatagtggcggtatctagcacggttcctaagaccattagctccagtcaggctccccgactttaaattcggcctctactgcttcacgtctgtggactgtcagccactttcttcttatatatgttctttccattgcctcatytctgaaattgtgtaactattaaatgagctacagagtattaatgtaaaattcttagagcagtgcctggcgctacagraagtactcagtgaaagttagctcttattattttaaatatttgacaaagttcctgcttctccaagctgattctctggttcccaggtggtttcattcatgcactgttattcctggaagtcttggcatgsccacttcccagttccaggaacaggcagtcgttgttttttctggcttatcacattgagatacatggttactacaagtgacacttaaacgtgtcagrcartttgggggctcccttcttgaactttttctaagagcaaacctttgtcttaatgccaccctgtttacaacaatagtagggctttgaacaatgagaaaatgcggggaaatgaaaaagacatataaagggaaagagtggatttatgcaattggatwgaaaagtggcatgtaaaatagctggtttatagatcaaactgcctttagatctgtaaaggagcttagagtacatacaggtggagagacatcaratgtgtgtgagcagacccttatgtacttctccatcttcatctctaagamwgtctccctcttttgctctgtaacctcactcgtcttcctttacttgaatgagggacgttcctccagctcaggaattctacctatgragttccctctatctatgatgccctccaacaccccacccaccatacctccatagaytagttgatttgagacttccttcatctcctagtcygacttttcttaaaccccctaccaccatctaagttagtgccccataaccctttcttatagcaacattaattttatttatagcasttagagtatttttaataatatatttaattcttaattgtctgtctcccctagtgtctaggtattgtgctctagtgcctggtatagtgccttgcatgctctatgccttcaattaattccttwaaaaccacacaagctttatatttagtgaatatttatataggaagaatttctatgtgtatatatgtgtatctgtgtatatacacactgtattgcactgccctgaatagtgctaaattaaaaaaccaaaacactttttaatcasaacttaatagttgcactcttcaattttccatatgttcttttaagaagtgattagaaaaaaatgatgtctccatatgttgtctgctgctgtaaaagaatacctgagacttggtaatttataaaggacagaaatttatttcytacagttctggaggctaggaagtccaacataatcatgtgttgcttaaatacaggaatacattctgagaaatgcatcatgaggcaattttgtggttgtgagaacgtcatagaatttacttacacaatcctggatactatagccagcctactatttaggctggggtggtggggttgggggtgttgaggagagtcagattgagagctgagggaagtctcaaatcaactagtctatagacgtgtgggtgagtgggttggtggagggcattatagacagagggaacctcacaggtagaagtcctgggctggagggaacttggctcattcaagaaaaggaatgaccagtgaggtggcagatagcctactagacctagactgtgtggaataaggtgttgctcctaggctagaaacctgtatagcatgtactactgtaatgaatactgtatgcaagtataatacaatgtcaagtatttatgtatctaaacatagaaagggtacagtaaaaataatcttatgggaccaccatcatatatgtgatctgttgttgtggtgcatgactgtatggaggcaccagcatcttgtgagggtcttcttactgcatcatcccatggtggaaagtggaagggcaagacagcaagagagagtggaacttgatttccttacaagcctactctggcaataacaaacccactcccaagataacgacattaatctattcatgaaggtagagtgcttataaactaatcatattttattaggctccacytcccaacactgttgcattggaaattaagtttccaacacatgaacttagctcacacattctaaccatagcacctggcctagttaaagctaagtggcacaagagtaaattgaaattcaagccttttctgtcttacataagaaagataaccttaaaagagtcttttaacaaatttcactgaaggatgtcagtcttccttttttcagtgaattagagacatcggtgcaaagaatatgaattattaatcatcttaattcagctagttagcaagctgtatcacatttattaaaatcacttttatttctatgggtttagtttcaccatttattaggaggaaaggaagcaaatttgtgagggagctctgggttgtcagraaaggcttttcagagtagtaaagcaatcaaatgagaataactgattcagtatttgtttcctttgtctctttggtttactttttagttttgtagaacacttgatcactaccatctcacttggtcctagttgatgtatcatctacatttttattcaagktttaatataaaatgctataaaaggctatcctaaactggttttaagcatatttrttttgtttgttcagcataaaatacacaagaggatttttatggaatgrctccttgttacaaggtactttgcatttataatcagccacagtcacctcagtttcatcccgtatcttacaagtatgatgtgcygtatactcaaagcctcaccacctgcttgccccacccatttgcttaaatgtatcaattttttctaagcttaacttttaccaaaactggagttcaacagatgaatatttttccttcttagatgttaactaaacatttttaaaggtacaaaatttaygtacaaacataacccaaatgacatggaakttacttgatttgtgacttacctctgtaatgttcccctggcctacttgaaattcctaccttycctctagtctagtrtcttattctcagttattcggaggaagttagggacctagaattcttgttttcagagcagtagaattttgctaacataattcaaaacatttatccctatcttggggcttgaagagaatgtgaaatgctttatcytctgttttgagggaatgagggaaggagcttgttcttaggcaattaacaagtaaatttaaataaataatccaaatctggtgtgggtaaacaaattttagttttaggaactttcaaaattaagtatgcttcccctttgggttccagattttacagtaatactttttgaaagcagtaagataaaaatttcaggacctcaagagatgggtcaaaagagtttcactgtaatatgaattttgaagccagaactggaaatcccctgtgctgtgtcttcctcttcrtggtagtagaggttacagttatcaaatagtccrgagaagcaatgggaacttatgatttctgatagaaaaattttaacagagatgtacttgtatgcaaataatatatgatgcctcagtttcctccaaagtcttagttaacagagttagaaaaaatcagattatatttgaagttctgtgttcatacyggagtaattattattccaatggtacaatatacaacataactttattacattttttggtacagcataaagatgattttccctttctctgagtatttctgaaatttaaaatgaaataagtgtggtagaagccattatttatgaattatcatgctaaattaattaactcattaattcattsagggcacacccagttattccccaaacygagtgatrtatttctgggaatagacttattaagcttgagaaaacccaaaggatcattataacagcaaacaggaatgtaggcatccacatagtggatgactttagtgacctggcacacagtgccttatctacttrgcacatgtacaggtacaaggaacacttaacattttgcaccagagcttattacataccaytttcaatgcttgagatattatataaatgctaaaattctaaaacctatagtaaagcaaagacccagattttatactgcagtagttttgccagtaagtctcatcctcactaacttatcttttaagattaaaaataatgtaaccaagtgggaagaaaaagagcaaatatgaacaaattgtcattgttttagaatctgcttcttttcctttcyggtatttctgtgcaaggagagaatgatctctgaycttgtgaaaggcaaataccatgtgtattcatggttgttattcatttggcaasgacttgaaactcatgacactccctgctgaagatcctccacctattcttaacagctgggctccccagctcctggatcaccaaccagtaccagtctgtggcctgttaggaaytgggcttgtacagcaggagctgagcagctggrgagtgagcaaagtttcatctgtattgacagctgcyccccatcgctcacatacattaccacctgagctcaacctcctgtcagatcagcagtggcattagattctcataggagcaagaaccctattgtgaactgcatgtgtgagggatctaggttgcgcactccttatgagaatctaatgcctgatgatcggtcactgtctcccatcacccccacatgggactgtctagttgcgggaaaacaagctcagggctcccactgattctaccttataatgaattgtataatccttttgttatatattacaatgtaataataatagaaataaagtgcacaataaatgtaatgcgcttgaatcatcccaaaaccatcccctgcttcactggtccatgtcttccacaaaaccggtccctggtgccaaaaaggttggggaccactgtttaccaggatgcatagcatgggtttatgaattccctatctttgcagcacatcctttatttctggcttgcatgggacttgaaagcctaaaacaactaaatgctaagaaaaattatttttaaaatkatgacaaaaatattttctatttcagatgtatagatctgcaatccagaaactatgaatttttttcagttgagtagtctgtttgccaaaaaataaaaaaaaataaaaaataaaaacttgcctaagtktcttctcttacattttatttaggatttgccctyagacattatttagtgcttttctgaccctgtagggamggtgagaataattgaaacactagtttcttaaaatttctgttaaaattggttaaaggccatagaattttttttttaagctaagcatgttatagagaggtatcctataagaagcaaggggcaggtaaagmctttagagatgtatagtccagtgtgttaattaaaggatactacctacttctaattcggtatgtattaatcttttctgatatatctgttaaagtactcttcgcatatttttaaaaaaytggcattttaaagtatagtctttgatggtagaaatgtgagattgacaaaaatcatgtcctcttatgtatgaatttagtcttacacagttcttcatatgwtggaatctaaaacaaatgtagtcytgaaaacttttagtctactttggttacatgtgtttattattgctcaccttatagattaacagcagaaaagtataaattttaatatttctacctttctggcttgaggtctacagcattaatttctgaccagttaatgcaaactgagattcctattgtcctaagaaaatctgggaagttagtaacacaaacacatcttttgatttatttcaggaccacataaacccattttgaattattcaaccattgctgaacttcttgagtatgtataattaagagttgactataattggaatgttcttaagactttaagttgattataaaattttgtgcttaaagttggcaataatcaaaacaaaacaaacaaacaaaaaaaaccctttattttraaacacagtcttgctctgtcacccaggctggaatgcagtgatgacatcatacttcattagascgtcaatattccaggctcaagcaatcctcccacctcaacctcccgagtagttgggactacaagcgcatgccaccatgcttggctaatttttttttagtagagacagtgtctgtccatgttgcccaggctgrtctcaaacttctggactcaagtgatcctcctgcctcagcttcccaaaatactggcattataggcataagccaccatccctggccaaaaaataattctgaaacagcaaggaggaaggcggtttcttcttgggaagtcttgattttagttgagcatgtagagggatcacttgacttattaaccacttaggattgcacagtaagataatttaaagggtagccagcactggagtgggcctgggaaggggatgggcagtttgtgttagtgtgygtgggtccaagataaaaatgttgggtagcagagttttgcctaatgcattgtcgctaaaagggatgaagggcatcgggatctacaggagatggaaaaagtagtgacaggatagtagtgggaaaaactaggatcggatcaaggcactggaaggcagaaatattgagtagaatgtttgctgcaatttatgtttctgtataaataccgagtacaaagtttcacttgggtggtcaaggtgctatggctgtgacaactcctgagagtgggttttctggttaaaaaaaaaaaaaaatctctgaatgcacggagtcgtctcaggccttctcaaatttgcaaagaacaggtccacaagacctacattycccaagataattgcagtagtgtgacctgataattaacattttttgctttcctgctggaacattcctggggcccagagactgggccaagcatttccagtccaaagactgggaactgaaccaagcatttcctttagattgttcaagttgtgaaggttgatgttattagcttggttactacttggagtcttagctcatagtgtgtctttatggctttctgcctcactggaccctcttcccaaaaggctttagaatgtgttcaccatcatgagctgaccaacaatttctaaattcctactcagaaacacagcaaggggaatgcagtcaagcacaaagggyttaaatgamcagataaggctgsgctggatgaataaagaggaatatcctatgaatgtgactgtgtagttttagagtatccckattcaactgttatatttgacttgtggccttgtagacagtgtgttaatgtcagatcttctttttcagaactgttttaatcatggacaaacaaagtaagtaatttattttaaatgtttactttcctccttataatgttaatctgttggtaacttgttatttgtcataatgttttattcagtgtctgaaagtgtataatttgttttctgttgtttatgctccagaatacaatgtctagttcagtattttgactatagagaagatgtacaaaaatagcactatcactaggttcttcattaaaaatamgaaagccttttggaaagctaagaaatgctagatttattgggaaatatgttctgtaacatatatttaaaccacaacaatattctctttgtgtattttatatgtataaagattattcaagtcatactaattaacagataataagatttgagttcattgtaataaactcctcagatacacacctcaatgtatatttcatcacagacacatgtttgtattttaagtaaataccagtcattatgttctggctttttttctctcaagaaaattctaagtaagatggatatttatcaagcaagtaataaaagactgtcttattaagatatcaaggttctgaagaacagagggaaaattatgttcaaaattcccactacatagggaaaattaaattcaaaaattaaatcctgtttttctgaaacgcttttctttattctctctttcatctttgttgaggtaacaaaaaaatatttatctgtcactacagtgtcacccttattagatatatgaaataatctccaggactrgactccttgcttttcccatgtgaagttttatgattttctttttacttacaaaactcaaagctttttaaatgtaaatttatatagaattatactggtttatttgccacagactttaagttgattccactcaatttacaaaaatgtatctggtgatggtcataggcaacttttaactcttcagttttgtatatataattgtatgtatgtatgaatgtatttgcataaatagaaataaaatgtgtatatgtgtgtgaataaatgtgtaaatatgtatatatacatacatgtagacataaaaaaaagtacctttaagacaatgtgatagacttgtacttcttataagccattttaagttgcatttcaaaaacgcagtaatcaaaccataattaacatgctctttgttctgcttgaacacctgcccattcactcattctccttgtatgaattccccctggaatgcctgaaatcagaatcattgctttggtaccaaaagcccagagattgtgagctcatgatttcttgagtctgtctgttcctgtatatgtgtgtgtgtgtgtgttctatgttatagtattcaaacaatgttgcttattaagaggtatcacaatgtgacatacctgtcaagggtagatctttacttcagacttgcaaaatattttcttgaaatctattctgagtctgatgctgtgtttccaacttaatttgggagtaggggctgcaggcagggccttattagctagagaactagggagttaggtcagtcacttgatgctgagaaatagaagagaatggatgggaaagaatgatggggagtttcagagatttgtgatgattcacaaatcacaaggtatgttgcaatgttygtccagggaaaagtcctcatttgttttttgttgttgttttgtgttatttatttatttatttatttatttgagatggagtctcgctctgtcgcccaggctggagtgcagtggcacgatctcggctcactgcaacctccgcctcccgggtttaagtgattctcctgcctcagcctcctgagttgctgggactacaggcgcgtgccaccatgcctggctaatttttgtatttttagtagagatggggtttcattttgttggccaggctagtcttgaasgagtaggagagcggtttttttgcctgattttacacaatcaccatggactggattccgctgaagtcatcatgaagctatttatgaaggagaaaggccggggcagggggtgggggaaacaatccaatcttcctgataaaaccacacgattcacaagttgagtggtctttgaaagttcataatagagacacatacagaaaaatgtgttacagtgaaagtttgacctatatgttcttctatattgatgccatgtctccatgattctaaaacaaaagactttgaatttacagttagtaattcataaggaaacagataaggagataagtgtagtgtctactgcaccttaagctgtatgaaagcagagccattgtagccacagagcctaattcaagggtgacacaggacatgctcagtaaatatttagagactggctgcggtaggtaaccgaatgactagatagacatgaatattaatatttaggaggttgaaccatttgtgcatatattaagtttactcaagccttattagcaaataacaaagtttaatatgctagtgtattgwwattaaacatggcttttgtgggtcaaaaacagtcatatttggggaatttcatatggttcaacttcattggtgtagttccagagtaagcataacatatataaatactgaagtatattcattattttaaatatttaaaataatacttayagcaatgatgatagatatctttaaaatcatccataattctaccatcttcacatcccattaatttcatttatctctttcttsgtagtctgtatgtaattttaaagctatctttgttttattatcaacaaaacatggaactgaacattcatcagggatgtttcaaaaactggtaattcagccccagtaacttaactgtctcattttatctaaaggaraatttgtttgaaacaaatttgctagttgcaaattagctctgagaacaggcacagcttacgttaagtgaaaattttactttccctatttcaatacagcataagamcayacaagttacaattatctaagtacaatacattgtttctttctaatatatattttatttaatcagacatctatttacctctccttgaattgcagactcacagatgaatgcttctcacccggaaacaaacttgccagttgggtatcctcctcagtatccaccgacagcattccaaggtaaagcagttgctgaaagaagaaaaagtaaaattaattgagagacagagagagagagtgagagtgggagagagagagtaagagagagagagaattgtgcatttgtttttattttagtagttctttttttaaaattatattaatgaaattttggcagcctagttgttcttgattatttttatttggctatcattttgcacagaagtaatttttatttatagaggacagtaaaggtataaagaaagctagtaaaaacaacattaggtttacatttagcaaatgaaatacaagactgtacatcctaaaatacaaatgttaagtaaaatattttattgatcctccatctgttctgaaaattatgatcatttaatcacatttaggaaatttatttctgataaactgagtcatgtagtagcttggcatgtgttcagtgagagtcacatcaaaatagtaagactgcttaaaactgaaagtaatagaaattcagttacctgggaataattctcattttaattttataatgtatatgaaagctttatttttatatatatgctgattccaccctgtatttctaagaaaagtaattgagtcatttgactacatacataattgagtacattttttcttttcaaccaatgcctgaaagaattcagagattttcatttaggcaaatgcagttatcaaaactactagaactttaaaaatagcaaagtccatggcatgtccagatttacaagcagacaggctacccacatcttgaaagagcatcctgaggatttaggaccaaagggaatgtggtttggatagaaggatgtacccactgtgttttcttctctgagtaaacaaatgtgcttaggagstgaatgtcatgtttaattgcctagcaagaaacctccctgcgggtcccggatctcatccagatgtttgcaactgaaagaatatgagctagataagctcagactctcaagtggtggctcatggcaaccttgtctgcactgaagtatcatcacccagaagcacttaaaaatagtagtgcaaaggcactattccagaaaaattaaatcatagcttccagtggtgggactcaaggaatagtaatcttttaacaccccaagtgattctaaggtgaagccagggttgagaacatctgctctaaattcttatagggttggtgtttgaaaaatcattagtaagtctataatattcatccaaggcacttaagagaatgatttaatccaccctatcactaattaaaagtagatatacataaataatacagttcagatataatcagacttgagagtttgtttatatatatagatatatatggctctacagcttgattttgtttctcaagtccaagattacatatagcacaagtcttaagataacgatgctaagagtaaggataatttaaaattgagatcttaccatgctttagtcattgttttaaatgtggagttaatgtggactaacacttttaattcttagaatactcttatgaggtaaatactgtcagttatccccattatgtatgtgggaaagctgaggcataggaagtttgtatcaggcttcaagttctgcctactttaaaaaaaaaattcgtataggtaaatgtgctggtaaaccaggttctgccttctgtactaatagttatgtggtagtttaarcaagttgcagtacctcaaagcctcagagttcctatctataaataagggtgatattttcaatgtaggttgctttgtagagtaaatgagagtatatgtaaaacactgagcacaatgcttgcaaattataaatgacaagtatttgctaacatatttaaaatattttaaatcaattagtctttacataaatgatactagtattcaaatttcaggtaattctttatgcttaattcattgatttgaggagtaatccatcatactttcagagtctggggaaaattatgatgatgttaaaaatgtaagaaattaactcacatctccatatccccactggtctgcctatggtctggtttctgtgctgaccccagtgatctttaaaaatgtaaatctgctcatattacagagagtgtagagcccctattttattagtggcctattacttttaggataaaggctaacactaaactcaggatggccttttccatgctctctctttaacttcctcttgagcctggcttgctgttattcagctagactggctatttttcagatttttaaaggcctatgttagttactgtcccaggacgttgctctgaaatgttctttctgtgactctggcctcctgaactcctgtgcatccttcagatctcagcataaaggtgacccctcarggcagctgttcctgctccttccctttttctcttcccatctcaatagcgacctttggcatctctagtcataaaaccgtggtctcttacttgaaagcatttatctccaattctaatgaatcaattaattacactggtattatagctccctagaataagtggggatataaagttgtctctctcattaaacaatgatgggcagggattgcatctgtgttttccattgtaaattctaatgcttttccactcctgaaaattttgtaagatatagataagaccatggaactcattcttctgcttaaattcctccagtacttgccaatcataattggaaccaaatccagactccttactaaggcctcctttgatgaacagcttcctgttgctttgctaacagcctttcctagtcgtcttctttcttatgacattcctctctcttttacgcctgtcaaattcattacaaagtcagaggtattctatttgcctttctttcctcctgaagcatttatcactaatcttcatataaagcttttctcttctcatcttttagaccttgatataaattatatttacccaaagtaactgcctcataccctgccctcgctcgcatacattctctccatcacatccatatgaattttttttgttttaaatgtgttttctttctcccagaagttgactgtaagctctctgacagcaggctgcctccttgagaattgtatcctcatattctacaacacagccagtcacattatgatcatttgtaaatattcattcatcataaaggaataaattataaaagctatatttatgatgcattattgtgaggtttattctgtttttctaagccttatttttgaagggcaaatgaattttatcataaatgatccatttaaaagaatttgtaaatttcctattctaagtattacattttgcataggctttaatgttaaaatattgagaaacacagtcctttgaaattgtattccactgctatggaattgctacactgtggaccatacaaacaggtatataaatcttcattgtaatcacacattcgcagagaatatgaagtacatttactgttattaaatttctgcctcttacaattttttgccatccttgtttctcaaattatattttccagagaccaaaggatgttaaattgtgaaatttaaatttctaacctaaatattataatagaattttattttaatgaagaaggacttaggaaagcaatacattatggattaaaacataaggcaaaggattaacccaagcaggcatctggaatgtactaaaagaaatgaygtgtactaaacgaatgggcgcggtggctcacgcctgtaatcccagcactttgggaagctgaggtgggcagatcacgaggtcaggagatcgagaccatcctggctaacacactgaaaccccgtctctrctaaaaaatacaaaaaattagctgggcgtggtggtgggcgcctgtagttccagctacttaggaggctgaggcaggagaatggtgtgaacccaggaggtggagcttgcagtgagcagagatgatgccaccgcactccagcctgggcgacagagcaagactctgtctcaaaaaaaaaaaaaatggaaagaaagaaatgaygtgctttcaccttcaacagtggcactataatattttgggctggacaattcttcatttttagggagctgttctggctcttttaagatgtgtagcagcagccctggcctctacccaccagatgcagtattatcttcccctccagttgtgaccaaaaaaagtctgcagatcttgtcaaatatccctggcagagagggggcaaaactacccccagttctatacatatattataaggcatttgctagaatttcagaattatcatttttcacaagatactttggccctagaaatgctgactcaaagccattattttgggccttctaccaatgacgtgtttgtttcccttgaaggcttgccagaatctttatgtaggtgactctagatcatggttatttaytttcattttctcagatattaaagcatattttcyttctgagttttgaatggtaagggtaaggctattcaccgcatactatcatccaaatagaagtggatgtgcaaccacagatatttcattgaaaaatctcagaaagagaaaagcrtattaaacatcacagatacagatgtctacgctgaaatgtcaacttatagatagatggcataaccctaaaaaggttgacaattccatttttggtgcagttacaaatcatttcacttgtttgtatttcaggacctccaggatatagtggctaccctgggccccaggtcagctacccacccccaccagccggccattcaggtcctggcccagctggctttcctgtcccaaatcagccagtgtataatcagccagtatataatcagccagttggagctgcaggggtaccatggatgccagcgccacagcctccattaaactgtccacctggattagaatatttaagtcaggtaatttcaaagacacaaaatactcataaaaaacagaactgtgcttccagcttgcttaaccagattagcaaatgaataattcaccaaagtctgaaatagcaaaactgtatttyctgctaacagattactctaattcttctaggtctggttcaattttaaagcaaaatacaaatgccttagaaaattgtattttctgttatcttaaatacaatctatgataatggccaatagcaaacatttaattagcactgtttcctgcctttgttgtatgcctgatacatgtattaactcatttaawccttattgaaagtctgtgatgtataggtgctacatttttcaaaagaagaaacwgaggtccagagaggttatatagctcactctggggtgagaacctaaagagtcaagactgtttttttaatcccgaaactttggtactgagcgaagtgctctttagtctcaatactgaataattgccttataatttggaagaaaatttaaataaagtttattgttgagtttcaataagtggccccaaacaaggggttaatattttatgtrtaatatgactcacctttttattgtaactaataaaactgcatttttatgatgctgcttttgttctttggaagacctaattttataaatgccattaataaaggagtaaaaagtcctggattttgttgcactaaattataattaatctcagcaataagaggtttaacatttaattggtgttagaaatcaggtaggtcaaatagaaacaagaaactctgtgtgtccagtctatacacatacaaatattcttgtgatattcaaccagttttcatttcataaatcatttctttcttgcactctctttagtaacttaatttmccacaatgtgcttaagtggcayaatcataggaatttttggtcattattatattatgcaagaaatacatagaaatagatattttaaaaatcagagtctcataaaatacataaaggatgttatcacatatgacaaaggttgatattaagtatgcttaatacaaatctgaaacttgtaaaaaaaaatctctttgatggctaaaaaagttaccaatatttcttcagcctattctagaaggaagattgttttctaccttttgaattgtttttgacacataataattgtgcatatttatggagtacagtctggcattttaatgcacatgtactacgtgtaatgaaaaataaggataattagcatatctgtcacttttaatatttatcatttcttagtgttgagaacattccaaatcctctcttctagctatttgaaaatatacaataaattattgttaattatagtcagcctacatagctatagaacactagaatttattcctcctatctagctgtaattttgtattcattaaccaacttctctttatacctctcctccctacccttcacagtttctagtaaccactattctagtatctacttttttttttagatggagtctcatcctgtcacccaggctggagtgcaatggcacgatctcggctcactgcaacctccgcctcccgggttcaagctattctcttgcctcagcctcccaagtagctgggctacaggctcctgccaccacacccagctcatttttgtatttttagtagagacggtttcaccatactggccaggctggtcttgaactcctgaacttgtgatccgcctgccttggcctcccaaaatgctgggattacagtcgtgaaccactgcgcctggcctctactctctacttctaagaaatcaatttttttaagcttccatgtatgagtgagaacattcagtatttttctttctgtgcctggcttatttcacttaacataatgtcccttaggctcatccatgttgctgccaatgacaggatttcattcatttttatggctgatttttattccattgtgtgtattaagaatgaatttttctttattcatttatctattgatgaatacttaggttgattctatatattgactgttagtgctgcaataagcatgagattgcagatacctctgacatattgatttcctttcctttaaaatttttgttttgaaaattttgaaaaaatactgtttcaaaaaaaacagtagtgggattgctgaatcatatggtggctgtaattttaatttttgaggaaccgctacactgttctccataatggctgctctaatttactttcccaccaacagatttccccttctccacatttttaccattatttgttattttttgtctttttgataaaaattcttaactgtacaaagataatatctcattgtggtttggatttcatttccctggtgattagtgatgttgagcattttttcataaacttactggccattttgtatcaattttcttttcttttttttttctttctttttttttttttttttttttgagatggagtctcacgcttgttgcccaggctggagtgcagtagcgcgatctcggctcactgcaacatctgcckcctgggttcaggcgattctcctgcctgagcctcccaagtagctgggactacaggcacctgccaccacacccagctcattttttgtatttttagtagagacagggtttcaccatgtcagccaggatggtctcgatctcctgacctcgtgatctgcccactttggcctcccaaagtgctgggattacaggcatgagccacctcaattgtctaatttttaaaggtactccagtataratcaattttatttgacctaaatttttccacattaataatgaacacaataaatattttattaattaaaaatattaacttcagttttacactaaaaagtaatataagctgttaaatattgataattggttacatgtactttaaaaatataaatacatgaattttaatttggttagcttataaaaaccttcatttgacatatacataccacttattttttttcctgctatagatagatcagatactgattcatcagcaaattgaacttctggaaggtatgtattcattgttttaatcmtgtttctataaagagtagaagtttatgcagataaaggcacattgacctccacaaatataacactctcacttatataggacagttaaaccagttatttacaataataaatgttatcagcaattcatttctaaaatttaggaatcaaaaggtaaaatgctgttatgttgggcacctgccctcgggatattgacactaacttagaaggaaaataatcaaaacccttattttgctcctctcttcatacatcactttttttctgacttctaccacttaagctattttctccgtaattgtgatcagcttaagaatggcacagagccacattccaaagtaagttatcttttttatttggatgaggaagtttgggaaaattatcatttgtgcccacagtttctcttgggagttaaratgaaccctataaaacctttgtatacgaggtcagatgcagrccactgcagtgtgggaggatgctgaccaactagcstgcaggcttggcttcatagaagagcactcctgctcctgctgaatggcctgacatttccttgggtccagggctccttaggtgcaaaaataaacctaggaagccaattaatgttttataatggctgccaggggaagaagaccctggatagatttatgaaccatagtgttttccttctagataaaaaaggtttaataaaaaataaaactctccagtttttaggaatatgtctgctaaattcattttcacctgtctccaaagtttctttccactggtaaaaattagaagatgaattgtataagcagaataatggatttggctaaaatatacaattgtcatctattacattgaagttatttgtaaagcacattattatttataagttacttgattttttttttagtgtatctaaacaaagctttctctggaagacagctttgtattctgaattttttaatgttttatagtatatattagtaaggctataaaatccaaacagacatataaccaaacattacacagcacactatttatctttttttgtagatttataggctttataaatatttgttaaatatgtgttaattatgaaatagaaagttccaaatctaacagtttttaattatgcttatttttcaaaaaagaaatgtctccagttttttttttgtttctttttctccaaaattgaaagtctatgttattttttcatgagtggtataaaaaagatgaagattactcaggtttttagaatctgagcataaactaggcacttacttttttttctcaattcaaaacacagaagacaataaaaatataaacaatttgtttacatttttaaagtaaatgaaaagaaacttaaaggttatgtaaaccaatgttgttttacaaataagctggagatttttgagattaagctacttaatgtaacaattaattagataatgaatgtcctctcaaaatcagcttaacttttttctcatcaaacatttgactatttcagatgttgaaatcagacgttgttcctataaatgcagagtacagggtctgtctgtgtcccaccaaggacacttaaaggagttcatggtggtaagacttgtgaaggccgtctttatccgactcagagtctttccacataggcattatagagygacttttcctccatatatttattttaatcactcattattttagccaggcttctgacatctatgaccccagttactgaggactatgtacaaatgggacagttattgctcctttctggctttaaatatggagaggtttccaatgtatggttagatatggaaagcccttgatacaaagtatgtgagtgtcagcattttgcagccatctgtttccctcatgaagatagattagcccagcaaaggtgcagagttcacttaggattcccayggtctagatattctgtgagttgaagccttggttgccgaacacgtttgtctaatacccacctcccacttctgaacaactactgttgagttgaataaggatgccctgggtccaatgtgacattctaattcatctttcatttttactccctcggtttttatgcgtgtacattgccttctttcaaaagcattgcaaaaaaataagacataagtaaggtttataagacagtctcaaaccaattgatttaatataaaatttcatagcacataaacagcaatcctcttatattcccctccacattacacataaactatcctgcattagtggacattttatctatacacctagcaccaccgtgcccacccacagcattgccccaactctcagcagaaaagtctctcttctgacagacatttatggaattaggaaaatataacttgtttccagtgtctcacataatgaagggatgggttgcccctccacacttgtgggtgtttcttgttaggcggaacgagagacttggaaaagaaaagacacagagacaaagtatagagaaagaaaaatgggcccaggggactggcattcagcatacggaggacccgcgccagcaccggcctctgagttcccttagtatttattgatcattatcgggcgtttcccggagagggggatgtggcaggacaataggataatagtggggagaaggtcagcatgtaaacaygtgaacaaatgtctctgcatcataaaaaggtaaagaaaaaggtgctgtgcttttgatgtgcatatamataaacatctcaatgccttaaagagcagtattgctgccagcacgtcccacctccagccctaaggcagttttcccctatctcagtagatggaatatacaattgggctttacacctagacgttccattgcccagggacgagcaggagacagataccttcctcttatctcaactgcaaagacgcgttccttcctcttttactaatccccctcagtgcagaccctttacgggtgtcggactggtggacggtcagrtctttcccttcccaggaggccatatttcagactatcacawggggagaaaccttggacaatacctggctttcctaggcagaggtccctgtggccttccacagtgttttgtgtccctgggtacttgagattagggagtggtgatgactcttaacaagcatgctgccttcaagcatttgtttaacaaagcacatcctgcacagcccttaatccatttaaccctaaattgacacagcacatgtttcagggagcacagggtggggggtagggttacagattaacagcatctcaaggcagaaaaatttttcttagtacagaacaaaatggagtctcttatgtctacttctttctacacagacatggtaacaatctgatctctcttttccccacggcataaggacttaatttctctatacattggtaatctctccttttttttgccatttttctctgtctggatcatctctaaacatcatttcttctcctccttatgccacttggggtatcatcaaaaactggcatagctagatattataatatctggataaattcaatatttttaacatagaggtgattatgatttcgtcttttatgtttttagttttaacaggttttgaaactaataacaaatatgaaattaagaacagctttggacagagggtttactttgcagcggaagatactgattgctgtacccgaaattgctgtgggccatctagaccttttaccttgaggattattgataatatgggtcaagaagtcataactctggagagaccactaagatgtagcagctgttgttgtccctgctgccttcaggaggtctgtgatcaattaccagggcactttgtaaaatagttcagcaagaatttctgccctgtcattgaacctttcatcgaacctaggcattatgattattacatttacatatattattttgcctttgtagatagaaatccaagctcctcctggtgtaccaataggttatgttattcagacttggcacccatgtctaccaaagtttacaattcaaaatgagaaaagagaggatgtactaaaaataagtggtccatgtgttgtgtgcagctgttgtggagatgttgattttgaggtaagagatgtcataatgtttataagatttgctttcctaatataagaagaatgtaattttgcaggacattataaatgcattaaataagtgttgtgtgccaatgtctcaatagcaagatgattttctcatttatttaactttgggcagagtggtagttatcactctgattaaaggtcactgttggtcatgagaaatggaaaaaaaagaagcagacctatgtagtcaaataaaaataagcaaatcatccctcacttaaacgtggtggtttctatgtgatgacactgtatattatccattttaaacagaacgttaaccttgccatctaagtctgattgccaaagcatatggatccttcttaaatctgaaatatcatctgccaatgctcaaggccaygttcagaatgtctgacatctttgaattcctacaagaagcccaattatgcaaagatagttttgagaaaattagtataatatgtactacccagttatgcttctctgtggtctctccttttccctatattaaattaggtcactagaagctgcaacatattaatatttgtatatttactgtaatacattgtagaatttcattagagtagctcttcaacaacagatggtctacttttacaatccaaattttttcattgcaaatgtttaaaaatcagaaggttttataacttaatcttgatttcttgtttctcttggaaaatcagaaaattgggttaactgggcccacctttccaacaaaagggtaaaaatctactaaagatgtgtggggctgccccttgtaataatgacatgggaactctaccactgtctccaccccttactgaggtttttcaatatccagtgtcattcatttatgtgatctgcctgccttctttaatcacatggtattttattcctccgtcagactttagctatataaagatgaatcctttcccccattgacttcataatctaatgacagagatttgcagttctaaggaggatgtgatatagaaactttaaaaaggctcttataaggggattatataatgtgtgtatgtatatgtgtgcataatatgcatgtataaaaattttatgtaagggtatgcataatagcagttcttcatgtaagggatggaatctctgtcctacatccagagaagtgaaaagtaatttctcattcaaggaacaatattaacagaagtttggctggcatatattttatttttagtaaataaatgaaaacactggaaaaacattgtgtaatccttgtatttgatactaaaaaatttatgtttcawctggcagtctttctygatggataccttaaagcatccattccatgtaataaattaacttttcttctatttatctagaatgatgatatcaaggtactctcatggaaagaattgagaaatagtcacttgaagaattttccatagagttgacaatggaaactttgacacctcaaagcagaaattatcagtatgagggaccactaaggaacatgaaatccaccagggtgtcactgggcatggaaacttgaagtaataaaagagataaaagcctgttccacagcaggggcaggagtcattctaaaacagagaataactcaagaggcatttcataggtgtactatgtggaactaattcatggatttgatatcaattgaggatgaaaaaaattttggagataaacttgatgtgttattattctgatattacattggccaagttaagaatcttggaggaaaaacacttgatttgtgtcctcttgaccattatgatagtctgctttttaaaaagtaaggtatcaaatactaatacacatctaggtcagggatcagcaaaatataatcaatgagctgtagttgattatataaaatatatatgggaagttaatgacttgaattaaggtcatgttggattttagttatgtataggaaaagaatggagagttttcagcaaacagayrgtaattgaatctctaagaaggttatcttaatggtgagtaagagagagcctagtagaccttttatccaatataggtgataagagagtctgtctccttcaaggactcttggtagggggaaaaaatatggccacatgaaactgacataccaagtcagctctgtctatgagcttgaaatctgaattcctgccactgttgtgtttcaggaatctcaaaatatagaaactgatcctgagtagtgataaattttatatggtcaactatagcccacagattttttttcctgccctctcaactagattttcattagtattcaataaatatgtttttaaaaagcagacaatcctaatggtcaagagtatagacactggagccagatgcccaggtttgaaacccatcttcacaacacttatctatgtgactttaacaaattctttcacttctctttgctttagtttttttacatgaaaattgggtgtaatamcagtaaataaataaatcattagtaagtaaataaaatagcttaccagcaactattaatatactcatgatacactttttatatttctttgctacatacctagatcctatatgctgtcattatatttcagtattttgcatttatatttgcattgtgagatgaatctatggttttctttttagaatgcttttaccaattagtattgcactcatggatttgaaagtttaacattatacaataccaatttattatttccaaatgttgacattttattatagtgattttctattccaaaatgtctacaatttagctaaaaattatctagtcctgctaatttattggttgaagatcattatttgcatttcttatccttgccataaaaaatgtattctctactttgttaaatttcttgctgtagtaatcaaaaagggcaaatgttaatatctttatctgtatagtgttgagtttacggtggctagtaagttgtcagctgcatttttcatttttttaaatttcagaattaaaaaataaaacataagagttttcattactagcttcaaatgcttcaatgacagctattagcagaaaaatactaacatgtacaagaaaggatttgtattagtttatttcaccacagtagtatttcattacacataatccctaaaactcagcagcttgcaataagtgtttatactcatgcttatgggtgtgtaggtcaactgtgtttcagyggatgtatttaagcactgacttaggcgcatgttaacctcaatctgctccaggtagatttgttctatggctgtagcagcagcagctacctgagtcatgcttttctagtggcttgtcactgaagatcataagccaggccaaagcacttagccaagtttaaggacactactcrtgtcatatctgctaacacccgttgttcaaacaagtaacatggccaagcctaattatgaaggaacagkaagtatactggccctacagaaggagagggaatgaaatgaatattygatgaacagtattatgctatcagcttcatattagatgtttatttctagtattttacaaactatccacttgtactcaaataaaatgagtcaagtatttttagattccccacatttatttagctgaaaaggacactcctctgttaatacaactatatgtgtacatagttttgtgaatttcagctacattcagtccccacctgccctcctagaggagttgccttagtctgagcaaagtccattcaaccctatatgatggccctgggctttcctcaggcagaattgtaaaattaggaaacttctacttcggagctcatttgttcatacactcttcatcttttattcacaccccactagttatccactctcaacctcaacccttggcgtggggcatttcatcaagttacttattggtatttgcctttactccaaactgctaatcttttctaggtgcttagcatttcatgtttggcaactcacagtgggtrgtaataagccttttcatcatatttaatctttcagtctgtgtaaactgtgcttctcctaaagcagaagtctaataggagttttgttcattaacttcctgatggcttctagaaatgtcatcaaagaaacatttcatatttatatccttttttgcttaaattttcttttgggtcaattcaaataatttattaatgtctatattaatataaaatagaaattgttaaatatttcaggaaaactttctgaaatataatttctccgtacaatgaaacagtttttttcatatatctataaatagatacaggagcctccagttatctaatgagggttacatatggtgcataattttaataccatatttgtttcatcttacttcaaatttgaaagtacttttgctataagtttcctaaaagtatttaatacttttttttttcaatttagattaaatctcttgatgaacagtgtgtggttggcaaaatttccaagyactggactggaattttgagagaggcatttacagacgctgataactttggaatccarttccctttagaccttgatgttaaaatgaaagctgtaatgattggtgcctgtttcctcattgtaagtctgttcttattaatcttgattatagatgctttctctaggttcattctgaaatgattcagtaaagtgtatatttcaaaatgacattttaaaatttatagattttaaatcaggattcccatttaatcctagctctgaaattctatttgatcctgacactctggggtcacaggtgactagtttctacctgaagagtctatgaatattcacatggcaagagggggactaaggagatgtactaaggagagattttagtctccccttaaatcaggcatctcctagatgctttgaggaagaagttgaaagtaggcatatgtggaaaaaatttagtgaaacaaggaaactttaccatgactcatagtaattaaattaaaccatctaatataggagtatgaagtacaataagagtgtacattcactcaagtgtgtagacctaactaccaaattacaggaaataattggatataccagtgattctgaaattgccttcacattagaaccacytagggactttaaaaacyccaaggactagtccatacctcagttcaactaaatcagaaacttcgaagttcatatagtgttccaggtgattccagtatgcagccaaagatgagaattatggggatagagaaaaagtaacatttagagaaaatgactggaagattaattaaattcatacaggtatcaataaatgaatagaattatagaatttattattaaaatggaaagccaaaggcagaacttatataattatagagcttttgtatatttacttattacatttaatttttttaacagatttgttactgtgtttcactagatcccttagtatttctgcatctgataattgatctctgttttgttgttgaaaattcatttgtatacttttgtttttatctaggacttcatgttttttgaaagcactggcagccaggaacaaaaatcaggagtgtggtagtggattagtgaaagtctcctcaggaaatctgaagtctgtatattgattgagactatctaaactcatacctgtatgaattaagctgtaaggcctgtagctctggttgtatacttttgcttttcaaattatagtttatcttctgtataactgatttataaaggtttttgtacattttttaatactcattgtcaatttgagaaaaaggacatatgagtttttgcatttattaatgaaacttcctttgaaaaactgctttgaattatgatctctgattcattgtccattttactaccaaatattaactaaggccttattaatttttatataaattatatcttgtcctattaaatctagttacaatttatttcatgcataagagctaatgttattttgcaaatgccatatattcaaaaaagctcaaagataattttctttactattatgttcaaataatattcaatatgcatattatctttaaaaagttaaatgtttttttaatcttcaagaaatcatgctacacttaacttctcctagaagctaatctataccataatattttcatattcacaagatattaaattaccaattttcaaattattgttagtaaagaacaaaatgattctctcccaaagaaagacacattttaaatactccttcactctaaaactctggtattataacttttgaaagttaatatttctacatgaaatgtttagctcttacactctatccttcctagaaaatggtaattgagattactcagatattaattaaatacaatatcatatatatattcacagagtataaacctaaataatgatctattagattcaaatatttgaaataaaaacttgatttttttgtatatttgatttttgtttttaaacgaaatgtgttcagatggtattttgagcactcattcagttaaatgatggtacatttgaagcaggatatttccctgaccccttcacaggactcgagacaggggtgccttgtttactcagcctgccattctcaactcctcctgggagggagtgcacaggcaaacaaggcaggaactggagtgtacaagcactggaactggctggccgctttggcatgggcaggaacaaactgtgcaggccctgtggtagcatccaggtggggttgcctgcgattcctgaagccccagaagatgtgttaacagtgctcttttagctctgctgtctgtggacggcttaagtgttaacagctcagtgggccctttgccttgtcatgtgggacagctgccctccaccagcaagggcaaatggcgaatgtgagagccttttatatcggcactcatggctcccaggctcttgtccggtgtccaggaaaaatgtggtcacaaaaacaaactgaaggatggtaaatgagggggattttattgctgatgaaagtggctctcagtgagaaagggagctgaaaaggggacagtggggtaggtgatcttcccctgaagtctggccctgtccagctggattcttctctgaagttacactgtcaagctgtccctctgaagtcaagctgcttctctccaatgtccagccatagtctccactcctctctgactgagtcttgggtctttataggcacaggattgcaggcagggcgggccatgggcagtttaggaaaaggcaacattcaagtaggaaaacagggatataaattctcactttgggccggggtttcaggcatttcagcttgagggtagggttttcactggggactcacccttttctacctagaatttctctgcctcctgtctccatcatatttaactgacttttcctttcaaatctcctttaaaaatgagcaaaggtacatgacactttgtagtaaaatctgtaccagtgttggaaactaggatttccacctgtcagaagcttataagaatttagttaatctcttttgtaatgaagattgagttgaaagatgacatgaacaacccacaatattcttcatgcaatggaaaagtatgcttaagcaataagggcatgtggaagagtccctctttcatattcagcacaattcttgtaacagcagctctcctcatggtgttagtgccctagacctcaatagctccaaatggcaagcggtgagaacattagtatgcaggagatcttcaggaaaagtcaagtctagatgatctcccacaagtctaaacaattcaccagatgccaagttccagtgatgaggtgtacccatggaactcagagcatgtgcttggtacagatggcatgccaagaaaagtggaggtacttgcatagctgaatcccaatggcattgttatgccagttacagaagagggtgggcataggatttccaaactggccataatgtgccaaaactaacccaaaataaggcttagagtactgacattatctctgtgacagctaaattttactttcattatttctctctctctcaacaggattctggatctttggttaagcaaaatgaaactaaactgatctaaacatttctttcttcaactctgcaaagaagatctgagcaaaaccccacatatcttctgcagaacctatttaaatactagacaaatatcttctcattacataattacatacagaaaataatcacacatgaaaaattcgatatttaattaagaaaataccaggaattgtttttcaaagtttaatttgtaatctcaatgagatttgaggaaatgttgcatatttttttatttctaccatgtgagttataacagtgaatggaaagtcactgcgtgtccctgactagggaaaatattcaggaggaaaagctgcaatggatggcgcatggaggtatatttttgatcttgggaaggaagttctaggtaggtggtcagtgaggaagggggagaaggagggaggaagaaggaggggagggaggggaggaagacaagattaagggatgtcagtacctctcctatgtacctcttgggggagggttgaggagtgaggggagtgtaagtgaaagtagagacaaggctgggagaggaaaaaacaaaaagcaccagccacaggcaattaaattgccagaaagtcagtgtctgggctcccggcatcaagttagctagctactctatggataagtactaaagctttaattgcatttgggctcaaaaacaacaactgtaactttagggtaactagaaaagcctctgtagagaatcgctgccatcagttaagaatggaatgatttaaaatgtctctgggcacaatgaagtgctcctagagcttaaagtgccagaaaagtgtacagggtttccctccatgtcctgcctctctcctttactgtctctagcccagcatacaccgcctgagtttctagggccatgttcctgcacctggtactgtctccttcaagctgtgtgttcctccttgtgccttaatttcccttagttgtcaatagtatcgttgtcaattgattatgttatctacctcataaggtcagtatgaagattcagtgttctaatgcaggttcagagacctgagcaggttcctgcaatagaaccagtgtaaaaaatgaaaagggctatgtgttggtaaagatcaatggttttcagaacacagagaagtgtctcaaagccagtgaagaatatttggcctaaagtaaatttctgtattgtgatttgaatagcaagcaaaatccatttaaaccctagcaagaatactatctcctcaaaaaaaaaaaaaaaaaaagtccatgcaagatgccaagctagggaatgatgctcatctcacagaagtgtagattaagggaaattaaggcacagggaggaacagagtctctggcttctgtgttagagccttttttaatcttagctttatagtgtcaaaatgtggcaagctattttaagagaggaacaatagctgggcgcagtaactcatgcctgtaatcccagcactttgggaggccaagacaggtggatcacctgaggtcaggagttcaagaccagcctggccaaaatggtgaaaccctgtttctattaaaaatacaaaaattagctgggcatggtggcaggcatctgtaatcccagctactgggaaggatgaggcaggagaattgattgaacctgggaggcggaggttgcaatgagccgagattgcaccattgcactccagcctgggtgacaagagtgaaactgcttctcaagaaaaagaaaagagagagagagaggaacaataatctgggcccctgaaaccagatgaaacaactgacaatacagagtctgaactcatgatttacaaactgagagggccatggaatgataaggaacaagtacaactggtcacagagctctgcacttaacaaccctccacacacatacacacaccaagcattcaagttaaacgttaacctactgttaatgtttatatggtagaaaacatcagatttatgccaaaatgcagattataaatctacccacattgaattctgaatagatttggaaaattgatctgcttgcctactaagtacaatttgtttctgcctgtggattctgggggttttccatcattaacacattgaggttattctgtctggcagtgatagggaacaaacattggcctatttatttcagcaaaggagttagttgctaggaaacatttcaactttagtcaggtattgccaatagactgcaaccacctgaaaatatcttagagaaattctcggttatattgactttacagagttaattagatcttagtctaccacccggtccactcgggcttctataccaaaacaccttagacagggacagtgtaattataaaggactaaaatttgttaattatagttcacgaagctgagaagtccaagatcaagtcaccaacagattctggtgtctagtgagggctgctctctgtttctaagatggcaccctgttgctgcattctcacatggcggaaggcagaaggtcaacagggacccaaccgagcccttttaaaaggtcaccaatccaattcatgagaatggtgccttcatgacttaatcacatcctaaaggccccatatctgaatactgtcaaaatgggtcttagtttccaacaaatgaatttgggggcacacatacctttaaaccatggctcctactaagcacatttctgttaaatcatactgcctgaattctttccccgttattgcaagtcacaagcagaagataatttactcgcaaaattattttttttgcaaatctatttcagtttttatgaataaagacagattcactcaaataattcacataaatgtatttgtaaacgttatacctgaggaggaaatgaatataaaaaaaaaaagttgattgatttaagggcactgaaactgctcatcaattatttaacaagtacatacggagcttctacactgggccagtagttacgctaggtacgatggtctcaataagcaacaaaaattattttctacaagatgcttaaggtcaattatacatatggaatgtttgattataggatccagagtactatggagaggggtagtagggacactgaactcagttttaatggtcaggaaattaggggaagtaacttttaaactaagaaagtttgctggacaaaaggcaagtgagattatttcaggcaaaggaaagaacataaacagaagtcacctcaggggtctgaaatgtggctaggccactggttttgtgttccttcgtgagtgaaagacatgcagggggtaggacatctaaagagtggttagatcatacagtgccttagccacattaagaagttcaggttggggccagacatggtggttgacaccagtaatcccaccactttgagaggctgaggtgggaggaggtaggaaagatcaagtgtcctttcctacacatagttctctctcagtctctaggaatcaggtggtggacttctctaaagctgcacttttttttttttttttcccaagcagcatggcttgcctgattgttctctaggaactagtctagccttttcagatgagaaagttactttgtctacacagaagttttctcatggtgatttggtatctccctcatcaccaaaacctggatacatggtagatggcctaaaattgttgaattatctatctttcaaatttacagtgtgaatcgatttacgtttcaggtcctgaaagctatcaaaataaccaaagtccatttatctgaggagatggtattaataattagttgtgtaagtaaaaaagtcaataaaagatgaagcatatctgtaaaaaagatgaatatatttaaaataaattaagggtgaattttattattttgttattattatcatatcatttatttatttatcaatcttttaagtaggggcaagggccaagtgtgggtctactattctgcactgtctttcttctataaaaatacacagtttatttttgtttcaatagagccagaattctaagacactttcaaaggtatcttagtgtagaccagtcaatttttaccatgatttttcagtcattcatatttggctcaccctttactaactcagtagcaatcaactttactgagtagacttaataagcattttaaaggaattcagattaacttacatagaaacaatcttttatattaatatttaatcaaagcaagtaaaaatatttactttctgtaactacaataatcttttgtataaactgatttacaaataaatacaaatcacttttagttggtgtagaacttttgagagagtagacgtaccctagaactagagagtcaatagggaccctcttaatgtaatagtcaagtgtattcagcataatttgagctaataattaggttttacagagagaataggaaatgtcaacccaaggagttgggtaaattaagatcag

SEQ ID NO: 17583 - DNA, 56698 bp, Homo sapiens
ctgacagagtagaagtcaatatacgtttgcttcacaaataaatgacaactttcatgataaaaggttcatatgtctgcagatttcacagttttgaagagattttcagtaatattcagacatttatacaaagaacttaaatgatttccaaggtcacagtttcttaataataagcatggctctagaacttaggcctacttactcctaatacagtgtgcttagctatatttttaaatatcaaaatgcatatactatgagcataaattttatgggtcaattaaaaatttcctaacatattattagatggtatctgtctttaagcttataatatattttccttctagggttaatgctggaatcacacacaagtcaagggagaatccagttgaccactgaaatttcaattttcagtgtaaaatgaagaggttatctctgatgtgtgcttgctaaacaccttagagatctagatttctgactatatatttgtatgtctttattttggtcaaaatttaaagcacattatgcaatccctgtaaaataagcccttggtgcttgagtattatactagtttatctttcataaattaagctaaacaatctgaatgctgcctttggtggccaaattattctgctgtaacatgatcaattatctatattgaataattgaactcttcaagaaataagtgacacatccctttacaaatgtagtgaccagcctgggcaacatagtgagacccccatctctccaaaaaaaaaaaaaaatagctggatgtggtggcatattcttgtagtcccagcttctagggaggctaagacaggagaatttcttgagcccaggaggtcgaggctgcagtgagccatggtcacaccactgcactccagcctgggcaacagaacaagaccatgtctcaaaaaaaaaaaaaattacctatatcttgcgaagtttccattctgttctgacttaactgtgcatgccctattggtatatatgaacattttcaaagaaaacttttcagtgactgacatctgaggaacaaatctgtgtctcaaactatgtttgaagtgatatcctttcactagtagtcttttaaaatactaaatatcaaatttagttctaagagattacataattcatttttataacttagatcagtaattctcaaatagaaatatagcagtgtctctgagggagagagagaacattataagatattaaatttattaaagggtacataagctggaaaaggttgagagagcttgtcacaaagaaaaattatctggacacccctggagatcttacatcaaatggaaaaaaggaagttcacaaaagttaattgattttaacaacataaatgaaatctagaacaaattaattttaatgactattttcaaagaatgattaatttgttaattatgaattctaaaactagaagttggcatatgtatggaataatatggacaatattggactgagggcaagagagagctgagttcaagtcagttctctgctattaaataatggagtccttcattgttctgaatttgtgttttcttatgtgaatatgaagggactagcctagatgattgctaaatgaccttaaagttctacccaattcttgtttttttttttgtaaaagcattttatagcccccacacacactaaaaatagcacatagtacatatgtagagggataatagctacaattgttttcataactagaacttaagtccctgactatggcagacagactaggagatcatgcatttttttttttttttgacacctagtttcactttgtctccaggctggagggcaatggctcaatctcggctcactgcaacatccgcctcctggattcaagcaattctcctgcctcagcctcccgagtagctgggactacaggtgcacaccaccatgcccagctaatttttgtatttttggtacagacggggtttcaccatgttggccaggatggtctcgatctcttgaccttgtgatccacccgccttggcctcccaaagtgctgggattacaggcatgagccattgcgcccagccggagatcacgcatcttaaccaagtctatatatcagaatcacttgtgaaccatcatcctcttggaaaatcttatttgaacatctctcccagtgatttttgacatctatctctggttttaaagactacagttctagactgtctcttgacaaaacgtttctttgggttgcaaaaatctatgctaacatgggaaacaaatgcaaaatcataattaatttcaaaatagatcatttctttcctacccatttgtggataaacacaatctctcttatttttgattctcactggatcagagctgatcagaccttagatatttaactttttttcttgaacccatgacagtagaagatcaggtaatagaaactcagttggcattgagatacagtatgtataaataaagaggaacacacatatgtattttaagttatatatgtatatatgttatatacatatttgcatatatttcatacctcatatcttctgtttgctcctccaaatccacttgccaccctttccaccattttcctccctgttttctgctgcgggagactgacctgaatgaactataatagttcccatgccctctggccaataggtagctctggtaggacatcataaaaagggagaagaatgaattcagtttattatgctcccggatcactcctggcaaagtcgtcttcaactggctgtgtcctttgaccaggtctccagttggtaagctctttatggcacgctttgctttcaagttctgataagtgttcccttcccttatcccttgaaggatggtaaaagctctgatgcaattgaccccagtttgtcacactagttcttgtggcttctctgcctttacactttataaatagacccttgtaaataaatcctcctgaaattatcttatttgagcatgccatctatttcctatttactgggttcctgactgatactgttttttatgttaatggtgcctttgagaatatttgattaataccaaaaattatggaatgcatggagacttgagctttagtttgtaaaaaaaaaaaaaaaaaaaaaaaagaaggaaagaaaaagctttaattcttctaaaaacagtataccttagcagctgaagaagagtgtgataaattgtgttgaaattgaggtagtggtggatatgagaaaatgggacattggtctgatctgtgatatggaaataaagcaaggaaatgtgaattttaactgaatgcaaacaccaagtcacaaggctgaggctgttagtatttcttttcatgctccagagacacttgatctataatattgcattcatctgggggcagctcattaacagaaaaatacaggcaagctggaaggagttcatagaggagtaacaaaatggtaaaaagcactggaggattgacatgtgggaagagattaaaaagatgaaatcactctgctttagctaagtggtgactaagggggaacatgtcaactgtctacaattatgtgaaggttataaattccaaaagaaaggcagtgattactacaaatcaaggtagtgctctgtgtaaagagacacattaacaagggaaaagtttagatcaaataacaggaccattttctaatgtagagctatattatgtcttataaagctaagtgttacacactatagcctttgaaaaagacaaaaatgaaacaaattacaaatcatttcttaatgatatatatgaattctctgtagctagatagattacatatctatccatctatctgttgatataccttagaaatcagccttttacaaacatatatcggaattgaaatagtgactggtgctattactataggttttgtgctagacatttaacaagaatcttgtttaattttaaacattgtactttgacaattaaggcaactgtgggttagaacatctgagtaacattcggaaggtcatccagctagtaagcagcagagccaggaaatggacccaggggtcttcatttccattcctttgctaactaactcctggatagttaaaatatttcagtacattattatatcttaaattttcattatcccattatttacatggctatatgaactattttactaatttccataaagcattttgttgctgatttccttgactacatagcaatgtatttcaggtaccttgaaatatagctacttgtagtcatcaaatctgaaaggcacagacatttccgcagccattacccattcttgagcaatccatgtggtcaccacccattctagctatgtggatgagataaagctcaaataatttcatttctttatccttctagacactagtcacttataattttagaaaataatttctccatccactactttatgcaattcaaattacctaataagttataccatattaatgaggttttcatttgaaagaaattatgctattgggctctttataaaaagaaaaactaatcacctttcacacttcgtatattttttcagtttaattaatagatattttgaaagaaaaccatgctcatgtataatatttcaaacagtacagcagaccataaagtaaaatgaatagagcccccattcctctgccatctttaaattctgtggttagaagtaaatactgctaacattgtcttttgtatcctttcaggagttttctatgtacatatctgtacacattttcttttttatcacttagccatttatcttggttatctttccatattagcacataaagtgctactttatccttctaaaacattctattgtatgggttatttatccaatgctctttcgagagggacatttaacaggtttgtagagactgttaaacgcacaattctgttatgaacatagatctctatttatctttgtatactttcccatactgacagagcaaatttctagctggggcatttctcggtcaaattgtgtgcagttaaatttttataggtttttaccaaaatgaccatcccccaacttgggttttatgacataaaaaaaacgtgacagtttaagcaggctgttcatactttaaaactcatattgaatttcaaggtgtgatggtatcaacttctgctttgtgggcataaaatggccatttgcaaaagaacattttattctacgtagatgtattagtcctggatcaggcttacctttgcccacttatatttgtaaatcaataacatgtcttatctgtattttcccatggcttaattaaaataaatgtactaatgtttaaaataatgaatttgattacttctttgttctaggcttttgcttgggttatttcttctacctggacaatctgccttgctccaaccttgcatgtctaaattccacctacccttcatgctttatttaaaatgataccttccccatctgaatcatgtttccttcctcagaactttcagcacctctatttaacccttttgtaataaagctatacatttataaatccctgaaaatgatagctgtcattattagtaggctctggatctcttcagttctataaatgttcttatctttccctgtttgcacttacctgctccatggattaatttagtccaaactacatattcagtattgtgatactacttttattttatttaaaaaaaatccacattttcatttttaacatcaactaattaaaataatatttttatcctaaagttccaggatttccaatacagcagaacatgatttaaaaatatctgtttggaacttagctcataaacaaatacagctttaaaaactgccagttaaatctgaaacatactggtgggagtagcatggatgctatcatatgcaaggcctttagggggaggctagcagggttgcaggctagcatagttgacaygccattggacctatttatagagctgagttmtttttgcaatgtcaactgtaacattatacctattttaagcctcagtatctcaaatgtcagcctctactagtcgtacagttctctcttatttgatatcagagagcccaatggagccttctgaagtacctagtcagattagcaaagataattttttagaagttcctaatttatctgactctctttgtgaagatgaagaagttactttccaacctggtttctcccctcaaccaagtagacgaggttctgattcttctgaagacatatacctggataccccatcttcaggtactagaagagtttcatttgctgattcctttggattcaatcttgtgtctgttaaagaatttgattgctgggaattaccgagtgcttcaaccacttttgacttagggacggacattttccacacagaagaatatgttttagccccactgtttgacttgccttcttcaaaagaagatcttatgcaacaactccaaatacagaaagcaatactggagtcaactgagtctcttcttgggtctacaagtatcaagggtattattcgagttttgaatgtttcttttgagaagttagtatatgtaagaatgtctttagatgactggcagacacattatgacattttagcagaatatgttcctaattcatgtgatggtgaaactgaccagttctcctttaagattgtattggttcctccttatcaaaaagatggcagtaaagttgagttttgtatacgttatgaaacttctgttggtacattttggtcaaataataatggcacaaattatacattcatttgtcaaaagaaagaacaagagccggagcctgtaaaaccatggaaagaagttcctaacagacaaataaaaggctgcttaaaggtaaaatcaaggtgaggatatatcttacatattttattattcacaatcttaaagtttttatgtcattctttatttcatgtgttgtaagaaagtgactctatttaaaaatatactgcttgctatgtaaaaaacaatggtgccaggctttaacaaggtcaaagctattcaaataatagcactgtgtaaccctttctacaaatgtgagaaaaaatatggctgtaatgcaataggttgggagagaagtgcactgtgtatattacttgcctaatgagttataaattattcctgctcaaaccatgaaatctagattattcacatataaaattatttactttgacatttaaagtacttttattttcagtcgtttttaaatgtctatgctttcctttgaaacagttttgattaacataaaactatatttcaatatgtatctagttctcagaaatttgtaaacttctcccaaaagctgcaaagaacttcttcataactgttttgagttatacagggatgtttgaagtgatacatgttaatttaaattataaaagaaatgaccttaatgattaacagaaagacataagtatatcagtgatatatgagttacacacaaaatttcattaattataaccaagaataacattatggaacacaaattagtataatttagtaaaagtcaatggagcagaacaaaaaatgacccaaatataaatagggatattcagctatatagattagagatttgggatgtgacccctcattagtaaccttactctcttgttaatgtgaaaaataagaaaaactggcattcagctgtctcgatagtacatagctggctaatttctgtgacactaggtaagtagagaaaacattcaggagaagtgagaccccttctgctcctcagtatcccagagggaaagtctacattgctccagccacaggcaaatgtttgatcatcctctgagtggtccatcttaactgtccctaaacccaaggattttggtaactgtaccagaaatagtgtaatgtaggaaataggaaatataggaaataggaaagggaactgttttggaatcaagacacccagatttaattctctaaggggaatttaatacaaagcataagatacgatattgggaaatttttttaaaaattgtgctttaaacgataaataataactactaaatgcattgttccaatgtattaataaactaaatgcagtatagatggaagcaattcaaacatatatattatgtttattttcattttcctttaaagtcatctgaaatattggcttaatcaactttgtgaattaggccaactttcttggtctaaatcaaactttctttgattttaactgatgctgttaggaaagagagtataataatctctacataggctaaaataataatttagatgtttatgaaattactctaacacattagctacactaacaaaataagttcaacattatttagcaaactaatttatatgcataatatatacatattaaatactttagaaatgagataagcattagtgaatatctgttaaacacactgcaacttgctctatatgttagagaaaccaaaatttagaaaaggcgcagcattattgtctaaaagctcataaaagaggcagtgttgaactcagcggatttttctgcaatttaatgcagttttaaaattcaagcaatacctgctgaactgtggtttggataggggattcctttgattcctttgatatgccaaacttgactgataccaaggcaaagactagccaactgataggcctcatcttctaccttggtcataatatttttggaacttctcctagttgaagatatgtagaactatatgtatccacacatacatttgtattcagaacagtaatcattggattcacagcggacaccattcaagttttaatattgctttggggaaaaacctgagaagaactaaaccacaaaatggtctgaaggcctgtaaagtttcctaatgagttataaaaatggaaaaaatctctctccctcaaaaccacaaatacattttctgcacttctgtaacttaaaaatgaccaacataattcgaaccacattttgaaaaaagcatttgcctctggaggaggcattttgtgctgaatttcagtccaacatgaatttttacatctgatttatataccactcaaaatggagtgtataaaggaaatcctgacagatccttagaacagcatgtgccataatagaatatttatacagcttttccatgatataatttatatgcaatggggtttcaaatattcctaaaactcacacaagagagcattatcaaatttctaaatgaatattgcagttggattttattgtgaagagtttggttagagaaaaatagcacaccttatcggtgttattttacaaaatgtgtacttgactaaaataaaaatgaactaatacttatttgatcaaaaattatagctactaaaatctcttctctccaaatagttacagaatctaaatgggtcatttctgagcatttctacacttcctatgtagcttaatttggaggttatttctttcagaaggtaaaaacagaatatatatatgtatatatatgtatgtgtatatatatgtatatgtatatatgtatgtatatgtatgtatatatgtatatgtatatatgtatatacatatacatacatatatatatatgattttttctttatacctgcaaatagattagtaatagtatgtaatatcagtcatagctaaaatgaaaatcaggctgccctagtgtagagaataacagctaacttcaattcttcttaataaaaaagttaatttgctatcagggtgcctgagattgtatcttctgaaagtgtcaataatcccttctaataagtatggaatgaatgaatgtggaaatacatttaggtaggatttctgttaagtcaatcacccacccaggcattatgttttctctatggagatttttctcatgttaagagtttgcaaatctccacattggtgtgggttgtctattttcttttgatgcctgatagtctgtacactttggacagaaagaaatatgtagagagaaggggaggcagagcttgtaactcataggcatgtgattgagagtgacccaaagatatttaattgcaccgaaaggcatgcatcatgagatacttaagtatcaccacatatgctagcaaactaagcagattcctgatatatctgatgggttttattttaaaatcaatgacaaaaatgacattgatataaatcacattaaatgtacatagacaaataagctaaaatggcatgcaaaacaatataacctcaaagttaggattttaggcttcaaagttaaagatatctgagtttgaatccaagctctcctacatgctagcaatatgaacttgggcaagttaagcttgtttttctggtatgttaattgagaacaactacagctctatctcataggggttgagatttcggtgaagtaatacatataaacttttagcacagtgtctggaacataataagttatcagtaaatgttaactgctgtaaaaagacaatggtaacttcagctttaggtgtatctgaaaaactgcaaggctcaagctgcaccaaagttcttctcctctttcatttcagggcttctaaattttcagctttggagagccattcctttgtctcttgcaagattttaatcaacaaggaagactaactgaactgtaaattttcttgagaaatgtgtcactttatatatgaattatcttaaagctggaagagaacttaggaatgttaaaatttccacatttaatagatgaaaaaatgaagaactagaccaaaagggataaaaaggcattcatttaggattgaacagacatgcatattaatttcagtaaagtttacacttagtagctrtgtggctgtgggcatattacttcagagctcaaagcctcagtttattcacctgtcaaataagggtcatgatgtctagtgtcacattgattaaaataagtttatatacttaaagcttttaatatagcatgttagacacacatgaggatatcatcaaaagcccttcatcacaattgtcccttttattatcaaatcttgttcagctaatgtcctgactcttgaacttgcattatttctccatacatcataggtttccttgtttcaggctccaaaacttattcaacaaatgtttactaaagaactgtatgtcaggttctgagttgttaggcagcagtatcgataactgagaaatgtggctggagacaggcgcctgtgaagacaagaagaggccccaagggaaaaggccttgaaaagcagagagaaatgaagggaagagagaaaacaccaaaaccaagttcagattctctgggtatacagtagaagccatagataaaaaatgaaataagaattatttccacttgaggttttctagaatatgtgacctagagctgacactgtgtacttactggcctggggggtggtctcccttctcagcatcttggctttttttccccactgcctgctaaatgtatgttcctaatggctgggtacaccggttgagttcatctggttttgtattttattaagtgaaaccaatttattattttaagtaaagaaactgcatgatataggtgtttgatggtatttataacttggccaggtgaatgcaaataaagtcctaaatgactttaatgccaaaggagaaaattgattagtcctcaatttttgtactgtaggaaaaaaaccaggtacgttcaggaacaggaaagagagaactcctttctaaaacataattttaagaatacagagggtttatctttcagggtggtaaaattgtgaaaatgaggccaagaaaagcattgggaaatggggtctaagatatggctacattgtgtgtttcagtcagagctgttggattgtgagacttccttaatttacgcatacagtataatctggggtcctggaaatagtccaaagaggtgtaaatagccccacgaggcctttgggacctcacgtatgccataactaactcgttttgagtccacactaattgtggaagctgggtctgtttaaggagggacctctggcaaggccacgtggaaacataaaacacagctgtgcagggcccatcaggagggtgtttgaaagcagccagctggttgacagcgaggtgccaactggcttcaagtttccttggaggtccaccaaggcttcatggtttcctggttttgtggaaatccataccccatcctagactttccctagagtgattttgaaacttttctgagagaagaggaacaaaagggtatcctccttcagggtgtctctcatgctgtggctgaaaggagtcactatgaatgccatgcctcaaatggatcctctgggatctctgagagcctatccctccccacctgaagcccatctgcagcctgtaaaaataaagcagagcccactatttctgagccaaaaatgctcctggcaaaaaaagaaaagaaaagaaaaaaggaagaagaaaaagatggcaccgttatgaagtgggtcaacttagtttttcaccttcctccacttctgctaactgtgactctcatccctattccaggtttttacccctacccctcaacaggaaataatgcaggggaaaagacctcaagggcagatatctgaagtggatccgattgcccagggccctatcaaacttaaaaaatcctctataatctgacacctcattttgtaaccttgcctaaaatttacatatatgtgtttgtgtatatatatatgtgtgtgtgtgttgtatgcttatatatgtatgtacacatgcacacacatgtgtgagattttccttcttaaatggagacccctcgagggtggcaggagctatttcaatcttatacccattgaggtcagttgcacagaggcactttgagtttggattgagaaaatggaaatgtctgattttagagcagagagcactacagaatacaaggtagatttaagtacgttgtgatagggttccatagtagtatgagactcatggggtctgaagtacatgtgtatatggaggatggagaattccaaaaacattgaagcataatggaaacagcaagggctttaaagtaaggcaagaccttgaggctttaattctaactaattactatctgcttgacttggataaattatattttgtatctattttattcaagtgtaaaatagggataataatttctacttggcagagttgctatgaggaatacattagctaacacatacaagcatctattccagttgctgacattttgtagatactcaaagtggtagtattaatgacattggtgataaattccacattttccaatcttgtgtatggctagtactgtgcccaagattaacggagaaatgctgttttccctcatcattcctgctaccaggacccaggctaaaacaaatagtttcaaaattaatcatgttatggttcaataagtcttgggggactagccagggagacgagtatttatagcattgcttctatgggtaaatgatttccaaattttagcaacttctgggtcacacacaaaaaaagctttggaacatcacctgttcataaattggaaactgaggacatgtttttcttaaggtagttcttctgaagatggttcttttggactaaatatctgagttgattgcacacaattcaccttattatctctttatgcctatgaatagaagatgaaattgaagtttatataattctcttcttctaagaaaatacattatgcaacatcaaatttcggtcattcctctgttttaaagcattctatgtatcccacaactatacgaaaaggaatatatctcttttcagagtattatctctcaaatcttttctggtgtccattctgctgcttcaatagctttactaggttaactagcatggtagtgttattatctgttaaataaaaataacaactggttttgaagccttaatcatgccatcctgctgtttaaagatcttatgataaaaagatgaaaacaaggaatttgctaaatttaactgttatactgcattgctcagggacagagaccaattaaacaaacctgtcgtaggaaattctaaaattccctccacaccaagttactctgaaaatgatctgtctgtgttgtatatcagcactattcaagtcacaactatgaattgaattttaatattgtaaggtaatggttgtcttatgtgtagtcatggttttgatttttatttacaccttttgaaatttgcagtagtaaaaaggattcaagtaccctccccattgatatttgtaaattatactgaatagtgaaaatgcttttcctaattatgtgaaaacatttcttagcccattgacaccatcagaatatcatccgtggtatttagagaattaagccatggtacaaacctaacctattgactataaatctgtatgaataacctccagctgattttcatttctaaaaattactgtggaygtgttaacacaattacaaatcacatagagttgctaagataaatttcagtttcacaaactatatttgaaaaacaaaatatagtctatcaacctcaccttttgaagattaatatttataaataattttattatatgttaaaacaacttaaatcttgtaagtacttaccaatagaaaaattgaagttttaaaaagtcacatttagctgcagcagaaaatagattatattgttcacatataatcttaagtaggtgcataagattattgtgtttattgtatttagtatttagtgtaaatatagttataattattgtttccaatgttaatacagtacttgatttctgaacagtttttgttgaatccttttgtaggagagactatctaattctatcctttgcttttagcagtattcagaaaacacccaggtcaaatggttatatattttcttcttaatcatcttgatatggtttggctgtgtccccatccaaatcttaccttgaattgtaataatccccacgtgttaagrgtggggccaggtggagataattgaatcatgggggtgggttcccccatactgttctcgtggtagtgaataaatctcgtgagatctgatggttttataaatgggaattcacctgcacaagctgtcttgcctgctgtcatgtaagatgtgccttcgcttctttgtcttccgtcatgattgtgaggcctccccagccaagtgaaactgtaagtccattaaacctctttcctttataagttacgtagtctcaggtatctctttattagcagtgtgagaacaaactaatacatatctcttgggaagattatgttcttcaataatgtgttctatcagaaaagttccatgactttaatgtagccacttacgttgttctgtctttagtcatttatttactctttcagttgaattaaatgttggaatccctatccttatacattaaaatcaagcaaaattatattgtttctctcacagacttctattttccatgtcaaataacctcaataactttgtttttcccttgaggtctgaattagttaactagaaaacaagtttgtagtgttttaatgcatacgccagagaagaaaaaactccatcatcaactgaattctcataaggggtgaatgacatcactattaccaggaccatacattgtcaacactgatggatcaggaatagcccaattggtcaacaggagtttaactaaggcactctccaagccctgccttctttgtttgaattctcagtgttggaggtactattattacagtatttcctctgggagtcagagaaggaaaggaaactttattttataaaattagaaagttaaaagtacttcagaagatcgcttcatttattcttctatcttacctaaaaagatagctatattagaattcttgaaaactgtggacaaataatgagcaattaagaattaaagttacactattttctagatacctaattttaaaataacatttctttccagaatgtaactgtataaataaaatgctgaacataactttttagccattattaatttcttttttacatttttattttattttagattcaaggggtccatgtgcaggtttgttacatgggtttattgcataaggctggggtttggacttccattcctcatattgtaaatgtagtaatcatgaggtggtttttcaaaccttgctcccctctttctcttcataattctatcgtcccctgtgtctgttgtttccatctttatggccatatataccaattatttatctctcacttataagtgagcacatgcagtatttgagtttctgtttctatgttaattcacttaggataatggcctccaggtggatccatgttgttgcaaaggacataatttcattatttttaaggggtgcatagtattccatagtgtatatatactttttctttatctaatccaccatcaatggacacttaggttcactccatgactttgctattgtgaatagtgctacaataacatctacgagtgtgtctggaaaagaaatgttgaataaatttataaaaataaaatgcagtttagacccactgaaatttaaattggtttacattgtatccttttgttttaaaaaggttaatattgtatctacaagcagaaattatttgaatatatactaaatttcttgactttgtgtgtatgtataattttaactaaaagctatttgttctatcaatgaatatatacagaatattggtacagccattccagttgattatttaggaaattaaacatgggaagcagtgtaatactgcccagttacactcaactcatccttgatgcaccgcttttttctgtggaaaaaatacacacacacacacgtgtgtgcacacacgagcttttcacttaacctgatctctttcttatgtgtgtgtgtaatccatataatgaagacattcttcagagagttcatatgttagctagtattttatattttctatatcggtaatatctcattccaagttaactttggtaaactgagttaagtttttagacattggcaattatgtgaacattcaaggcatttgcttgcaaatctcataaaacccatttagttcaacaggacccctagtgctactgtctatccatattatggaacttgctttgacctctgatttctttttttactttctttaatttaccagtatttctagcaacattttcccatgaaagagctaattctagagcacaacttttcctaaataaaaagttgctgtttgtcactattacatctgatgcaatttatttataggcgaagaaattaacacctagcaaaagacttaccagatatttttgtgtctggaagaaatagaacctttgccacaccgccctctatatctgtttagtcagcatgtttacaatggtggcatttctaggcagcctccaggtacggtctatttttttcaaaccataacattatattttatcattcataatttttatattttaataagtagttttattcccttgtgaaaagttcaaaaattattttattgtaaaacacttcagttaattcataggctactttcaaagctcatttattacatttacaccattttaaaaaaacaattatgaaactacatcttgctggccataatataggcagggtgatgggaacaagtatgttgatttttttttttggttaaattctggaaatgtattcccttaatcccacgaggtagttatagatgaagaaactgaaactcagacttttcaaggtaactcttgatgaaactgggattacagccgcttttgatgtcaaaaccaccttccccttcactactaatgctgcctcatcaggtaaccatttgtgaacagtaaaggatattaaatctcaataaagtagtgtacccttaatatgctgaaatgtaaatatttagaaagttcctccgagtttatgaatacaatgtgattgtaatagggctttcctggtttctgatgctactcatgagcagtagtgataaaaacaatacattatggggtttaacaatcctattaataataaaagattctgatttacaggtaaacatgaatacagccaaaaggatgtttttagagctttccattatgcagacactagctcttccacttgtgttcactgtttctattcaagccacttgcgtgctttgaaaacatttttttccttgtctcttactattccatttccaccttccacaggaacgagtttgatttttccctcttacttgaggctttcctaatgtctctaatttatccagatccttcctttctctaggctcagcatttaatgcctacatcattcatctggtaaatgttaaatattgcctatttctgcacttaagaacttgtacgtgtgacctttttcccaagttctttgaggtcaggaatggtgtattagtctaagtattagtccccatgtgaccaacaaaaacctttgaaaaactattaatgccaaatagttttctcatagataactctgaggcctaataaaatccaaaaagacttctgaatagttaaataatgaattatgttcattgtagttcaaatgatgaatgcatttattgttttcatgatttttaaaaatcagatgctccctatacatctccatctggatctccaagtggcaaattactttatgttccaagtcaaagttacatttatcccccaatcctatttcttcgtcttatatcttatattttgtttaagtcatagtcatcattcctgtcattcaaataagaaactttaatatcaaacctaatttacctttgccaactcctattctacatccatattatattatatggccgtggaggtgatgattgttcctttgatcaaaaatacaattattttaaaaattaagaatgcaataggatatacaaagactatatttacatatgttaaaaacaacagatagaaggggatttgtcccagcaataactgcatatttgttgtctaaattgaataaaaattaatagataattgaacacaatcattgtaacatcttgtagacagtctaaatttagatggtttctttcagttacaaagatatcaatgaaaaatcgaactgagaaataatatagtctgctacagcatactctaattgttcaacaccttcttcttttctatgacttctaaagaaatgattaattgcaccatcataattttacttttctataagttcaagtaattctaacatctcaaaagaaatatttattgatcagcctttggccttctttatgattcagaccagtgggaccagaacaagaaacatccaataggctgaataacaaaagaccaaaggtagaaattctatgttcactgatcagaaatgattcacttacctttttcttcttgccagggccactgctcatattagtgctgacgcttatgtggtcctcactgatgctggcatccctagacactctactagttgtattccactgacatttctatcttgagattgcagagtcttggtccttccctaaatgaaacaaagagcaaaacaaaaacctagaaccagtgagagtaatgcaatgcatctaaatgtttcaactcaagacctacaaaaatttagtgtgatgtgtctactacactctattgtgtactacttaaaaggtattttaaaatggtttttgataaaattttagatttatagaaaagttacaggaagaatagaaacaattcccatattcatgtatataaatgttttaaactgtgtaacagaggggtctatttgcattgattattgtaggcaagggcttttacttttgtaaactttaagcaatgggaatttttagtttgtagctgattgctgatttcactgaatataaaacatcttaaatattttgtgaaaatattgacaaactcaaatggaatagtactatcaggcatattataacactcataactcttaaaattataatatttttatgacaagaattggaaacatattttaggaaattagggtgaagtctaaataactatgtattttatatagcaaaaataatatattccatctattatacatcaattaattcttacattactacccttaatcctcatagttttcattaagaattctactataatttttcctaatactcatgcgaacttcattgtacaaaagctgaagtctccacccaaagtaaaaatgtgttgtggagataggtaatacatggtgtttgtaagtattttattttccactttctcagaataattgtttcagtgaaagtagctaaaaggtaaaattttattgatacattttgttgttttcctattagcttcaatatacaaatatgggtcccagtgaaaacattgtgagattgaattaaacataattttgagaacgaattagctgttgactggaaaatatggagggatactgtttttagtacaatagaatataattttctgtacagtgactcctgaagaaataaatttttgaaaccctttgtataattttgctgacatagctataaaagacaatttttttttctttgtatttcctcaatttctgggtaattctttgaccacttatgatgattttggaccaatttccttttattcttttaattttgtatttgagggtctgtaacatttgttagaacttggctacaaaaccaggtaagaatctcatctcatgtataatgaactgtagtgtattgacaacttgagttttatggtgttttaccatgtgaataagttagcttgttcttcatcaatttagaatttgctattacataaacttatgtattttttaaatctattatgacttcttaagtggtataacattatctcccattacttcacagttacattgtagtaagcagagccagtcccatttcacataagaagaaatttgtcaaaggaaatttatttgatcaagtccaggaaatgtatagcaggcgaagctgggtttgggatttaaggtctttaactccctatagctctgaggcatagtgcttcgataaactaattattcataaagaatttacagtccctattttacatagaactcttttaggtaacttctatctctaagcaaagatttggtttagtgataatatttgtacacatgagaagttagctatcgacatggtatttaccaaatagagtgaaacatactcggacaaattcataggagataaagagcaataggcattagaaaaacgattatactgcaggctaccacaattagagacagcaccacagaggaattgaatttgacctgcaaatggtaaaatttgtgaatgtggagaaggaacagaagaacatttacatacagtataaatatacttatggagatgaatgcacagaaagtaagttgaagatgttattaatcacactgtctgaaatgaaaggaattgtgggagtcaatcttgaaaagcaagattgaaaaagagttgtacagtcttgctaggctgaagattttgtgctttagtctctatgctcaagaacaaagtatttttggttatattaatccagaaagagtttggagggcacattagaatggaaaaaaatgtaagattcagtttgctaactgtaaggaggagaattgaatgtaatcgtattgagtatgatttcccaactttttctgctaagaggttttgcattgatgatgttatacgaatggtccttcattgccttctgcttaaggaatttatgaacaccatgatacttacagggcatattttggggacctcatagtttaaataattgtttctgtgttcataagcattttcatttacttgtctatacgtgttgctgtgtttaaaacatgggtttcatccttttcccattatcaatattaagtactcaattcttctataggtcattttttatataaataagcagatatatattgcacagattttagctatttctatacctatttcacgggtgattcatcttactactctggtggtgcttaagggaactttcttattgtaattagtttaatccaaattattcattccttcaaaatctaaagtttacacttttacctagtgaaaaagattaatccaggcacctcaatctttatcctcttagatggatatataggaactactctactatggtttcttctgtaataccagtgacttccaggttaagagggtagggatcttggttaacattaaagaaaaaaatatacaaatatcagcagcaaaactcttactatgctcttagcttgggtattgatgggaagtaaaaaaagatcagtgactggaagaaatgaatgatgaaggaccatcagtcattcaataaatattatggaaaacatactatgtgccaatattgttctaagcactgaggatacattagcaaaaagacaatgcttatccttacgtagcttacatcctaatggagagaaaactaataataaattataagtataaagaacaactaaggttaccagataaatgcaattgagaagcataagcagaatgagtgttcttccttcactttctcaaaagaatgcacttcatcgagaaggtaacaattgatcagagacttgaaaagagtcagcgatgactctgttctatgctgaaggaaccaccagtacaaattctctaagaagggagtgaacaggaatgtttgcagactagcaagaaggccagtgtggctaaagcagagtgagtgaaggtgaacacagcaggagatgcagagagctcgcagagaggcaagctgactctgactgcatggattgcattaaagtgcattgtaaatctttatccaagtggagatgtagtgtacaattagatgtagtctgccatttgggagagagttctgggctagtacaaatttaggagtcttcaggctataaacagtatattaaaatgtaagactggaagttatcaccaagaatatatcatacataaagaagataacaggccaggcactgtggtttgtgcctatagtcccatatacttgggaggctgaggctggagtatcacttgagttcaggagttggagtctgcagtgaatgattgtgcccctccactccagcctgggtgacaargtgagactccatctcttaaaaaacacacacacacaaagagagaagaggaacaggactgagttctcagagattccaacattaagagaccaagaaaaagataaggaagaaaacaaagatcattaaaattaggagccaagttacacaacatgcttcttgttttctaaaagttatgactaaaattgtatatacaaaatgacttcagttataaacttaaaaatccctgttttgatgttcatagtttgcaaaaggtggcatttgtttatgatcttttttcgacaaccctgtgatgtaggtcaggctgatgttattatctccattgtgacaatgcagaaagaggattaaagagatttgcaatacttttttgaggtcacagaatgagtatgttggttttcaggggatttgaaaataatacttttgacaccactgcatatgatctttctactatgtcctgccacacgaccccttaccactcgcagctaaccctggaccagtttgcttagttagaaagagttctgtcatgaagatcgttggcaaggagggttaagaatattaaagaaaatgaaaaaagcaaaacacattctttatttcataattttctctgtgacattcctactttaacccattcacaattttatttcattgaggagaaattaatttggaatataaacttccaggtttttacctaagttgatgcaaatatatatacacactgtcaccatgttttaaatagaagtgaaattatgcaatgcctgtgtattggactacaacctgcttttttctactcatcaatatattaggtacactgtcgtgggccagctatagagttggagagtccaatttagaagggggatggtgtctatgtttggaaaatgttcaggtaatggaccttcgccgtctattttcattgggttttaacgctccttggggctcctataccctctttggattatttcacacagaaataagtcactacccacagtgagggagagtgcaggaaaagtgtggatgaacacatgcagttggtggcttgtctttgaattctttggggatccctttcacctttactctagctgccttcttgctgtccagatcttcaaattctatgtttcaggtccgtcttttcccactgaagtacccagttgctaattctgagtgaaagtagaattgtgttacagtaaatctaatcaaagaagaaattctacatcagcattatttaaaaaaaaacttaatcattgtagctatcattttttgtttcaaaatgtcttaacttgaattattaatttctagtactgtgcaagttggataagtttatgtaaattagtacttataagaaatattttttataaaattaggagtatatatacatatataattatatatgtatatactatgtaagtatatacttatgtaagtgtatatacaagtatatacttatatatatcatgtatagcactgtatatatataaatcactatatatacacatataaagtgctatatataatatgtaaatatacatttttgatatgtcatatatacaataatatatacatactatatatgtatgatatatatcaatattttatgtatattgacatatataatgatatatgtataaatcaagcaaaccattggaaattgatgattctgaaagactgcaagtgtaatcttgcaagtgccttcacttatataccatattaggaagaaagaaaagaccagaatatatatggttatggtatttttatatgaaatattctcttacacataataaactcctaacacattaaactatcagcattatccatgaacttgcatttaaacaattatattgcagttctaccttcttcaataactgtaactttattattttcacctctcgactctgattgtttattttatgagatacactttatggtactttcatttatagtaattgggctattcactacatagtgcaacaactggaaaacattttgctagcccaagtctaaatcttcgtaaacatgatcaattttgtaataagcagaagttgttaacatagaaataattaatgtttcctacctaaaacaacatctaggcttcctttaagttaaaaaaaaaagtaaatttaaattcattgaagtatggagaggtaatcctcatgagtgaaaattaattgttttatagacttagtagcagaagagcaatccatatacaatttacattaatgctagcatgtttgattatgcatgcccctctcgtcctcactcatctagaaaaccttaatagcagagtatttttactaaaggtcttaatttcacattaaccataacttcatatagtaaaagccaatgtagaatagcagtgtaaaccagtgcgtctcaaaattggctgcacatagcaaacggaaaaataaggcacccacacccagatccaactacaaagactgtaagttaattggtctggggtggttgcaggcttggtatttttaaaaggtctccagactactccaatgtgcacaaaggttgagaatgactgatgtaaacaaaggacataaatactggtgttttgagttataatttaaaaaataatgaaaatcttgtaactagtcacactatccacaaaaagaataatgctatttaaacaaaaattagtaaatccaaataacactttggaaaatgtggcatgaagtatttttaagcattaataacaatattaaggatgtgggacattcagatacaaaggataagctttatatatttattaaagatactttgctccctcagtgatgacttgggacaaaaggaaacatttctttgggaaaaaaggtacatcacacagcgtggcattttcatttagaatgaagtaaacttttagaaagtattcatttttctttttaaagacattggatgaagtggtgagcacagattttaatcaataatacactactgcaataagtaagtggggtacatcatgaactgaactcagcttgaattggtacagaggtgactgggcatttttaagggagaatttttaagtagagaaggggcaaataggatccaggtgagttactgactcttagtagagtcaggaaaccaaaaaattgcaaagtactggtctttataaatgctgattaggccagtcagtctgttagcttgaaattctagttaggattctatccttccatagactgggaaatagagaccctatccttcctgatgattacattttaatgaaatggctttcaggccctggaaaaagacaatactgaattgtaggacatacatatacatcttaacacacagagaaaggatttacacttataagccctttttagtaaaagctctaagaaatggtggccagggccttatcttcaggtgttggctggaacgaacaataaattcttttggcagccttgagctttctgaagcaggcactttaagtatggctagggtcatcctagaaatatggccttgagctttagaaaagatgttagtatttgcttaagtcttttattgtggggaaaggaggaggacaaaactatttgtgttgagaggctgtagtttgtgtaggccagggttgaggcctagtcaataacatgggcctaaagagcctggctagagtttggtcaaagagaaaattgttatcattatctttgtcactaagatctaattgtactcatcttttagttgtttttgttggacacttatatctctctcactaccatgccccttgatattccatctgcctggaatattctgctctgtcttcttcatctcaatagtcatactaagccctcaggactcaaacaaaatgctccctctgccaggaggccttccctggccacctctgttctctgagtttgacttagttctcttattattttcttctatagaactccatgctaccccaatcattaagcttacagctgtgattttaaagtctgttttgtgttaaccttcattagactgtaaactttatgaaggcagaatttgttccatgtcagcctgagctagtggtttagcttctagcccagtataagttaaatattttttgaatgaacacatgctgaattttatccaacattactctgaattggtatcatatccaatagacggattgagtcctttaaacccactgggtagcagtgtccttccaagtattgactataatgtcctgtgctgctttgttaaaagtgtgacagagatccctatccttatcaacataactgcatctcagcagagtttggctcttgcacttcactcctttagcaatcccagtgtgtggtccatttcctcagtgacctgctgtttgcctttccccttttatcaggttctcaacttgacctttccagaacaccatattgctcttatactaatcttcaacagtagtcatcttagtgaatgcttctcacttcatcttaggattttctggtaataaattctactcatttaatcagggacccaaaagccttcaatggggcaagttgtcttggcacttataagctcatcctgacctctttcatcccctccagtgggtggctccagcgaatataagatggtgtctctactgtaaacttctaagcttcctacataatttgcataacttttttttttttttcctttaagagacagggcctcattctgctgttcaggctagattgcagtggtgcaatcatagctcactgcagcttcgaactccagtaactatttgatgttttctggcatttaatattgaaattaacattagccagaataagaagtgtaattagctgcttgtgataatcatgttagtaagcataatttattctaaaacatattacctcatatttaaagagttttaatcaaataaaatctatgtaggatctcctcaagatagtgaggaccttaaagctaacttaaaaattatacaaattaatttatatggagatataattatttcatactcaataaatatagacttctgtagacccactgcagtgcttaggatatatggagtttacaagtaaagaactaagcgtctgtatctcctgaaatttaagagagaaatagtaatgaaagattgtgttgtactttagatcacactagaataataaagtgtcaagaaagtgaatacaagcaacatttaaagtctcatatgaaaagttataccataacatattttccataacatggcatgtgaataggcttcaaaaaatacttgaatacctttccatggattctgtagctaattctgttgcaggaatgtaagtttgattcccttcttcatagacggttagttcaaagactgaacaacttttactccatatgtttttttcatattttttcaaaagggaatgtgtctattcattttttttgcataaatgcaaaatgccaatataataataatagttgatgcttcctgcttgcttgctgtatgccagacattgagtggcttacatctgtttcctcatttattgtgttacattggtatcaaatactcttacttgatttaattgcattcttttatctggtgtcctctcttgggcctttctctgctctctttttcggtattccattccactatgttttccccacccaccttcagtccaaattattcaactgctaattatgctactcatgtttcatttttaaaaacaagtgctttcttcactttatatgtcattagccaaaaaccaatttcacattggagaaaaatataaaagcagattttgtactgaacttcgactggtttagtcaaaacggtgcaagcaagtggtttgtatgtataaactagctttaagtaaaaaacaacagaagcccaaaaccaaaataaataaataaataaataaaacccatgagctgaagaggaggagttctctgaatgtgaagcggtagattccataacagtataggctcttttatgaagaaatctgtgacagaggatggaagaaacaaaatagttcacaaaaggtgtgggtgaggggttgacaaagaaaatgtgtaacacaaaatgtggacatttgtgaggtatgcctcagtgctttgcgttcataatttgcatattaagaagtcacgcgtctgcacgttaatgaatccccaactagtctctgacacaatagactgatagtccctggaggagtcattatggcctatcatgtcaatgatccgcatattaatgactctcttatacgctcatcaacaggtagcctaataggcttccattgagttctttttcatttgctttataaatatatcctctcttctcttccttttgtaatactattgtgaagaattgacaaaaaggtgcattaagatgattttaatgtgtgacgtaagttcatcaaagcattaaatttagaaataatgctttaagacttactgaatctgcgtagaaaacttttcaaatgctgttaaatacaaatccagtttaataatagggttcttgtttggattttaatgcaaactaacccaatttactgtatttctgttttccctgatacattaatttatggcatgattagcataagtagaataatttgaaaatatgtttgtaaaatggaattgcttgaaaatagatataaattccaacagatttcatatcatagaggcatctaaccacttataaaaactataaagcagtaactgataatacaaacaaaaacatagagtaaattctagacatatatttgattgcatagcaatccagaaatgtgcccaggatctaaaaaatgacttcatagcttctaaagttaatatttaaataagatattcacttcattgttgtggctacttttaacattctaacttgctttggcatgctttaattttattagtccaaattatttaagatatctggtgttttttttaacaaatgtaaaatctatgatttaccataaaacatattgaagcattgcttttccagtatttttattgagttatgcatcatttcacatgatttactctccagataatgggagggctattgacacacatttgaaattctttgtcaagagccaggaatgagatagaagctgggaaaaaaagttgaagtttggtactttgttctctttaaaaaataaaccacatgaaaacatcccatcttggggaacattagaggccacacatgctcaggtgagtggctgcagtttgatgctgtgagctcacacctgccaccctattgggtaagatattcctctcctgagggctgtcacttctgaatgatttgatttcaaagttcrgaagtctcatgtcctcctgtattcattacttctccaaactcttccaaacatatactgagaatattggtttacatttaagatcaccttttcttaacaacagttttcaaaataatatgttaattcaaatactatagagtttggaggttagagctcaatatttaacaaatcaggtgacttaggtgaagtttgctgtagattccgtggaggaaacaggttttgttgaaatggaattagttaactcagtggtcatgactctaataatgattttttatacaatcacaaaaaattagcatctttataaagaaaataatgcctgaaatttagtatccctaggaaaaaaaacacacatgacaatacactgattatttttgaaggctgtaggtagtataaagctgtcagcacttacgttgtgaggaaattgtggagacagaattgtggagataagacttgtgaggtggcaagactctcagctggacaatcactactttcttgctacccacctgttccaagggtgactattgtttaagaacgcaggtaaaataaggactttaggccaataactttgagttttttgttaatggtatctctctgaagtatattcagttgttccagtatccatagctgaaaaacatttgtatttttctctcgattgaatatgattggcaggttgtaatggagttctttgggccagctttatctgtaagtcttcttcagcttacaatttatgaatgctgcttgtaattatatctcattccaaagcaacctaaatgttttttggttcgcacttggacctcccagattctacttagttatgcattagatcctgacaattgagtgcctctttggagagtacacagctctacagaattgcacatggtgcccaatccaatcagagaattaagtctaaaatgtcttttctccctatttcctttggggtgagctagaaaaaaacaccaccacctaccactttgtcacaacaaagcaaatttagacctgttatccttggtaggaactgaaragttaaaaaaatgaagaaacttttraagagagatttagcaaagaattctccaataagattgtttttcagttgcttttctgtctgctgttgaaatttcctggatcaataaggcaaagtacctcttgttttcagtaagatcaagctccgaggtactgggcaatgttctaacttagatattgaaatagagaagatttttagaaatgcamactcagttttatgcaaagatgaagataattcaatgaaacaatctggtcacaaacatattggtatgttctaagttacttgaatgcttgagcagtttagtacagtttccccaatggacttgtggttttccatggtttatagtcacattttaaaattaataaattagcttatataataggtatattcgatgtatttttcttaatcaattatagatactggtaatgttttacttttgaaaaggttttctttgccataaataaaatatcatggaaataaaccattccattacatgtagtagaaataatataagactagctcacaagctatgcaggtgagatttctgtggtattaaatttaaattaataatactgatcttatgatttaattgacaatttatccttggctatattgcaattttaggtaagcagttatttctattgattctaccagcatttttgtttttgaaaaatattaagaattttttcaattaaatacctctaaatgatactcagaatactcctttaagttatacagatgtagagctcttaaactgcaaggcatgttatttaatattaaagctgagaagtgaaattggttccattttgagcaatgaaggggttgatgggtagtggctgcctggctgtgtaaaagaaaggtagtggggctcaatatgcccgcagcaaggaagtccctttatctgttatcagagcttgccatgagtgttagagagaaaggtcagcatgagtgtattgtatttgtggccttctaatctaatccagagctttcactttacagataagaaatgtgatgcccacaaaaaawcaatgtgtcggtcaaaaccaaaacaaaacgatgtgccttactgtgtcagttattagtccccagattcagcatagaagaatataaagacattttttaaattctcactgtttctcttgagattattttttgcttctttcaatgcctgttaatcatgccaaactgtattcatttcgttttcatttctggcattatcatcaagaaactgaacctaatgcatcttttcatccttaattccttctgcatagttccttaaatttgtttttcctcaggcgcttctcttcacaattagacactgatccctcttttaatcaaatgttcctcatccacttttggttttattcctgatcaagagaagactagccagtactgtaacaccaaaggaaaatatattaagctgtagtagttggctaatgtattatgaattttgcctattgttaagtataagtctttactttcttcctttcttcaatatatgagtggctatgaaatggcagaattctagaaagtcaatttttagagaagctgcaacataacattatgaaaagaaacagtccacaatacactatataattatttacccttggaaaacctgttcgacatttctgtatgtgtccacttagtgccaatgacatactactcttgagtgactttttaaaaaatctcaaaggaggctcatatttctgattttaaaggtcatttattttcctttcttttgtggagagaaggagagcaaaagaaatgagatcacaagctttgaacaaagagggctggtctgaacttgagtaatttcacatttactttttagctgtttatcatagagtgagaggtgatgcccaagaattccaagtttggtcctgtttagaaaattctgagcactttcaggctgagtgttaaggagacacaaatacaatattcatgactcactttggcaatgatcccttttcatgccaacattttcattcctcttagagcagagttagactttgctgcttacaacctaatcctgccattcaccttaactggttgggtaattccatcacatcagacttagactttgtggcatagatctttaagaggttttgctcgttttttaagagacatatggggttttagcacaatggcattataggacctttggaaaaaccatattattatactaaaaatgactacattttgacagtgttaaaattaattataattccaaaagcaaaagtgcaacatatccagaaactgcagtaatattaacatggtgtctaaatcctggcactgaataaatcaattgggtaatgaaagaaggtgcaaattatcatgccagtgtacgttgtatttagagaggatacttttaaataaaaggttactgtcactgaagatctaatgatttttctttgaagggtgctcttctgataataagggtatatttacatggctgagcaagtatgctatcatggactgcaaattttactcttagaagtaccttgaatattaaagatatgagagaatatggtaaacattaaaaatatagataactcagagtaaaagaagcagcatacaaattggtttttgtgataatgtagaattaatgatcagtgtgccatttactacatttcctaataacaataataatttattaaacactttcatgtgttggaaactatgctaaataattactctgtgttaggagtaggcaagattttagagaaaaatgaggcgcagagaggttgattaagtatcttgactaaagtcaaatggtgagtaattgagttagtaagtgttaagtaaccggaaatactgagatttgcatgcagggtttttttttttttgkttttttttttttttgctttttttccaccacatattgaccctttatggaaagaacactaacataatgactaagaaacttggagctagttatggatttgccactagttggttggtatgacttctgccatattgtttaactgggctttagttttcttttctctataaaatgatgggatgagamaatccaagtatgaggtctcttacaaatctgagaggaatttggcataaaaagtaaaataaatctttctgtaagttgcatgggrctcagaggtaaagagtctgtagaactcacatttttgaatgattaatagctgacttagaaacacaaattatttttgcttacttattttattagataggttgaaaatgtccttcaatttctaccccattgatgtttcattattttattctgtaagtcacagatgatgattggtctattctacaatgtgtttcttctttcctgggtgcatatgagatacacaaacatttattcttttgtgcgtagagctatggcataattgtgtgtaacttgctggaaaagtttgagatgtaaagaggcacttcgtgtaccacattcctggagtctgagtgtctgtctgcagatattcttttttaatatatgtagttagacaagcactagtgcacctcagctaactctgaggttccagttaaaaatgcagattcccactgcccactcagagatgctgattcagtagatccaattttagtgcacttcagctaactctgaggttccagttaaaaatgcagattcccactgcccactcagagatgctgatgcagtagatccgatttctggcccctgaatagcatttgtaccaggtcattttcacataggaggtctgtgaaccacattttgagaggcactgtttgggtttgaatttgtgcctcttaagctagttgactaccaattggctggtgccctgggcctttagtctttcatttttactaaattgtatcttggattacttgacatgttgagaataattctttttttttttactgataaagtttttgcatataatgccttaagcttggaattgcttctctccttttctctagctaaggcttcttatttaggtttcagcttacaggccatgtccttctagaaggtattcctaccccactctgttcctcagggagcacacagttatcataccctggcgctgttgctttatgtacttgtccactctccccattagcttgtgagagcagggactccgtcttgcttttttggtaatccagcacaacatttcacaattggtgggtactcactaaatatttgttaaatgatgatgcattgaatgaataaatacagattgctataaatttaaaattgctactacattttacaagtgtaactattgcctggaaaacattcatttcttatgttcagcgcatatttatttaatgtctactagaagtcgtcacataaaatttcaatattatgtctcatttctttgaagtgagggaaaatttaccgcaacttataaagatagtgcaagcctttgtgcaatgatattgtaagggaaaaaggaaaaaatgtcaatctgggcattttccattcaacaaacactagttttcacttcccatttggttaaagagtttacaagtttaacatgtttccttcaataaagcttatcctctttctttcacccatgcttttccttttaagtctccatgtcaagtaatggtggttccatccttttagatctccaaattagaaacctctgcataattctttatttcttgatatcttaagagttatgtaaatagtagcaaagcatgctttaaactcatatgaaactagtaagaagcagggcaactgggtttggggccaggaattgcaactaaaggaatgactctcccacctgtctatcatctaaggaggagcagctaaatccagtggggcagtgagatgcattgttgtccatactaggagtttgcaaatctggcctctcatcaaaatcattttaggaaatttttagcaccatcattctctattccccatcttcacctccatatacaggtctatattaatttagattttatagaggtagggcctgaagtttttgacatgaaaggcaattctgggaactattgttatatttgagatctactgtatttatgagagaggggagagacaacgtaacagggcttctaaacagctgagatrtttaaagttcctttgtgaacttgatttctagttccttagaaattcatctggtagaatgccccagggggccttctaaaggttggtaagaactccttagaatgttatggacccaggtgactagtgtgaatgagaaaacattttattttcctcagtgaacgactggaatcagaaacctagaaataacttgctggttcaccatctagacatgtgtgccagaggttagggaggaaccctgaaaaaggtgtccacataaactcctgggaagcaagtcacccagcacataaaacatcaaaaccaatctgcagactaattcaagaccttgctgacttgtagtgcaggatccctcagttaactgtctttgcctaggtcttggaaggggcaacaatgtagatttctaattctgatgaatgcggctgaggttgggtagagaagggcattaaaaaatctatgtacagcatattgatgctacaacaaaaattaaaactcatatttggttctttttctctttcttcattaatagtaccctttgcccttatcattttgtgcctgaaatgtttcaggagcctctgattagtctttctgctccactgtggctcatcccgtccagtttctcctctacattacctccagaaatacgttggtaaatgtaaatctgaccacgtctctctcctgtttagccctaacccccatgccactggttaaaaagtacctaaataattcaacctcattttgccagctatgctaagccctttacaatctggcttgaactaattctcattctaccccttggcattctttccccaaacagagtccagccctctgaacattttgttgtttctagatgtgactttttcttttgtgcttttttttttttccttgagacagagtcttgctccgccgcccagactgcagtgcaatggcacaatctctgctcactgcaacctcctcctcccaggctcaagctattctgcctcagcctcctgagtagctgggattacaggtgcctgccaccatgcccggctaattttttgtattttcagtagagatggggtttcattatgttggccaggctggtctcaaaactcctgacctcatgatccaccctcctcggcctcccaaagtgctgggattataggcgtgagccaccacacctggccattttgtgcttttttagtcttgtctttggcgacctgttgttccctctgcctacaatggctgtattcttttctaattgggaaacttctagttatccctaaaacctaaatcagaatgttagtaactttgagataaacttcctgatttctccaacagtctcctgataacttctgtcctttcttcttatttctaagagaatatctatcatatcccattgtttattataatacttatcacttatagtaattataattacctattgatatgtctatttccatcttcacattatagcttcattgaaataagaaactagggcatatttattttcagtttctcagtgtttgttataattcatgacacacagatattttaaaatatctattagaaaaaccatgattaaataatatagatgactatattatataatttaaggtacactggaaacaaagtattgttccattaattaatttcttttttactttttaayttctaaaattataatgattttaaaattatgcttaaatcttgactcattattgactccataattgaaaacattgtcctgaactctgaaggggtaatactttaagtcttagaagataaacaaaaatatacatattttaaaatattagattattttctgaaattagatgaagaaataagagaagaacactgtcatagtaatgttggcaaaaggtagagaggagaagggagggtggagacgatgctgtgcatttattcactcaacagcatttcttatgccactattatatgtcaggcactgtgttagccacagaaaaatatgaaactctcctttatcaaaaagtactcgaggaacataaaggtgaaatgagagatattcaaaagtatactttcttcatgtcacaattgtcatagttctgggccctatcatcatcaaccatcaatttgtcttttttctcaaatgttctaaagctcttaaattcaactctttagatctaattggtcatatgactagtactttgaatttcagagtggcctctaatgtgggccagagagtactctatcttcataaattatttgaaactagaattgaactatttatatatttcaaattattaataagcacctgcaaaacaaccacccaaaacagtgactgaattctactcatttcatttcctgattccttctccctaatttgacccacctgtattagtctattttcattttgctgataaagacatacccaagactgggcaatttacaaaagaaagaggtttaatggactcacagttccacatggctggtgaggcctcacaatcatggcagaaggcaaggaggagcaagtcacatcttacatgggtggcagcaggcaaagagagagcttgtgcagggaaacttctgtttttaaaaacatcagatctcatgagactcatttactatcatgagaatggtgcagaaaagacccacccccataatacaatcacctccctctgggttcttcccatgacactgtgggaattgtgggagttacagttcaagatgagatttgggtggggacacagccaaaccatatcaccgcctgatataaccataatatcttgaaaatcaagttatttttagtgtaactatttattattaaattatcccttgctatatatatgtaatttgtaatatataacaaaccacagagacatacaacaaatggataaatcttagcagtataatattaaatgaaccgttccaaagtataacagaggacattctttttattaagctaaaaactacctatatatgtaaataaaattacttgtcccttgctatatacatagttatatataaattatacagttatagctatatatacctatatataatatttaacatatttatataatataaattacagagttatatatagttatatataactttaatttataatatatatggcaagggtcgtttacatatataggtatatgtatatttacatatataggtagtttttagcttaataaaaagaatgtcctctgttatactttggaacggttcatttaatattatattgctaagatttatccatattgtgtgtttctgtggtgtgttaattttgattgttgtataatattcctttttgtgatattaatagttttgtatctattcttctgttgatttgggttgattcaagacttatatagctaacaatgacactatggacattccagttaacaatgacaccatgaacattcttttagatatctcaggtaatatatgcaagagtttctcttgggtatacacctgggaatggaagtagtggtcatcatttatataaatgttgaattttgaagataatgtcggtcaaattgtttttcaaagtgtttttacctatttattctcccaccagcaatgtacaagaaagcctgggggccaggtgcggtggctcatgcctgtaatcctagcactttgggaggctgaggtgggtggattgcctgagcttagtagttcaaggctagcctggcaacatggtgaaaccttgtctctactaaagtacaaattagcaggatgtcgtgtcacatgtctgtgcctgtaatctcagctacttgagaggctgaggcacaggaacctgggaggtggaagttgcagtgagctaagattgcgcrctggactctagcctggatgtcagagcaaaacgttgtgtccaaaaaaatttaaaaaagcctgcagcttcaaccatcttcagctcttggtattaacagacttttaattttttatcaattaaatgagtataaaattatagctctttgtggtcttgatttcatttattctctaataatgctgaccgtcccattatgtgcttattggctatgtgttttctcttctctgaaatgtctgcacccttgcccccctacacacaatgaattgtttgtactttcttgttgatttgtaggagttcattatgtattcttgatgcttatttgtgttgattttgtgtaatgaaagcatcttctcccactttgtaacttctatttttactgcatagtctcttaataaacattttaaattttactacagttaaactgaccaattttttaaatcttttttttcttttttcttaagaaaatatttcctactcttaggcccagaagatattcacatatattttctactaagaatttcaaggtttttgacatttaagatctaaatccaattggtagccattttctctctctcaacttactgaaaagtaccatatttcctattgtctgacatgctatgttagtcatataccaatgttctggatataccatttgtcatataccaaagttctaagctctcaatcttgtcttattagtttgcctgactctgtaccaatataatactatcttaataaataaatcttcattaaaaatacttaatctgataaaaaaagttcctcctccctgctatttctcagaaacattttagccatcatttgccctttatttttctgtttggaataatattttcaaattctataaaaaatgttttggtgttttgattagtattgaatttgtagatcaatttgtgagagaattgacatcttcataatattttctatctatgaacatggtatgtttatcaacctttttaggattgttgacattctttgatataattttattactttgcccatagaaatcttacgtattttctgtttttgtttatagatatttcatatatttaaatttcatttatttctacttttatttgtacttgtccctgaatttgaagtttttctcctatatttctatatttacattttaagacactaacataagaatacatagttgaatacttattttatccccaaataagttaaagcaggctcctgtccttttgactcgatcattttttaagaattaaattatattagagaattgaattagagaagtgattggtagcattttgattagataagaacaaaaatctttgactatttttcttctacaaataatactttcagtattgtatgggaatagagacgaagcaggaataaataaatgctgtttaatggtttatatatttttaagcacataaacatgtacatggagaagggaaggtgtgtcagcctgcagttggatttcgtaaaaataaaccttggcataatttttgacctcattaagcaatatggattcataaattcagtatcaattatgcaagcagtatatttttctaataaaattatatttatatagaagcattattttctatatgtgggcccactaaaaataccaaatgtttttagtaaagttaaaattatgaatcataaaaatatataaaactgaattatcttcttgcatggtcaggatggaagaattttcaatttctcatgatttgtgaatataaaattggccttcctgggatttggatcagaattgctcatgcaatgaagtctagactcttgttacacaaatttatcagccattgccaactttccagatttcttttgttgcagaaaagtccttgagaataggcaccataaggaaattcagttgagagagtataagaaaatgtgtatactgcgccaaatatttcttataattgacttgtgacataactatacacaaagtgagctttttttaccaacatttttcctcctgagtttcatggacaaatctaaattctaatgacttcacaaatacaactacaaatagattacatttgaaggaaaaaggtatttgtcttttacaatcagtatgcagggtatgctagaaaaggaaatgtaacccaaatcattttaaagaaggaaagtatatgcttgcatataaatgatccaaagtcttgcttttaaaattggcctgtggcaatacatatataaagtcttttaactgagtataaatttagctgcctttcagttttttagttagcttgtttctttcttacttttactttttgtgtttttttgcttttctggagagagagttaatgttagtccaactggaagaattttgagtaaaatggaacacaaaaaattaattgaaatgttagcaatttccatgaccataaatagactgtcagttcataaaattttatcattaagccatgagaaaaacattctcacttgaaaagatgaaattcattgaagatagaataatctacatttacatatgtttttactttggttgtataagttttaatatattttcttaaatattaagaaatagagtgtgtttctgtttagaaatatggcattgtttgaattacttttaaatttttctacaaccaatacttactattgcatcattccaaaaagatcatttttatttcaaaamatcccaagtaatataggaaaataagaaaggctatataatgtttatttggcttgttactgattgaatttccccctgtgtaaaaatacttagaagatgcagtcccagaaaaacatataacattttcttttaaatttaacagtaaagaagaatcatcagtaacatcagaagaaaataactttgagaatccaaagaatacaggtaatattcttcattaattttaaaaccaaatttgtctcttttgtgaaagtctacaattaaaacaatcttacataggcacaattatattaacttttcagatacctatatcccaacaatcatttgttctcatgaggacaaggaagatttggaagccagtaatcgaaatgtaaaagatgtaaacagggaacatgatgaacataatgaaaaagaattagagttgatggtaagtgttctggttgccacggtattagagaagatgaatccatttctgcttcaaagatgctgcaatgcctgcctttcaatagcttcaactaatataatttgcaaatgtgaaagcacagcctattctgtccttgcgtctctagcttgatcaacaaggcactttgatttctgtatgttgcttctggtctctgcagtggtaaattaatgacattcatttcttatctctttaccagtggctctgagtaatagtttgcaggaattacaggagaggtagcactatcctgatgtgcatttctaatctttgtgacaagtgtatacttagcataaactcgtctataaaatgagagggctggactagaggattgttagtgtcctgtcctactctagaagtctatgattctcacatgtaacagcattttttaaaaaattccatccttgtgagaatctccaagttctatatcattgtagagtattaaattaccaagtaaaaagaaaatagcctgtgccataattttaaaacaggaaacaaattcagtactatacaacttagtattaaatttgttataaatttcatacttggtgagcattcaatctatttggaattttttggggggatggtttatacagcacttttatcacaaaggaagaaataggagtaaatgagtcacataatgcaatttatcctttactgtatttggatggagctcatatcattggaatacatggattcataatcatctaagattaaaatgacatttgtctcttcaagtgtcagtgctgaaacaggaaagaaatagagctcatctatttccccacatattccaccttttctatagtgatcgcggagctgcatcactaaagtatgcaatttactttgctccaactttaagaaactacaaagttgtcacccattgtgagaattctcaccagctgaaagttaacatggccatttttttcaaaccacagaatataatgaaagggccctgaaaaatcacatacttcaccaatacatctcattacgatgagcaggctcaaatataaaagtttgtttagaagttactgagattgtacatccaataaatgaacagggagctgtaatttagatgctaatttgctccatgctgacgttaatgcataaaacaatgaagctctataatagatggaaatacaaccaaatctgtggaacccacaggcattggcttacaagacagctgtgcagttgacaagtaacatgagccttatgtgagaagaaggggaaaacgtaagatttgcatataattattgagatcatgcaaatgtcagttatgaggagaaaaaaaaaaaacacaggcatctcactgttaaatcctgacagttggcatcactgaagagctcaaatacatttgagtaccagttggcagagggtcattaaaacagaatttgcagagacattaactccctcacttttctttgagtgacgttttgctattaatagtttgcagaggctttgcagaaaacatattaataagagaaactgtaatgggggcacctacagcaagtgtaaatgcagcaaggggcacccaggaagctgctgtctaattgattagcatggagctatcaatgtgtatagtctaagtgaggagaaagtgcaatgacaagcaagaacagttgaataatacaatgtgatagttggaagctgggaaggagagtgataaatttgggccccctttcttactaatctcgttccccagtcatagcctgcaaggatttccccaaaacatctggcttccagagtttatatgaaatccacaaatgaaatcagtcaaagaaatctacyagataattactagccragttartaaaacctatctaattcactatatattttaaaagatcttatggtcattatttctttgttgtttttatcccataagataaatcaacacttaataagraccagaagtactgcttccagagatgaaaggaatacattttcaacagatccagtcaattttccaaataaagcagaggggttagagaagaagcaaatccatggtgaaatatgtactgacttgttccaaaggtctctgtctccaagttcatcagcagaaagctccgtaaagggagatttttactgcaatgaaaaatatkcctcaggagatgactgtacacatcaaccttcagaggaaactacttcaaatatgggagaaatcaagccatcattgggagatactagtagtgatgaactagtgcaattacatactggcagcaaagaagtcctggatgataatgctaatccagcccatggcaatggcacartgcaaataccttgcccctcttcagatcaactaatggcaggaaaccttaataaaaaacatgaaggaggagctaaaaawattgaagtaaaagatttgggatgtttacgaagagatttccattcagatacgtcggcatgtctcaaagaatcaacagaagaaggatcttctaaggaagattattatggcaatggtaaggatgatgaagaacaaagaatatatttaggtgttaatgaaaaacaaagaaaaaatttccaaacaatcttacatgaccaagaaaggaagatgggtaaccctaaaataagtgtggcagggattggagctagtaacagagacctggctactctgctgagcgaacataccgcartccccacccgggcaatcacagcagatgtgtctcattcaccaaggacaaatttaagttgggaagaagctgtgttaaccccagagcatcatcatttgactagtgaaggcagcgctttaggagggataactggtcaagtttgttcatcaagaactggaaatgttttgargaatgattatcttttccaagttgaagaaaaatcaggtgggattaattctgaagatcaggataatagcccacagcataaacaaagttggaatgttctggaaagtcagggaaaatcaagagagaataagacaaacataacagagcatatcaaaggacaaacagattgtgaagacgtgtggggaaaaagagataatacgaggagtttgaaagctactacagaagaattgtttacctgccaagaaacagtgtgctgtgaactgtcttctctagctgatcatggcattactgagaaagcagaagctggtacagcctatataattaagacaacatcagaaagtactccagaaagcatgtctgctagaraaaaagcaataattgctaagctacctcaagagacagcacraagtgacaggcccatcgaggtaaaggaaacagcrtttgatccacatgaagggagaaatgatgattcacattataccctttgtcaacgagatacagtaggtgtaatctatgacaatgattttgaaaaggaatcacgtttaggtatttgtaatgtacgtgtagatgaaatggagaaggaagaaaccatgtctatgtacaatcctaggaagacacatgacagggagaaatgtggcactggaaatataacatctgtggaagaatcctcatgggtcattacagaatatcaaaaagcaacttcaaaactggatttacagttgggaatgttaccaacagacaaaactgtattttcagaaaacagagatcwtagkcaggttcaagaattatcaaagaaaacagactcggatgccattgtgcattctgcttttaactcakacactaatagagctcctcagaatagctctcctttttccaaacatcatactgaaatttcagtgtcaactaatgagcaggmaattgctgtagagaatgcagttactaccatggctagccaacctatttctacgaaatcagaaaatatttgtaattcaacaagagaaatccagggtattgagaagcacccttatcctgagtctaaacctgaagaagtttccagaagttcaggaatagtgacatcaggtagtagaaaagaaagatgcataggccagatttkccaaacagaagagtatagtgtggaaaaatctctagggccaatgattttaatcaacaaacctcttgagaatatggaagaagcaaggcatgaaaatgaaggattagtaagctctgggcaatcactatacacttcaggtgaaaaggaatctgacagctctgcttctactagtcttcctgttgaggaaagtcaagctcaaggcaacgaatctttgttttcaaaatataccaactctaaaataccttatttccttttgtttctgatatttcttataactgtctaccattatgacttaatgattggcttgacattctacgttttgtcattgtcctggctatcctgggaagagggtagacaaaaagagtctgtcaaaaagaagtaacctcagcactactattctctcttaaaagataagctatttaaccccaaacatttggattggtgaatgggactattcattgttcaaagatccagtgcagtttttctcttgaaggatcatttaaaaagggacgcgaataagtttgctccttcatataagtaattattctatataggaccattatgtttggatcattaaatacctatatgaatatgagatctgaagcacgtcaagttgaaattaggtacagctgttgctccttagcaggctatgaagttgcaatgcttcacatctcttcactacttaaagtgctatttcttgcattcatttctcttgcaataaagcttcatttttttttccccttgagagtatatattttcccctacggttttaaaaaacagataaaacatggacaatggcagaggacttttttggtcttttagtattgaacatgaaatttgtatttaacamtktatcatttatcaggattcattgatcaaatatttcaacctttcatatttttaagaaaacacccatatatattgaaatgcaaacttaaacatattctgttcacttgagtgtaatacttgatgcatgcacacacacacacacataccttctttatagctacaaagtcagggcgttcataggcaaaatctgacaagactgaaacaattgggagattatctttcaattcygaaaaattctgtgggtggcctgtctttaagcaatgcttttctcttgtgagggaagactgtaacacagctgaactatttcagtgtcaactattcagaattgaaaatgtaaattaaaatttccacaagcattgcttcagaatgaatttgtacctataaagcataaggcattaaatgacaataaaaattccaaatggactatttgttccacattgtatttttgtcttcaaatattttctaagagaatgaattatcccccaaaatgcatttagaaaacagtctttggtgatatttattatatgattatcaggttgttagatgataactcaaaattttcagtaggcaaataggtaatgtggaaatctgaagaagaaatgaatatccagtatagcagtgactttgactgctgttattacctatagctaagtgtgtatgataatgaaactcatcattttagtcaagtagaggcaatgcraagattcacatagtttatttcaactatttattgaatgattactatatgcaaaactctgtgctctgttctgtggcatagaacttcctttgatatgctgcatagctagttctaggcataggtacgtagtgtgacacttctgacttcactgaaattatggaagaaagacacccagaggaggcctctttggttggttcttttttcataggaaattcmttcataaaacatgtaacactgatcttcagatagaaaaagcaatctgtttatttacctgtaagggcaaagtcaatgagtamaacttgcatatgtcatcccatataactaagacatatgcatttatgggaagacaaaacaagaatgaaacacttatactgactttcatctggtagtaratgatttccttaatttttattaggtacgtaactatttccaaatcctctaatygcatactactctcaagtcccattgaaaatgaatgcttgacttcaactttttagttgaccaaatacaaacatcctaaagtagagcttagggcaaatatttgattgagagggcacaatttcattcagtacaagagaagtactgtaagcagtacctagaaataatctctaaaattgctatcctgataattttgttgacaggtctaaattacaatgaagttaaggttaggatttccttagttcttaatgtctcagtttttgaattctacctttaagggttttagtcaacatgccatatctcattattgcagagaacactacattactttatgaacacaggtgtctgagctagaattattctcttaaaagacaacataactttttatgtcttttatttactttttggtaatattaacttaccaaatcttctcctrtgcatttttaatatgacaaaacaaattttaaaagatttgaaataattgtatttctctgaattcagtgaagaaataattcatgattcaactgcatctccaaacattactcatgaccttgaaataaaataggaacctatgaaactattgatatgtgaatagatgggttatttcaacctgttttggtcacatcactatgccgagcaagaaaagtggatctcagggaggactagcagcccctggttaagggagatctggctgtgagtcatcatggcaagggtaatctttacaagcatagctgcctgcactctgtctctccaagtactggttaaggcccaaatgaaggcatgtcaggagagttagaggtgcatcacacatccgcttcatatgttggctaagaaacataacttagtctttattttgctgggcttctgacttttagaaacaaaattctaaaaatttgcaagtcaagtaagtgtgggtagcaaaaacaattatctttaaaaaaaaaatcacatcagtataggccatcaatatcacaatagatttctcaaggtaagagaaaataagctcatgagatgacattcacccttcaacataaaagaacattgggttaatgcagccttggtttcctgctgagctccagtattttgatagttaattatttcaactaatatatctatgtctatatcatctatcaatttattaagcaggtctatctttaatttgttatctcaaaccagtctgctggttaaatggaaacttaaaaatatccatggcaagctttgtatataaatgaacaaaaaagcaagcaaagcaaaacaataaactagcagaagaactagtaaaaatacaagcagattcctctactgatttctgtttttgtgatctctgactttcctttcaaatttttactgagaatatcgaaattggattatgcaataggatcttatttagttatttgaatctgtcttagccagttcctgtagaactgagaaataagattgactttgaatctgcaacragatctgaaataaatgagaagccaagctcttcaagcacctctatctctgtactcctatatgaagagaacagtaaaaaaaattactggtatttatttggttaaattcatttgcttattttttctgtttttggaaataatttgtaataaaaatcatggcaacataattcactttccatcttttaaaaatatattttgccattaatccaatatgtttccatcactttgccaaaacctatttaaaacagtgaattaaattttcactaggtttgaatgatcatgttttataasaaatgtctttattttagtgtgttaaaaccttattaaacaaacaactgtttaaaaagcataacatttttattttgtgtcacttctacattttttaaatgcattcatattactttcatttttcaaatatgaaacaaatgtgaaaatttgatgaagtccctttttcctaacatactcaattctttgtattaatggtaatgaagagaggcatgggtaaaacaatagattatagataaattacctttatttagctgtgatgcctccaacatatgatttgcagcagatttcaatgcctaattaaactggccttggttacaattgatgcatcttcctactcatacccctactgagtgaaaccattcaaccttatttctcactgctccctgtctcaagcccttagttagtgacatcatccccagaacatgtcataggaatctgtacctccatgactgttcatgtatgcctccctgcctaaaggacacgttcggttatctctacttctctcttcctgtccagttctgcacactttgctatggaaattcaagaccctgtcttttggaagtatcctgtttcagtcagtaggatctctccactttcatatctctgactagccttcttcttgcatgcactagggatttgactcattctaactggactgtctgcttgttcaagatggacaaggtttcctatcacactgcaaggtctagtttgtaggaatattcagtcaatacttgtggatagaattgaattgcaatgaggtctttattatccttaaaatgaagacaggatactctgaggtctgatttaaaaaggaataaatttaactgaatcaaaactagagtgctttagtaaactaccaaacacaaggttgaaaaaggcagagacattgagaaaaaaaggacagaatcgtataatggatttgggaggtagggaggaaagaaacatccccttttctctccatttctcttaagaattaagttgatttattgtatttataatttttttctagcacatgaatcattccctttatttcatgggaataaaataccaattatatgttaaaagaacaataatgcaaacttaaattcactggctaaggtgaaaatagaacaagacatgttttcaaataaagtagctcagtagcttaaaaaccaacaaacatcacaagacataaagtgtaagaaactcaatcttcttaactgctgccgtgccctttgaaaatggctgatctttcagttttgcacctgttatgcatgtcaacttttaggataaacaaacagaacaactagaaaaaataatcagtggatttttttgaaaaagaaagcatttgcttgattaatatatgagtacccacccagcagcatacacatgattttaacattcaatcagtgacaaatggcagagaatacggtctactaatacttcgtgtagtgatgcatgtaatgtgtggaggttcattcttgacgagattcatcatatcaaactcagatatgaaattaaaatgttaatacaaagacatgtctaattttgaggcagagtccaaaggaaagaaatgtagcctagaaatgtagtagcatgtcacgcaacagcttaagactattggcaactagtatctgaaggctcaaagaaaagccagatacgtgtctatcatacggtagaattcaataatcctgtatatgattgacttggttctgagtggaaacagacttaaaatttccttaaagacaaactctataaaacataatatcaaacagcagagagatggtgcttaaaaatcattatgagtttagaaattctctttgtaaacacttaacccataacctacttttagtaattttatgtaggaagcttttatgttagaatttgtaaacatttttagcataaagtgtttatagaaaaatacatttaaatcattttaaacatacacactaaaaagatatttttctacatattaaattgacttcccaattaatacatatttggaaaatccaattgtccttttttcttgatgcaaatactacaatttctttgtttttaagtgaaatggtggagtcctacctaaagaagggaataaagaaaagattatttcctatcttcataaacatgtgaaaatattttaaatacatttctactctttgaaatttggaaaagaaaatagaaagtaaagataatgtttttcatattttcataatcttttgcttttattatttttaattgacaattgtacaaatgagtacagtgatattttgatatatttttacaatgtgtaatgacaaaatcagggcaattaacatattcatcacctcaaacatttatcatttatttgtgttgagaatattccaaatccactcttctatttgaaaataaacaataaattgttgtaaattctgttctactcaccctaagtactatagaatgatagaatgtattcctcctatctagatgtgattttgtgtccattagccaaaatctctgacaatttctatctatcccatccattcaaactcctagtaaccactattccagtaccctctacttctataagctcaactttttaaacttccacatatgagtgagactatatggtatttgtctttctgtgcctgggttatttcccttaacatcatgttctccaagctcatccatattgctacagataacaggatttcatttttttcatggctgagcagtattccattgtgtatatataccacattttctttatccattcatctattgatgaaaacttaagttgattcatatcaagggctattgtgaatagtactgcaataaacatgcttcagttcatggttcagttcagaggtctttttgacatactgatttcctttatttttcataaatagccagtagtgggattgctggatcatatggtagttctacttgcagtttttgatgaaactccatatagctttccaaaatggctttactaatttacattcctaccacagtgtatcaggttcctcctttctccacgttcttgccaacatttgttgtattttatctttttgttgatagccatgctgattggaatgaggtgatattttattgtggttttgatttgcatttccctgatgattagtgatggtgagcactttttgttaaatataccgattggccatttatattcttattttgagaaatgtttattcagctcatttgctaacttttttttctcatcttttttttcttcttttttttattatactttaagttttagggtacatgtgcacattgtgcaggttagttacatatgtatacatgtgccatgctggtgtgctgcacccactaacttgtcatctagcattaggtatatctcccaatgctatccctcccccctccccccaccccaccacagtccccagagtgtgatattccccttcctgtgtccatgtgatctcattgttcaattcccacctatgagtgagaatatgcagtgtttaatcaaggtacttgtttattggctgagttgtttcagtttcttgtatattctggctattaattccttgttggattaatatttgcaaatatttttctactgattgtctgtttactctgttcattgtttactttgctgtacagaagctttctagtttgatataatcccatttgtctactttcgcttttgttgtctgggctattaaggccttctccataaaatctttgcctagaccaatgtcctgaaatatttcccctatgttgtcctctagtagtttcaaaatttgcggtcttacaccatttatgtctttaattcattttgagttgatttttttaatatgatgagagaggtctagttttattcttctgcatatggaaattcagttttcccaccactatttattaaagagaatgtctttcccaaagaatgtttttgttgcctttgtcaaaaatcagtggctgtttctagtttctctgttttgttccactggtctatgtgtcagtttttatgccactaccaggctgttttggtttaactttgtagtatactttaaagtcaggtggtgtgatgcctctagttttgttctatttcctgagaattgctttggctatttgggggtcttttgtggtttcgtaggaattttagggttgcctttttctatttttgtaaagaatttcattagaattgtgatagagattgaactgaatctatagattgcttttggcagtatggttattttcacaatattaattatttgaatccatgaacacaggatgtctttccatttgtgttttttttttcaattttttttcttcagtgttttatagtttttcttatagggatctttcgcctctttggttaaatcaattcataggtatatttcgtggatattatgaatataattgttttcttaatttctttttttgctagttgttggtgtagagaaatgctattcatttttgtatgtagattttattgcctgtatttttactgaatatgtttatcagttttaagggttttttgggagagtttttagggtttaaaaatatgtatataagatcatatcatcttcaaacaggaacaaattgacttccccctttccagtttggatgccgtttattattttcccttgcctgattgttctagccaagacttttagtactatgttgaatgagagtggtgaaagtagacattactgtcttattccagttcttagaggaaaagcttttaactttttcctgttaggtatgttagctgcgggtttgtcatatatggcctttattgtgttgaggtaggttccttctatacctagtttgttgagagtcttatttatgcagggacattaaattttatcagatgctttttctgcatatattgggatgattatattattttgttgtttattatattaatatagtgtatcatatttattgatttgtgtatgttgaaccatccttacaaccttaggataaatcctacctgatcatggtgaatgatttttttaatgtgttactggattcagtttgctagaattttgttgaggattttttaaaatctatattcatcaggcatattggcctgtaggtttctatttttgtgtgtgtatccttagctggttttggtacagggtaatgctagcctcatagaatcaaacaaataatgaatttggaagaattacttccttaaatttgcctgcctgcctgcctgcctgccttccttccttccttccttccttccttccttccttccttcctctctctctctttctctccctctctccctttcttctccccttctccctttctctctctctcctctcttcttttctatcttcttttctttcttcttttcttttcttttttctttcttcttttcttttctttctgtgtctgtctcactccattgctgaggctggagtgcaatgacgtgttcatagctcactgccatctcaaactcctgggctcaaactattcttctgcctcagcctcctgggtagctaggactacaggtacatgccaggaatgcctgactaatttattttttatttattttattttttattatactttaagttttagggtacatgtgcacaatgtgcaggtttgttacatatgtatacatgtgccatgttggtgtgctgcacccattaactcgtcatttaacattaggtatatctcctaatgctatccttcccccctcccccgaccccacaacaggccctagtgtgtgatgttcccctttctgggtccatgtgttctcattgttcaattcccacctatgagtgagaacatgtggtgtttggttttttgtccttgtgatagtttgctgagaataatggtttccagcttcatccatgtccctacaaaggacatgaactcatcattttttatggctgcatagtattccatggtgtatatgtgccaaattttcttgatccaatctatcattgttggacatttgggttggttccaagcctttgctattgtgaatagtgccacaataaacatatgtgtgcatgtatctttatagcagcatgatttgtaatcctttgggtatatacccagtaatgggatggctgggttaaatggtatttct

SEQ ID NO: 17584 - DNA, 44718 bp, Homo sapiens
tggcatgatgatagctcactgcagccctggactcctgggctgacgtgatctgcctgccccagcctcctgaatggttttttcttttttttgagacggagtttcactcttgttgcccaggctggagtgcagtggcgcgatctcagctcacagcaacctccacctcccaggttcaagccctgaatggctttttaaaaatattttctcagagtcagggtcttgctctgttgcccagactggtctcaaactcctgggttcaagcgatccccctgtcttggcttcccaaagtgctgggattatagatgttagccactgcctcctgtcaatattttttaaattaatagacattccttagagcagtttcaggtttacagaaaaattgagcaggaagcacagagttcccatattattatcccttctcttccctccgcagtttcccctgttattatcttgtacttagtccagtgatattgttttttttttaaactactattgtttttcagtttttagatagtcaaaacaaagttgtagacctatcattatcttgtatgggaatttaaaaaatgtatttcactgggctaatgtattagtccgttctcatggtgctgtaaagaaatgcccaagactgggtaatttataaagaaaagagatttaatggactcacagttccccatggctggcagagcctcaggaaacttacaatcatggaggaaggcacctcttcacatggcggcagaagacagaatgagcacaaggaggggaaatgctagacgataataaaaccatcagatctcatgagactcacagcttggggaaaaccgccttcgtgatgcaattacctccacctgtttctgcccttgacctgtagggattatggggattaaaattaaaggtaagatttgggtggggacacagagccaaaccatatcaactaaatattcaaaaaaagtactgctctaagagagtacttcaatttttaacttggtagccttggttcttgttcatgtgtgtaacactaacatagcttaggaggcagttggaaaaaatttgagtcaggggctctttaaagttcctttcttcatctttgagaaaacagtacgaggctttcccttgcaaagttctttccatctttacttctcttatctgaaacgcaaggaacctatagcttatcaaaggtaaatggactggaccagagtcgtgcaactgacctcagaggagagaaaggaaactttctgacttccaaccccaggctcattccagtagcctgcacattcaccacgggggtgtatttgaagattgatagctggcgatgtgttaggaggctcaaaagaggtagatttaggagcagagaaagaaagttctgtgtcggagaatcagcaaaccaacctgagaaactcaactcactccacaaaggaattgattgaaaattagatgtgttcaaaaataacttgaataaactcatggatactccatcataagttattaaggaaaattcctattcttctgacacgcttccatgaacaaccaggtccttccagtgccagagagagagtgttgggctgggcacacccagtgtggagccagtacatctacttttatgaaagtcatttagaagcatcactaaaggaactgaaaaacaattcaccaataatgacagtactccaacacctagttttatcttctaatctctatccatacatctatgtagtgtttatattattattattttttgagatggagtctcactcttgttgcacgatcttggctcactgcaacctccacctcccaggttcaagtgattctcttgcctcagcttcccgagtagcggggattacaggtgcccgccaccatgcctgactaatttttgtgtttttagtagagatggggtttcaccatgttggccaggctggtctcgaactcctgatctcaagtgatttgcctgcctcggtctcccaaagggctgggattatgggtgtgagacaccatgcctgatctacattatttatatcacagctcatgtacaaatttattttcttcttcttttgggcaaggcaattttatgatttattttggtatgtcggtataattatgttatcagtcatctcaatggctacacaatattgcagtattctaacatgtcctagtctactaggcccctatgttttgacatctaagttattttcagtatttagacagtcaaaacaatgttgaatacttatcattatcttgtatggggatttaaaaaatgcatgtcagcaggctaaatattcaaaaaattactgctccaagaaaataatccaatttttaacttaatattttgaaataatttcaaacttaccaaagagttgcaagaataaagacctcctcctacagtttggtgaacagctcttaacaagaataagatttgtaagagtccttcccatgccttcagcttgtcctgttttgatgtttctcattgtttgtgtggaattcacacaactggtgctgttaccaccatgggcgtctagtctggatcagtggtcctcagtcttttttgcaccagggaccagttttgtaaagatagcttttccacggacagagggaggggagatagtttcgggatgattcaagaggattacatttattgtgcactttatttatattactattacattgtattatataatgaaataatggtatgactcagcataatgtagaatcagtgggaaccctgagcttgttttcttataactagatggtcccatctgggggttatgggagacagcgacagatcatcaggcattagattcttataaggagtgcacaacctcaatccctcgcatgtacagttcacaatagggtttgcactcctatgagaatctagtgccactgctgatccaaccggaggtgcagctcaggcagtaatgcgagtgatggggagcggctgtaaacacagatgaagcttcactggctctccagccactcacctcctgctgcgcagcctggttcctaacaggccacggacagataccagcccatggccccagggccggggattcccagtctagatggagacctagacaaggcgtgcgacaataacaccgattttagatccatcatgacatttaccccatcccctgcaaagccagatggctaccaaaattaaatcttagtttagacacagaatgtccgtcttctggtccaaaacatccttgtcataagtttcttggctgggcgcggtggctcacacctataatcccagcactttgggaggctgaggcaggtggatcacgaggtcgggggtttgagaccagcctgaccaacatggtgaaaccccgtctctactaaaaatacaaaaaaattagctgggcgtggtggcgggcacctgtaatctcagctactcaggaggctgaggcaggagaattgcttgaacctggtggaggttgcagtgagccgagatcacaccactgcactctagcctgggcgacagagcaagactctgtctcaaaaaaaaaaaaaagaaaataaaaaaaaaaaaaacaagtttcttgcccactcttcctttctctgagtttccagagacatcacatcatttcttacccagctgagcagagtcccagcatggctctcgttcgaatacccatcctgccacctgccccagtgagaagggttggagcagcccctgttctctgcccccgccacctccatgactcatgcattctgtrggggaggcgcccactgcagaaacagccaggctggctgggaaaagccctgcagcaattccccgtccagtttctctgtgcccactttgtctccgtgttatctaggcctggatttatttctcttttttgaaaatgaagggctttgatgaaatgttcacaggatgtgaggtcaccaagatttttttcctttttttctgttcttttcttttcctcgaagtgatcccttgactaaaatcaaggctcccattgtcaccttatcagcctgcccatgcctaattctgcattctcaggcttccccagaatctgtccgagggaaaccaatctcaattcagaaggaacacagaggccccagtttctagggctgcaggatattgctgggtcttaatcattcgggtatatttcagcaaagctcagggcccctgctaatgatctgcaaaccctctcctctcagtctcccgttgtttagcccctatttataagtgagtgcatgtggttgttcactttctgtttctgagttatttcagttaggataatggtctccagtttcatccatgttgctccaaaagacagacttcattgttttttacggctttgtcgtattcctcggtgtatatgtgcattttctttatccagtcctccattgatggacacttaggttaattctgtgcctttgctattgtgaattgtgctgttgtgaattgtgtgtgataaacgtgtgagtgcaggtgtctttttgatgtaatgatttctttttctttgaatagatactcagtagtgggattgccgggtcaaatggatgttctatttttagtttgggaaatctccatattgttttccatagaggttcaggatccaggatttaagtgcaaccattcagtggaaaaccatcctctcaagagttcaaatgagagtcctcatgaccagcactccctgctgaacggcaatgccccaccccccaaaaaagcctccatcctcaccatcttagaccacattgcaggaaagcagccccatgcccaccagacaggcccacagctgctgctgctcatgggaggtctacctcccgtgctcagcaggcaacccaccccagtgccccttttctacaatgaccatcagcagggctgcagcttcataaaaatgtgaaaaacagtttgaaagcaatgtgaaaagcagttaggtgcctttcaacttcaaactcagcactcatggtttgacaaatatgagtatatttaggatcagaatgtatgaaatctggcctctcctgaatagtcggtcatcccacaatttcctctgccaaacttctcttccctccctgcgttctttctttcacctctctctcatttttacaaggtctggtctcagccagacatgaaccaatgatgatagatgctcctgctgagccctgtgatgtgccagggccctgacatgcgtggcttctctctgatcctcacgtgacctgcagatgcaaaagccagagctcagcatagttgaaaatcttgattgaggtcatatcccagttactggcacagccggatttaaacctaagactttcccctacacgacagggcttttatttctcagtcatctgaaaaggtgtcagcaagggaaatggcttgtctatttccaggggcattttacaagcaaatactgaaaggcttcggtgggcttaagggctgatggctttgatcgaatttcaggcatgttggccccaaggccctgtgtatattccctgggcccactcaaggggatgctggagccggaaagtycccggaggccacctactgcagccctgcactttacaaagaagagaaagattctccctaaaattacagaacagggccaaagatgcctaccggagcaaacccccatgggggcacctcctaccgcaggtgagcccaaggctggtcctgccttctcagtggctacccccctgagctcccgccaccacacaaagtgttccaatccttgtgcatcctccagtccttttaacctctcatgtcctgagaggccagagctacagccacagattccagaagacaccccactcccagccccaacctgctgcctttagaattataaacacttcttgtcatcacagggtcctgaaagtcccttttaagcctgggacactaggactctaaaggaagatgattcttaaggtcccatcccacttccaaattcctgcgattcaatgacatcacggctgtgaataatcagcctggcccgaagccaggatgggctgtgctgcttccaccgtgaacttcctccccctgctttataaaaacaggcctgcctcagctccctcatggccctgtccactgagcatcctcccgccacacagaaacccgcccagccggggccaccgaccccaccccctgcctggaaacttaaaggaggccggagctgtggggagctcagagctgagatcctacaggagtccagggctggagagaaaacctctgcgaggaaagggaaggagcaagccgtggtaggtcgggtttctgtrccttggggtctgtctcctcttctttctcttaaaagtctttccagcaagctgagccagtgaaggaatgctttaaccaagggaccaactttgtaattcaggcaactagaggatccrctagaatccactccagaggggagatgtctgtttgcatttgcatgtgattgggataggctggagtgttttggaggggagaggcagtcggggaaagggagactagggaggttgcattcattggagaagcctctgctgacagagtaaaggggaaagtgaaaagaacgatacagaaaagccccaaatagcctatgggagtacctcaagacgagcaagcaataaaagcaaaatcggctgccttgggacacgtgcctgtgacagctgggagggcccgctgggtcccctagtttcctccctcccccgatgaacccccagaaaggaactgaggctgtggatggggcagagggggacttacttccagagcactatttgctaggtgctgggagagagaagcaggtggctttcacaccccacattaccccgtgggatagagaaatgcctctgatctccctaggtgccacccctacaagtctccacaggtcagtttggccctctggctttttgcccagggtgcatcagtcaagtgtgcagtcctccttaaaggacattttaattacaggggaaaaaactgacattaatgtcttttattcctaaagcactctgcaggaagcatgtggggttctccagattttcactgttattatctttattttyttaacctcacagggagggagagaggaagggagggagggaagacsaaaacmcgccgaggtcccaggtaactaatgacaactcaagctcaaagaagtgtggtaacaaggatgtgtttggtggccaattgggaataatatggtggtctcctgtagctgcttgatgacagaaaaaatgtcgtgtgtgtgtgtatgcgtgtgcattgcagtcccgggaaggggtcttgcaaataccattgtcaggtggagtcccctcaaaggtgacttcctagcagtacttgctgtggcaagaacgctcattctgggatctaractcaatccatgacggtcagcatgagctgctgggtgygtgcttcctgtgcaggcagartcrgactccagcactggcagggacactgtgagtattgagatatgaatagctccatcctgcccacccatttattccacctaaaatgttctcaaagatgcaagcctccaagctctggatcaaatgataaagccccagatcaaaatctcaggagcaaatgaaagctgcccttgtctccaaaatgctccttctctgcccgactccccaagaccagcttggtttatttcacaatgactcgcgtcggattctcccagtgtytgcggctccccctgcttcatcacaggcctgggacagtccaggcagccagggaatagctgggaatagcagttcccctttgttggtttttgagttcactgaggctttgatttcccccagggcctgacgttgctgagcagagccagcggccagtagatttcaaaggattccaaaaaacagtcwggcactcctttgtgaacccaaaagtatctgagacaggtctgtcaatttagaaagtttattttgccaatgttaagaacacacatgtgacacggcctctggagatcctgaggacatatgtccaaggtggccaaggtatggcttggtttcatacatttcagggagacatgagacattaatcaatgtatgtaagatgtgcaccggttcggtctggaaaggcaggacaactcsaagtaggggcttccaggtcatargtagataagagaaggcttcattcttctgagtctttgtcagcctttcactgaatacacaatttacatatgagaggggggcagaggaagagtcacttatgccttagttggctcagtgaatctacttttttttttgagacggagtttcactctttttgcccaggctagartgcaatggcatgatcccggctactgcaacctccacctcccaggttcaagtgattctcctgcctcagccttctgagtaactgggattacaggcgcctgccaccacacctggttaatttttgtatttttagtagagacagggtttcaccatgttggccagactggtcttgaactcgtgacctcaggtgatccacccacctcggccccccgaagtgctgggattacaggcatgagccaacatgcctggcctgaatcttcatttttacaaaaacaatagggcagaggaagcaatcagatatgcgtttgtctcaggtgagcagagggatgactttgagttctgtcctttgtcctgtacccatttgcattgccaaggtgaagttcagcagaactgttttagggtaaagatcttgaagtccacaaggagtttccttgtgggtaaattgtgagagaggtatgtagccttttatctttgtagccgtcttatgtaggaataaaatgggaggcaggtttgcctcatgcagttcccagcttggcttttccctttggcttagtgatttgggggtcttgagatttattttcctttcataccttggtagtgtcacttgaagccaccacgcccggctaatttttatatttttagtagagacagggtttcaccatgttgatcaggctggtctcgaactcctgacctcgtgatctgccctcctcctccaaagtgctgggattacaggcatgagccaccatgcccggccaatttttcttttctttttttttttttttaagatggagtctcgctttttcaccaggctggggtgcagtggcacaatcttggctcactgcaacctccacctcccaggttcaagcgattttcctgcctcagcctcccaaatagcttggattacaggcgcccgccaccacacccagctaagttttcaccatgttggccaggctggtcttgaacacctgacctcaagtgatctgcccgccttggcctcgcaaagtattgggattacaggcgtgagccaccatgcccagacaggtttttctttgattatttggcattatgcacctgcagtctcagaataaattttttactttctctgagtgattttcgcttctgctttgatgagattgttgggacggacaataagggaccagtgcattctgctcattccttcttggggccatttcttttgtatatacgggagaaaatgtctgtctatagtgtcaggctataaacctcgtcctagtcaagcagctcacaaaaccatatggtgggtctcacatcaaaccaggtaaaagagtgaggatgatttagactcaaagaaaattagagctagaaataaatttaaagctcatccaccctgctccaaccctaagtcaagccacatggtcttccgatagtggctcagttttctacttacataaaaagacagcacattctcttagcaatatgtgtttgtrtgtgtgtgtgtgtgtgtgtgtgtgtgtgtgtgtgtgtrtatatatatatatatatatataatttagagacaaggtctgactccatcacccaggctggagtgcagcagtgtgatcgtaggtcactgaaccttcaaactcctgggctcaagtgatcctccatctcagcctcccaagtagctaggactacaggggcatgctgccatatccagctaattataaaatttttttgtagaagcagagttttgctttgttgcccaggctagtctcaaactcctggcctcaagcaaccctcttgccatggcctcacaaaatgctgggattacaggcaagagccactgtgcccagtccctcttagtgatattttgcatattatatattcaaaaaatattttctatgtatgccacttgggaaacttctgtagaatgggatagagggacagataaacccaattcttgatccactcaaaaataacacctgtgacagagtgaagatgaaacaggtgctgggcacacagcaagtgttttagaaacatttttgaactcaactttgcctgagttgtggtgctgatcatggctgccaggaaatgctagccagctgttcttcctatacaagtatatgactgggtgtctgcagcagctgcccggctgtgaattgcacacaccaatggccaagacccagcagcgacttggctaacaggcccagccgatgtgcatgggtgaccacgcgatgctcctgacacacgcactggtggcttagggaagtttttttgaggattgatcagaagatctgattccacctggagcctctgaagtgatcacttccaggttaggctgaacccagataccaggagacctgtgtattgagagccttttgttttttttatgtagtcacaactattccattaacatacagctaggcattagagaatccatgctggactcctacaaaggcccctagatccttagaacactcagagattccaaagcacacgtcctcccaggacaccctggcagaagagcccgggggcgactgtcacctttgcctgctgtcgggagctgtgctgatgggtagggggctctgtgcttgctgtggcccagagccaagccgtggggatgtgctctgtytggagcagaccccttcactgtctgcctaactccttcgtgtgttcccggaacagcttctgtgttatgcattccagaaagcctgcctgaccaccccaacctcaacaagcctgggatggacaacctcctccacattccactccaagcccacccccgtccccaccctgctgcgtggtatggcgctgctctgctgtaccctgagtgtctagttattcatcaggccccttcctaactatgagctctttcaggataagagctgtgtytttgcatcaccagagcctgtgccagggcacggctggtgctccatacacgttgatggtgaatatatagcatgggtagatcattgtctgtgaatgcttaacagagaagcagctcatgtgggtgcttgagggctgggggggcagggtgggggtctggtaggcgctgggaggaggacatccctgcagcttctccagccccatagatgggactcttgatgtgggcagtttttatttcagctgagtctccagaaggcaggggacagggactgggaggggatgctaaacccgataacccagtatggatgagctaacagaggccgggcacacagctcctgcctgtaatcccagcactttgggagcccgaggtgggcgggttgcttgagccaaggagtttgaaaccagcccgggtcttgaacatagcgaagactctgtctctacaaaaaaatgaaaaaaaaaaaaaaattagccagacatggtggcacgcacctgtagtcccagctacttgagaagctgaggtgagaggatcacttgagccagggaggttgaaactgcagtgagctgtgatcacgccactgcactccagtctgggtgactgggcgagaccctgtctcaaaacaaataaataagaaagagagactactggtcaacttgatttctgctggttattctctttctgtcatgttcaccaaaaagagaaacccgttgtattttatcttgttgtagcaagagccggtgtctaacacctgggctactgagagaaagcgaagggtttttttctgggaagctccaayttccttatttctctcacatgatgcctctgactttcatagtgtggcttggtcagatgggccttatcaatagagatggcctgatgtctcagctgtgtcatctcagctgctagttctggcttctgctgggagtccacagtggcctctgcatgcatggtgtgggaaaggcaaataaaaaagcagattaaaaaccagattaaagacatcaccctgtattcaggaaataatggctcctgttgatactgttctacgaacacagatgaaggcacaaaattctacatcaattgcagagaattggttataggctaacacaggtggtcggatgatctaggaagcaggattcagtattaacggggatccatgaggaccccatgaagcgtggcatctcttctgcatcagcagcttcaagttgttccagggagaagcgggaagcctcagtgcttttgttgaggaaggatgttcatgacagtaggtgcaggtcgctcctgccgtgcaccyaggtgtgggggaagractttcctgcttcttttccagttaccttacaattcagcaagacggaaatgattagcccatgacaaaaacyaggaaacaggctcagagagagtgagttgcccacacagaatgtgtgctgtaaatgcagttagatttccaggttgagaatccagtgaccacgccccttctttgtggcattctgctgtcgtataccatgtggaacacattaagaacgttatggccaggcgtgttggctcacgcctgtaatcctagcactttgggaggccaaggtggacagatcacctgaggttgggagttcgagaccagcctggccagcatgccgaaaccctgtctctactaaaaatacaaaaattagccaggcatggtggcacacacttgtaatccgagctactcgggaggctgaagaaggagaatcgcttaaacccaggaggcggaggttgcagtgagctgagattgcaccgttgcaatccagcctgggcaacagagtgaaactccatctcagaaaaaaaaaaaaagttacaattgggtgtcacatagacagtgaggagtagtggaaagagtgttagatttggggtaagagaactgtgtytcctgggcttgagtcctgatgccaactctcacaagatgtgtcaccgtacagcacgacgcttatactttttttttttttttttttgagacaggatcttgctctgtctcragctggagtgcagtggtatgatcacagctcactgcagcctcaaactcccaggctcaggccatcctcccacctcagcctcccaagtagctgggactacaggcatgtaccaccatgcccaaataawtttttgtatttttttgttgagatggggttttgccatgttacccagggaggtctcaaactccaaggatcaagccacccaccctccttggcctcccaaagtgttgggattacagatgtgagccaccacaccttgcaaatttttgtattttttgtacagccgagggtctccctatgttgccgagggtgatcttgaactcctgggctcaaatgatycaccctcctcagcctcccaaagtgttgggattacagacgtgagccacygctctcagccccttacacttttttgaagttcagttctcccatctgtaaaaacgaggtaataatattgcctcaaatgacttaatggatgtgaaagggtttagtaaactctgtgcctggaaaggtagaagctactcaaatatctgttgagtgagtggcattcatccatgtgtacatttctcaggcaacaataatgtcactttcacctaaggccagtaaaatgtgggtaaagtcatataatgatacaatgaaagtttctgatcagtatttcctaattcaagtgtgttgaaatgtggagttgggctggagaattgtcaaatcattgcgtatttaattaccttgtggtgatgtttgctttagggagtggaaggaacatgaggaacgaacgaccttcatcacggaagatgacattcatttcgattcactttagatttcagggcttgtttagatgcagactttgcagttaacattttattgcactgactgatttagttttcaccaggtggtccttgtgtttgcttcagaaggatctaagtgtattaggacagggtttcttctgttttgattgtgggaggaggcgggatagacttctgttttcctagacccacaaccaaaattccccactcctccaaataaccgggattaccaggcagagggtggagcattgaggagatgacagctggacatgcctgctgtagctttttctgagtttaattccatatagcttagacacaggccatatgcctacatttggaagatgttttggagaaaattctgctctgatgggtggggggcagggtctgccaggaaaatattctattcttttgaagacatggggtcttgctatgttgcctaggctggtcttgaactcctcgcctcaagtgatgctcctgcctcagcctcctgagtagctaggactacaggtgcaaaccaccacacccagctctgagaggatgctatactcttcacttcattggaattggtgaaattagataagaaacagactcttcctctcttctcccctagttataaacagttctgttaagagagggaaaataaccatttagcctatagaaaatcaccttttcgaaaagttaagaattacttatgtgatggtagtttttgaaagtggtttttattctgagatcatggcctctgtactatgcagggcctrgagaagtggratgagagctaccaggctcaaagctcctgtyccgaacaaagggttgctttcgtgggagcasgycaccctttccaaggctagttcctctcccagcatctcacttcagctctcgtcctgctctagaaacgtgcctttgctggtccaaggaatcctggccgtttcttttcttaattgttggcattcatctgggctatggtggttgtggcgggggtggcagtggagagtgtgttgttttaaatccatgagtcattttagggtattggtactcttgaagactgactttctcttgctcaggttttcagagagaccttttgctaagcaacaataacctaagaatctccttgaccaaagataaatgtagcaaactttgcacatggtgcaacatttgataatagtatcaatttacgtttgtctttcccttgcaatttccctcctcctctagcttgctcacgtttctgccttcttcttgctggcaagagtacagactataattctccagttcactaacatctggagcgactgcactgtttgcartttcattgattgactacatgtstacagttcctttattgcaagtcacttttctgtataatcttttttgagacgaagtcctgctctrtcgcccaggctgcagtagcgcaatcttggctcactgcaacttccgcctcccgggttcaagcgattctcctgcctcagcctcctgagtagctgggattataggcgcccgccaccatgcccagctaatttttttgtatttttagtagagatggggtttcactatgttggccaggcttgttttgaactcctgacctcaagagatctgccagccttggcctcccaaagtgctgggattacaggtgtgagccactgtgcctggccatataatctatttttaaaatgtttttatatgaaaataaacagagacagagtctcactgtgttgcccaggctgatctcgaactcctgggttcaagtgatcctcccaccctggcctcccaaagtgctggggttacaggcgtgaaccacctcatgtggcctcgctttcctatataatttaaacaatagaactatagtgccatttgtaagagtttcccagtttatactgcatgtgacactccccatgtcgtatgttctcacaacagaacagaaaccgcaggatgtcagcaccggaggcraccttggagcatccagcccacttggttttgcattgctggcaggagattttatgcctcaaaatatagatgctttttggaaggacagcacattaattatttttcagtcatttttaccttatgygaacaagctgattagttcctttcctaggagctggtttttatggagggaagatggggccggtagaggcagatagagggggatgtaatacacaggcactgagacagcaccccactgactttcccctgtccctcctccagctggcctcctcctttccaggggctgtrcccaatccagaatcagttactcactggtgcccatcgaccatcatttccccatgtggccaccaaagaaatgaacaccacctttctggttggcatgatcatcaatttctcagccaaaacggcatgcatccttggctctgggaaacagtacatctcccaggaaagtgagcttacagcacggtaccccacttcctggttaccagactattgttcccgttttccccaagaacagtcatcattcacaggttgtttggcagggcccaggaacagagtcactctggttgctacagccaacagaccaaacacggcttccaggcaggaaggtcagagctgctctgcaggatgcacatgcaggttggaagcagacagggctggccgagcacagatatgctggctgtgtcctacacacaggtgcctacacacacatccttcagatccgggctgcactctatcagccaacccacggactctgttttttytaatttgcacagattctttgtcaacctgccatgccctgagactgctgaacttcatccaacagagagggtaccttttgcaaatctgcaaaaatcaactttgtgtgctagggtggcctgacagggctaggccttggggtcttggggaccagcattccacctctcctctcatacagtgattytggattccagcccagcaaaagtcagccaaccttggggccttcctttctttcatcctttcttttttttccttttctatccttctgtgcctcccttcctacccccttccttccttcttctcatttgcctttttttttttcagttctttgatgatcctgagaagctactaaatatagcaaaagggagataacacagaacaaaattagaagtctatttataaaaatgagcctcttccatcccttccgccaatgtcatctctcacccgggtctcgccagarcactcatggacctccctttggtgaggcccaaagtccatcccagccacgccctgcggtcccgagtctgagtccattgttctggctttcactctgctctgcatcccgtcactggccccagacctcgacgcccacctcttcagcgaaggcgaaacaaggactcatttttcctccctctcttcgctctttcttgttttcagactgcactgtttttctgctggccggatgactcatttctttgtcatctcttaccccacttggccttttcagctgctcgaatcgcctctgtgtgatgcggacagagctatcgccctgctggggtgagattcacttgcattgaatcagctcaaggcgcaggaaggtccagggaagccaaggaagagaagagmcaagtctccaactctctcaggagcaaagacaaaaataygctccygctctcytatctcttattcagaccgttcagttgcaaaagggttgaacatgatgcagcgggtggtatgtgtggaccagccctaggtcgtgcttctcctccatctggtccccccacccctagttatccagaaagggggatgttcccaggcaatgccaacatgtccatactgcactcttcacattgcagtttcccggcatctgggattgcattccttttggaaggactttgagttcttgaaataaagaagtaacttggtgggcatctggaaaaaacacccaaactgtatcccaggctggggtgcaggagcctatcgagagggctggktggtgtggacagcgtgatgaagaaggtcaagttccttgtactcactcgtttgctgtttcattcacaattcctgtgaggtgggagctctcaccatccttgggtcttgcttaagagtaaggagtggggcaacctagagatacatgaacatcaaggagaaatggggagggagtttcacatgagctatttttacaagattaagtaatgggataaaatttaaaaggggaatttaagaggaattttgggcagttttgagaaacaggaaatttgaggaaagctgagaaagagaagatctggagtaagtytctgtgatgagaagattccaccccgcactcctgttctgggtggccttggctcctgrctccctttcttctgaaactgcctggagccagggagtagcacagctgcttcctcccggggagaaagggacacccaaagagcgcactccagggagaccttgggcactgcgggctcaaaggctggagatkgcacttctgttccctcctgatgggacaggtgcagggargctgagaggatgccacgctggcgagcctccctctgagctgtgttttctcattggaattgctgtacccggagcctcctgcaggtttccctcgccctctccctaagctcctctgcctgacacaggagcccggggagaatctgtcaggcatgaaatgtagcgaggcaaggagggtgatcagcacctcccacgggggagttcgtttcgaagtaacaatcaaagatccagagccggacccaggcagggaggcaaggyctggaagcccctgtgcctccargcccctaggacgctcgggggagggggagggggagggtgggacctgaagttgttgtgaccgaagggaaatgagtcagggaaagaaatgccatgctttaatttttgtggatgaaggagggaacaggccgccagaccacaaaataacacccggccgactaacctacttttagctgccgagggcaggatcacagaggagaggcagatggaaactggggctctggggtccaggaagatctgagtcttccgaccaaacatcatttgcctcccctccttcctgcaaatatgcacattgccggatctgctgcagtctatgaaaaaggagacagatgttctggcagagcggtggggggggtgggcgtggaggttgggttggggggcctctgctttgtggggagaacctcaggcaggggagtaggctccatcctgcgtggaggaacctgagcagtctaaggcaggctggctctatgatgtgctggcaataaaatcccaatggcttccgctgcagaagtccaagaggacatgactgcggctccatctagtcaagcccagggcaggaattcccttccaggaaaccaagccagagcgctgtggtctctgggctgccaagatgtctcagaaatggtctagcccttcagcccacagaaatctctgggcaaaattatctcccagcattgacagacgaatggataaacaaaatgtgttctatcccacagtggagtattattcagctttaaaaaggaaggaaaaatgctgggcgcggtggctcacgcctgatcccagcactttgggaggctgaggaaggaggatcatttgtgcccaggagttcgagactagcctggacaacatagagaaaccttgtctctacacacacacacacacacacacacacacacacacacacactctctctctctctctctctctctctcagccaggcacagtggcacatgcctgaagtcccagctctgggaagctgaggcaggaggatctcttgagcctggtgggtcaaggctgcagtgaaccatgttcatgccactgcactccagtctggatgacagagcgagacctagtctcaaaaaaaaaaaaaaaaaaaaaaagaaagaagaaagaagaaaggaaaaagaaaaaaaggcagcggggcgcggtggctcacgcctgtaatcccaccactttgggaggccaaggcgagcggatcacgaggtcaggagatcgagaccatcctggctaacacggtgaaaccccgtctctactaaaaatacaaaaattagccgggcgtggtggcaggcgcctgtagtcccagctactcaggaggctgagacatgagaatggcatgaacccgggaggcggagcttgtagtgagccgagatcacaccactgcactccagcctgggcgacagagcgagactccatcttaaaagaaaaaaaaaaaaaggacatgctacagcatggatgcaccttgaagacatttgcaaagtgaaacaaaccagtcgcaaaagaagaaacactgtctcattccacttctaggatgtatgtagagcagtcaggttcatacagacagaaagtagcagcgtggctgctggggaaaaggggaatggggagttattctttaatggctacagagtttcagttaggggtgatggagaagttctggagatgggcggtggtgacggccggccgcacagcratatgacgtgcttaatgccactgaactgtgcactgaacatcgttaaggtggtaaattttgtgttatrtatattttgcaacaataaaaaatatgtagtttctagaatcctcttctagatgcatgtctggcgtttctgccgcggggctggcactggaggaagccagacaggacaacattgcggcttatcctcctctgttgccatcatggacctctcgcaccccgtgatcaagctgttttttctctccttccagaatttaagggacgctgtgaagcaatcatggatgcaatgaagagagggctctgctgtgtgctgctgctgtgtggagcagtcttcgtttcgcccagccaggttggtgtgcaggatccctgtgtcccgcccctcaaggctgtgatgcttccggaggctccaggggtctgtgtccatctgggccacggaggttggaatgctgtcagggagcagagaggcacagggacgaggggctggcattgctgtggagcacacagcacacactccyttytgtacagcaaactctgtatttgggggcccagtgtgtagctgggccctaggcacttattttgacctgagtaagcggaattaacatgccactccctgcctgtgactgcctttttttgcagctgtttttaaagaatgtattcaaattaatccataaagtacagttgtccctcatatctatggggtatttgttccaggacccccaaggataccaaaatccagggatactcaagttcctcatatagaatggtgtagagtttgcatatcctatgcacaccctcctgtatactttaaatcatctctaaattacttataatacctagtacaatgttaatgctatgtaaatggttgttataaggtattttttaatttgtgttatttttattgttgtattatttatttatatattttttggaaacagggtctcactctgtcacccaggctggagtgcaatggcacaatcatagctcactgcagcaccaaactcctaggcttaagccttggcctcccaaaactctggggttacaggtgtgagccacaagcccagcttatattattattttttatttttctgttttggttgaatccacagatatggaacctgcagatatacaaagtggactgtatttataaaagacaatgcaggacagggcacagtgactcacacctgtaatctcagcactttgggaggccgaggtgggaggatcgcttgagcccaggagttggagaccagtctgggcaatatagtgagatgctgtctctacaaaaaatttaaaaattagccgggtgtactagtatgcacctgtggtcccagctactcaggaggctgaggcgggaggatcgcttaagttcaggaggttgggacttcagtgagatatgattacgccaatgcactccagcctgggtgacaaactgagatcctgtctcaaaaaaaaaaaaaaaaaaagaaaaaggcaatgcaagtgccatgagccacagcagaggcaaactgccctcatggtgcctactctctagctgagatggaagcgctacacacactctctgaaaatgcctagcaataaagggcctcacggaagtccaaactaaccacacctctccmacaggaccctacagcggggagagccaggtgactgcgtggagtagacagycagctgcaactccattgcccaatatggtggycacttaccttgtgcaactgtttaaatttaaaataattaaagttaaaaattgtttctcagtcccactggccacattcaaagcactcggtggccctgtgtggcttctgtcgtggacagcacagacagaaaacatttccaccaagcagaaagctcttctggacagagccagtcaggaaggagaggaagaattggactagaaggcaggagatggactttcacttgggccagttacccgagggggtctctgagcagaggtatctggccggcaggttcacatgggcttctgggttggccgcctttactcttagtacacctggcwtgtgctgatccttcctccacctctggtttcttcgcaggaaatccatgcccgattcagaagaggagccagatcttaccaaggtcgggtgaagctgaggggtgcatggggtcatcagggagggaggcagggcggggtgcagggtgcatcacccacccaccacctgccttcttccacccaccacctgcctacggtgtgacagtgccattgcagcatgrttctacagagatgcctgtgtcrgcaccattctcccatcagctgcggccactgggcgggttctgattctgaggggagcagaaacaggtgttcccccccaaggrgccaggctgtcagggatcacaacctagcgggggctggggggggcggccactggyccaaggtyctrgttatacagatcaaaaggcagagcccaggagagagcaagtggcttgcccagggtcacacagccgccagcagcacggccagggcagtcacagccgaggccaggcccatgctctgggtctcatcctaggctgtgatcccaccacagtgcaccggcagctttggtaacaacatccctgtgtatccatttccctctgttgatccaaccgggatgtcccaactgggatgtcccacccaggcaacccctcgacatggtggggtctctaagtccacatctagagttgactctagaaggctgaggaatgcgaggcccagcttcaggtccaaaactaccaacttaggccctcgatttccctccttcacgacccagttccttcgagtctggaagactctgcaataccctttgtgaaggtgttaaaaagggtgactcactccccagagcgagtcacacctggactcttaatgccttcgttgttggatggcatcctgcttcctaccaggttatcctggcctcagtgacctcagaagcagcaagggtctgacttacagtgggcacgtgctacttctttaattaattgaaagtaaagttgttgttttttaagttggcattctggcttgaaaacagaaagatggcatgaaaatattaatgggagtacttcaactattttcattatgccaaaaatacttggagaagtagcacattttctgcaaagtctaaaatgtcaattttctttggggccaaaaatgcatcatttctgtgtggtaatacttatgtggataaaaaactctggtagacagttatgcatatatatattttttggtgaattacaatgagaaaaagtccaggtgcaatggctcacatctgtaactccagcactttaggaggcggatccaggaggatggctttagccyaggagttcaagaccagcatgggcaacatagtgagacacctctgcctcccccaccccaccccgcctctacaaaaaaatttaaaaattagctgggtgtggtggtgtgcacctgtagtcccagctacttgggaggttgacgcaggaggactgcttgagcctgggaggcagaggttgcagtgagccaagacagcaccattggactccagcctgggtracagagaccctcgaaaaaaaaaaagaaaaagaaaagaaaagaaaaaattaggctgggcacggtggctcatgcctgtaaccccagcactttgggagaccgaggtgggtggatcacttgagatcaggagttcgagaccagcctgtccaatatggtgaaaccccgtctctaccaaaaatacaaaaattagccgggcatggtatcgggcacctgtaatcccagctactcgggaggctgaggcaggagaatcacttgaacccaggaggtggaggttgcagtgagccgagattgtgccacttcactccagcctgggcgacagagtgagactttgtttcaaaaataataataataaataaataataaataaataaatcatatgagaagatactcaatggcactcagaaaagaaatgcaaatttattttattttattttgagatggagtcttgctctgtcgcccaggctggagtgcagtggtacaatctcggctcactgcaacccccacttcctgggttcaagcaatactcctgcctcagcctcctgagtagctgggattacaggcacctgccaccatgcctggctcatttttgtatttttagtagagatagggtttcaccatgttggccaggctggtctcgaactcctgagctcaagtgattcacccacctcggccacccaaagtgctgggattaccagcatcagtcaccgtgtttggccagtattcattatcttgttgtcttccagttgtgtctcttcaataagggagtatgcaatggagtctatagaaagcaagtgagggagttttctcagtaggtgcaagggtagtgaggcatttcattttgagtcatactctgatgaggctggcctgtcttttctcatagtgatctgcagagatgaaaaaacgcagatgatataccagcaacatcagtcatggctgcgccctgtgctcagaagcaaccgggtggaatattgctggtgcaacagtggcagggcacagtgccactcagtgcctgtcaaaagtatgtrctgaggctggraggtggtgcatgcctgtgatcccagcactttaggaggccaaggtgggagggtcgctggagcccgggagttcaagaccaatctgggcaaacatagcaagtcccctgtctctacaaaaaataaaaaaattagccagacctggtakgtagtcccaactacttgggaggttgaggcagaaggatcacttgagcccaggagttggaggctgcagtaatctacgattrtgccactgcatttcaacctcagtgacagggcaagccctcacctctaaaacaaaacaaaacaacacaaacaaaaacaaaaacacagaaaagcccagtacaaatcgacttcaaactgagacttcgagttcaggggtccagtcatgaaccctgtctttcatggtccccggaaagttcaaatcttcaaaaggagcctccaggcctgttcggccttaggcggaggtgaaggtacaagcagaaaagggagcaagaccaagtgaccttgggcaaatgcccgcttgyctcagtttcctcatstrtaaagaggtgggaataacagtacacacttcatggtttgctgtgaggattaaattagctaatttttgtagactgtacaacagcgcctggcacatagagcacattcttaatattttaactcacatcatccttggagctgctttgaaaatacaggggacccttgaacaacacttgtctgacctgcagggtycacttatgtatggatttttttcaaccaaaggcaggatgaaaacagtatttgtaggatgcagaactggtatacrcgtgttccacgctgcaggacttgagtgtgtgtggattgtggtagacagggctcctggaaccatrgcctgagcacacagaaggaggctgtcattaggggcttccttttttatacttgacaggttgcagcgagccaaggtgtttcaacgggggcacctgccagcaggccctgtacttctcaratttcgtgtgccagtgccccgaaggatttgctgggaagtgctgtgaaataggtgagtaggtgagagcacgtgaaacgagctgaaatcccacctctccagtctcccccgcccccggaaggaaaggcagggtgcsatggcagggccaggggtgggggccarggacagggaaggcgcttctgccatgggtcaggaagcacagtgccacacagcaagcagagccyaggtgtgaccctgaatccaggctggcacccttgccacccagcctgtggcttccgagccagcctgcatcaggccygggggaggacggggcagagaggggagcctcctgagggctgaatgaaaggggactcccatgtgaggcatccatgccctgctctctgtcagataccagggccacrtgctacgaggaccagggcatcagctacaggggcacgtggagcacagcggagagtggcgccgagtgcaccaactggaacagcagcgcgttggcccagaagccctacagcgggyggaggccagaygccatcaggctgggcctggggaaccacaactactgcaggtgagggcacatccccaaggagggattccccctgtgagaagctgytacagctggggaaagattctgtcagatccgtcagggttctcccaagaaacataaccaatacaggatggatagatggatagatgatagacagataatagatgataggtgatagatgatagattgatagatgatagatgataggtgatagattagataaatagatgatacatacatgatagatagatgataaatagacggtagatggatgacagatagacagatgataggtgatagatagatgatagattgatagatgattgatagataaatagatgatagatacatagatgatagatggtagatagatgatagatggatagatdatagatgataggtggtagatgatagacagatgattagaaagatagatgatagatacatagatgatagacacatagatgatagacagattgacagatgatagatgattgatagatgattaaatagatgatacatagatdataatgataaatagatgatagatgatagatgataggtgatagatagattgatagatgatagaagattgatagatgatagatacataggtgatagtagatgtaagatgatagatgatagatagatagatgatagacagattgatagatgatagagagatagagatagagaaagaggagagagaaatagagagagagagagaatgtgtgtgaacccaaagtatctgagacaggtctcaatcgatttagaaagttgattttgccaaggttaaggacacccccgtgacacagcctcaggaggtcctgaggacatgtgcccaaggttgtcagggcacagcttgcctttagacgttttagggagtcatgagacatcaatcaacatgtgtgagatgtacatcggtttggtcgggaaagttgggataactcgaagcaagggcttccaggccataggtagataagagacaaaaggctgtattctgagtccttgatcagcttttcactgaacacacaattgagtctggctcagttcatctgcatttttacataaaaaatagggcagaggaagcaatcagatacgcatttgtctcagatgagcagagggatgattttctgtcctgcacctgggaagataagctatccatttacaatgccaaggtgaaagtcaacagaactgttttagggtaaagatctttaggcctgcaaggaatgtccttgtagagaattaaaaaaaaaaaaaaaaaactttgcagctatcttattgaggaataaatgagaggcaggtttgcctgacgtagttcccggcttgacatttcccttggctcatgacgttggggtcctgaratttattttcctttcacactagatagatagacatttatgttaaggaactggctgacaggatcgtgggggctggcaaktcygaaacatcttggtaagccaggctggaagtgcaggcagaagctgaggctgctctcttaaggcagaatttcttattcaggaaacctcatatttgctcttaaggcctttaagtgattggacgargcccaactacattatctaggacaatttccttttctaaagtcaactggctgtagatattaaccacatctataaaacactttcacaactcctagatgaatgtttggttaactgactgggtgccacagcctggccaagttgacatataagactattccagtccacaccttgtcaatttggcacccatgtgcatctccttaaaccatccttcacctccaagtaaacacaggaacaaaatcatactcctgcctaacatgatagaactaccagtgtacaaccaaaaacgcactcccggctgggcgtggtggctcacgcctgtaatcccagcactttgggaagccaaggcaggtggatcacctgaggtcaggagttcaagaccagcctggccaacatggtgaaaccctgtctctactaaaaatacaaaaattagccaggcatggtggcaggcacctgtaatcccagctactcgggaagctgaggctgaagaattgcccaaatccaggaaacggaggttgcagtgagaggagatgcgccgctgcactccagcctgggataaacagcgagactctgtcaaaaaaaaaagcaccccccattcctccagaaaaggataccaaagtccttgggtcctaaaggagaggcttcacctttgacctaccctggcccttcccttggctgatttttcagaaacccagatcgagactcaaagccctggtgctacgtctttaaggcggggaagtacagctcagagttctgcagcacccctgcctgctctgagggtaagtggcagccaccccgcctttccctgaatgtccctgggggaggaaagtccaggaggacaggccgatagccctcctgcacctgaggggagaaagggggaggccaggagtgagtcattttggttgcagagggaagaaagacaggacttaggtctgygcctgggctyggcctctgactggctatttgtctgacctggagctgatctcctcacactctgaccctcaatttcctcctctatggaggagaggatggggctgaatcagtggttttcagtccttttgagaatgaatggagattctcccttttttgattaatgggtgaatggggctttgtctctctttcgctccctctcaaactttttaatgcaaaaaaaaaaaaaaaaaaacttccaagattgaaaaaatatatattaagttacaagaccaggcacagtggcttatgcctataaacccagcactctgggaggctgaggcgggcggctcacctgaggtcaggagtttgagaccagcctggccaacatggtgaaaccctgtctctactaaaaatacaaaaattagccggatacggtggcaggcacctgtaatcccagctactcaggaggctgaggcaggagaattgcttgaacctgggagatggaggttgcagtgagccgagatcatgccactgcactccagcctgggtgatagaacaaaaaactgtttcaaaaaaaagaaaaaaatgaaatgctaagttacagaaaggtactatgaattcagtggtgcttatacaaatcattacgttacttatcacatttatcacagcactatgaaagattttttttaagttctaaatatatatagggccaggtgcagtggctcgtgtctataatcccagcactttgggaggctgaggcgggagaactgcttgagcccaggagtttgagaccagcctgggcaacaaagtgagactccatctctacaaaaaatacaaaaattagtcaggtgtggtggcttgtgcctatggtcccagctgcttgggaggctcaggtgggaggatcgcttgagcccaggaggttgaggccacagtgagcaatgattgtgccactgcactccagcctgggtgacagtgagatcctgcctcaaaataaatacataaatatgtgtgtgggtgtgtgtatatatatatgtaatacacatatattaaatttatatatgatatatataaacacgcaccagctatatgcattcagcacccaggtccacgggtgatgcctgtgactctgaagactttacagtcactctacaatatcctccccatcccccatggtctggtctaaatgaggactcgcagatctagataatcttgaaaatcccttccatttatggtatttatgtatagaggtatgctttgtcagtttcaggtcgggagaaaaaaatggaaaaatgggggaaataaatgaaaacaggcagcactccacggctcataccctcctccttcccaagcccatcatcagatcctcaggacactggcagacacagtccgagaaataacccccaccccagccccactgaagcacgttggttcactgcagcctgttaagtaacacaaggaaacccctactggctttcaaagcagcttcagaaacagcccccactcatggaagtggttcttcctgctgaacctgaagatgtccccagactctctctcaacatagcaatctagggagccacttccggtggagatgaaacccccytgccatctctaagtaaaaggactcaaagagggggaaaaaggctcaggccgggcgtgttggctcacacctgtactcccagcactttgggaggctgaggcgggcagatcacctgatgttaggagttcaagaccagcctggccaacatggtgaaaccctgtctcaactaaaaatacaaaattagcgtagcatggtggcgcatgcctgtaaccccacctactcgggaggctgaggtagaagaatcgcttgaacccaggaggtggagattgcagtgagccaagatcgcgcattgcactccagcctgggcaacaaaaggggaagtgtgaggtgttacactcttctcagtgccgggctagcggcctccagcttcctcgaccggcagctccgcttcaagccccagccctgacttgcgtgcttcagaatttgtttttgtttcagtttgagaattcttttcttctaggaaacagtgactgctactttgggaatgggtcagcctaccgtggcacgcacagcctcaccgagtcgggtgcctcctgcctcccgtggaattccatgatcctgataggcaaggtttacacagcacagaaccccagtgcccaggcactgggcctgggcaaacataattactgccggtaggtagcacaggggtggggggttcaggtcttggcagaacgtgggattagggtgtgagacgggggaagatccaatgtctcaagttgcatgacagacccagtgcgtgggaagcacccatggatattatctaatccaacctcttcacttgctagaataacacatattgtgaaaagcaaggtctaccagttttccaacctaaatcccaagttaagggtcctggcctgtaaccatttagtcctcagctgttctcctgacatctttattgcaatgatttgtaagagttccgtaacaggacagctcacagttctgtctgacaaccctatgagattagaacactacattactgactgggtaacaaagttaaagagaagttctcctagggtgggggtgtgctgcaaggtcaagatgaactcggtgtcctccctcccagctcagtggttttcattggttgactgagtctccttctactcttacatggcctgtgatgtggctgaaaatgggattgaaaatcttaaactcctggcctggtgtggtggtgcatgcctgtaatcccagcactttgggaggctgaggcaggaggattgcttgagcccaggagttcaagaccagcctgggcaacatggcaagaccccatctctacwaaaattaaaaaataagaagataaaaaggaaaccttaaactctcttatcatttaggaatcctgatggggatgccaagccctggtgccacgtgctgaagaaccgcaggctgacrtgggagtactgtgatgtgccctcctgctgtaagggctgggccccggctgcctccctgcacctggtctcccttcttcaccatctcctcgccactttctaggccttcatggctgtctggtgcagactgtgtgcctaccaracttccaggctgggtggggagggggcttccatgactgaagccacggtgggtgggcgggtgtccatgacccatgcatgggggtggtggggaggggcaagaagaaagaaaagaacacagcaacctctctgagaagtcagtaggctctacccggctctctctagacgcctctattggtgttgctgagagtaatggggaatgaggaggaggcctcgcatgcatggctccttagataataaagtgccttcaccacatttgtccaacagcgtggtggaggtggtcttcctacctccagtttactgagtaggaagcagtctcccagacgccaggtggcctgcccaagctcgctgggcaccgggaggtaaagctagggcctgccctcatgccctctgaccccaatggcatgtacttccactgtgagatcttccacgtttcctgttgacctatttcacacaggggagctggctcatgatgtgggtgagagataggagattcaagttggtgcatattgctaaaaaatgaaactttagtttggaaatggccagagagtaggttattaatcacctcctgtgaacacagatcagccagaatgttccccaaggaacacaagtycaactgggacgatgagacacagaccaccagctaactcacacccaagggcattagtgtgagtcctcagtggtccgtgtccctaagctcctcagagctgagcaggtggggacgtcaggaaagctttgcgaggaggcaggattgcacctgggccttgaagcatgggtaaggttggacagatggaaaagaaatgagcagacattccacagaaggaagctgcaattcttcatttcttaggccaggaaatggctgtaggaaaacattagaaggaatgaaggatggcagatccccagttttggagtcaaacatacttgggaactaatccaggtgccattgcaaccttgggcaaaaacgtytccgcctcctgaaacttatcgctgtgggaactaaagagaatgtatggacaacattcggcatgctgatcccaccaagtgaaagttgtggttttacagccatgctgatggcctcctcactctacctacacacgtgcaggaggcctgtgggactgactgcctcctcgtcctttcctccccagccacctgcggcctgagacagtacagccagcctcagtttcgcatcaaaggagggctcttcgccgacatcgcctcccacccctggcaggctgccatctttgccaagcacaggaggtcgcccggagagcggttcctgtgcgggggcatactcatcagctcctgctggattctctctgccgcccactgcttccaggagaggtaggggctcggaaacccagttggtttttccaccctctaacgcctagaaaccaagccctttaggggaaatcccacagcaaaaawagcattctaaggctgtttctccaccaggtttccgccccaccacctgacggtgatcttgggcagaacataccgggtggtccctggcgaggaggarcagaaatttgaagtmgaaaaatacattgtccataaggaattcgatgatgacacttacgacaatgacattggtaagagctcgtcattcccggctccagttcatacagatcacacaacacacccacatgcactcacctatgtttacacacacgggcctcctcctccagcccctgcccctcctgcgtgttcctcccctcccgrgracgcggccctcacgccagctcactcctcctttctccctcccagcgctgctgcagctgaaatcggattcgtcccgctgtgcccaggagagcagcgtggtccgcactgtgtgccttcccccggcggacctgcagctgccggactggacggagtgtgagctctccggctacggcaagcatgaggcctgtaagtggaaggaagyctcggccccatcctgtctgcgggacagcaggggaggctgcggtccaccagaggaaaatggggtcaggagaccgaagttccagccccgggtcaggcactgacgccagtcccgtctccctgtgtcgtgggggcccgtctctgctgtctctgcctcacagggacactgcaggccaggaaaggacacaacagtatgagggcctcgaagtgctgcaggtgttgggaaggttctgagtaggaagtggagtacagtcgctaagcgtgtgggttctgggaagctggagttacaaagacccgatttcaaatcccacttgctgagctgtgtgaccgtggacatggatttttattttgaactgctcccagcctcagtttcctcgttggtaaagtggagatagaactatctccctaattagattaggagggttaaatgagataatattgaacgaatggatgtcagctggggtgattttgtcccccaggaaacgtttggcgaggtctggagacgtttttggttgttacagtttagggtgagggttaacgccggccttcagtgagtgcagccagggatgctgcacactgcagggctcgggactgtccccatcccccacaacagggacctccctggtccgaagcatcagcagtgccactacggagaggctgtgggttcaatcccggaatcctgctgtttttgtgggtcaaaacgataaaataccagcagtgtcataggattcgacctaatacatgttgaatcttgatcaatgttagctattattggaaaatttggctttctctttcaaaaacgtttataaataactttccctaaaaccatatgatggttctcccctttcagtgtcycctttcyattcggagcggctgaaggaggctcatgtcagactgtacccatccagccgctgcacatcacaacatttacttaacagaacagtcaccgacaacatgctgtgtgcwggagacactcggagcggcgggccccaggcaaacttgcacgacgcctgccaggtaaccaggagtggcgcgcccatgctgggcacaacccaggggagaatgcccctgggacaacaggttcttcaccaaagaaaaaagttatcaccagagtggagtgatttcctcttagtgatacccctrgggattctagatgagggcctcacagaataaagcaactggaggaagatcaaagtcacctaaacctaagaattctaaactgcaggaaatttccccaggatctgcacaggcaactccacctgtacaggatttcctttcagcccaggcaattgattgactattgaagtgatggagagagccacacaattaagaaacgtttgcctcagcctggtgtggtggttcacgcctgtaatcccagcactttgggaggctgaggtgggaggctcacctgaggtcaggagttsgagaccagcctgaccaacatggagaaaccccatctctactaaaaatacaaaattagcctggcatggtggcacatgcctgtaatcccagctactcaggaggctgaggcaggagaatcgcttgaacccgggaggcagaggttgcagtgagccgagatcgcgccattgcgcttcagcctgggcaacaagagcgaaactcgatctcaaaaaaaaaaaaaaaaaraaaagaaagaaatgtttgcctctgttggcactagagaattggagtctgctttgtagaaggagaaggaagaaaggcaacttactgggaagcaggatctagatgatgtgagaaagaagttttcaaaactcacattcagccctaataccctgggaaagcacactatttgaggtcctttgtgtgggcatccttatcagaattagtacttatatttcatgattagccagatactggggtatgggaggacaggccagcctgctggtattaagacctgcacagagccaaggaattgatcttcctcagacatttcagtgcctgcagcgtgcgaagctctcctttaggggctgggggtagaagagatacaaagagaagtgaggccaggctctggtgctgaaggatgtgtgggctttgttttcgcaaggcagtcatatcggcggtttcccctctgattccctgacaggatttagtttctttttgaatggtttcttcagcaacctcagctgtaccagcttacagtccagaaacaaaaaggttgtaccaaagtgaaaccattatctatctgcaagcttagttaaaagcaaaaccaaatcattttaattcaatataagaacagctaacaattaccaagagttttactagatgtcttccagtgcttttcatgcattcttctactgaatgccataaccactctatgggtagtatgaatattatctctatggtacagataagaaaaccaaagcatggttagtctaaggccatcagctagtaagtgatggagccaagccagggtttttgaggcctgaaacgtttgagtaattaactctactttaccagaatagatacagcctaatcctccatgggaccaagataactgagatacaatctacccactcttcagtaagtctccacttaacagcatgcctggaaaaaataggttcttagaaactgcaactgtaagtgaaatgacgtataacaaaaccaattttaccaccagctaattgatataaacaagagttggtcaggtgcggggctcatgcctgtaatcccagcactttgagaggctgaggaaggcagatcacctgaggtcaggagttcgagaccagcctggccaccatggtgaaaccctgcctctactaaaaacacaaaaattagccaggtgtggtggtgcgtgcccataagcacgagaattgcttgaaccccggaggtggagggtgcagtgagctgagattgcgccactgcactccagcctgggtgggtgacagagtgagactctgtctcaaaacaaaaaaacaaaaaaaaacmaaaaaagaagagtgaagttcttgtggcaatatttctagtcataaaaacatcagcaaacttctaaataaagacccaaaacacttctaacattcaatattgaaataaatgtgagctatacaacatttaagaaaggttaataaaaacaaacatggtatttatttacccaatttttggagaataagtgratgatggcggccataatagtggtgggttaattcagggaataaatgtttgcaargcarraatggtaaggaacacctcttactaccatgaagttcaaaaacaatcacaaatagggcaggctccctgactgcctccacacctcacagtttatcatgcattcgtgtatttagcacagactagacagatttttactttataacactttgtattcattcattttccaacgtgcttattccggttcagggtcttgggtgggggtggccagagccacctggcagctcagggcgccaggcgggaccagccctggacagacgccaccatcctattgcagagccactaacacccacactcactcagactgggcccacgtagatacatcctcagttggcttaatgtgcaagctttgggatgtggaaggaaaccggggtacctggacaaaacccaggcagacagtgtccccagacaggaattgatttttgttttcctcatcaaagttataatgaaatgacactgaatggaatattattgaagggcctgctgtattttgaagattacgatgttcatgctacacatactgactttctccagatagtctgctttttttgcaaacgccaaacctgctatctcctttgcagggcgattcgggaggccccctggtgtgtctgaacgatggccgcatgactttggtgggcatcatcagctggggcctgggctgtggacagaaggatgtcccgggtgtgtacaccaaggttaccaactacctagactggattcrtgacaacatgygaccgtgaccaggaacacccgactcctcaaaagcaaatgagatcccgcctcttcttcttcagaagacactgcaaaggcgsagtgcttctctacagacttctccagacccaccacaccgcagaagcgggacgagaccctacaggagagggaagagtgcattttcccagatacttcccattttggaagttttcaggacttggtctgatttcaggatactctgtcagatgggaagacatgaatgcacactagcctctccaggaatgcctcctccctgggcagaaagtggccatgccaccctgttttcagctaaagcccaacctcctgacctgtcaccgtgagcagctttggaaacaggaccacaaaaatgaaagcatgtctcaatagtaaaagataacaagatctttcaggaaagacggattgcattagaaatagacagtatatttatagtcacaagagcccagcagggcctcaaagttggggcaggctggctggcccgtcatgttcctcaaaagcacccttgacgtcaagtctccttcccctttccccactccctggctctcagaaggtattccttttgtgtacagtgtgtaaagtgtaaatcctttttctttataaactttagagtagcatgagagaattgtatcatttgaacaactaggcttmagcatatttatagcaatccatgttagtttttactttctgttgccacaaccctgttttatactgtacttaataaattcagatatatttttcacagtttttccaaaatcagagtggaatggttttgttatagatgctgtatcccactctttattcatgttcacattttaaaatcatttggaattctgcttcactcgcttaacatatacacaacacctgtaacatacaaggcaatgggctaggtgctccagaccgggaaaaggagggacaggaatgcttggtctgatgggctaatatggcatttagagaagtaccaaggtacagtggagccggtcacaaaagggcagacttgtagtagaattcagttgcaagagggattggggaatcttaaggaaaaaatagaatcttaaggaaaaaataactgggtgagacgtggactgtggacaggtgtggaaaaggcactctccatggaggtatgaatatgtagagggccaagagaggggagtacagggagaaatgagttgagcttgtctgaagtgaacttcaggaagaggaacataggctggaatttagattatgggggctctgaacaccaaactgagtttggacttaattgacttctgtaggcaacgaggagccatggagattctgctcagggaagtgaggaactgggcatgccttaggaaaattaaccagggggtggctggcaagcaagcagacagcaggagaggaacgctgtggggatagggaggaagaacctcgcatgaccttgctaacacagcaacatcccaaccgttggttcggcctagaagctggtatttgggccatctgtytcccattgtcttaattttctgctcattagaaattgaacccctaaaccagtccacacaagtacgttatctaagtaatgttgcattctgcttctcttagactactttttttttttttttttgagacagagtctcgctcttttgcccaggctgaagtgcagtggcgctatctgcaagctctgcctcctgggttcacgccattctcctgcctcagtctcccgagtagctgggactataggtgcccgccaccatgcccggctaatttttcatatttgtagtagagacggggtttcaccgtgttagccaggatggtctcgatctcctgacctcgtgatccgcctgcctcggcctcccaaggtgctgggattacaggcgtgagccactgcacccagccctcttagactactttctactcgcgagatgcaacccctattcctggctgctgtctggcagcttttgttctcactgacatcctagttccaagaataaatcggatgctgcaatgctgctgttggggatatgctgacacagctcctcagagaggagaaaggtggtcgtctctctggtggagttgtcagaactgctcagtttagaggttcttggaacaaaagtcgtttaaactcacaaaagaaagagattctttaactcccaagagcttgactggggtgagggaggcagcgggggacatccctgaagtgttgaagtacctaggccagtaaataaatgcaggtcacagagacttaagtcacagatttcttgacttcagactgctcacttgcatgttctacagtttttagacagatgtgtgtctcagccatttaagaaaaacattgtttgaggccaggaacggtggctcatgcctataatcccagcactttaggaggctgacgtgggtggatcacttgaggctaggagtttgagaccagcctggccaacgtggcaaaaccccatctctactaaaatacaaaagttagctgggtgtggtggtgcacgcctgtggctccagctacttggaacactgaggcaggagaatcgcttgagcctgggaggcagaggttgcagtgagctgaaattgtgtcactgtaytccaccctgggcaacagagcaagactctgtcaagaaaaaaaaagaaagaaagaaagaaaaaaaaaaaaacactgaggaccagtgcgaaggaacccccagccactgaatctccggcagaaattcagctggtttcatcccctccccctttgcaggacaagctcttcttcaggattaatgaaatgaactgaggcagtgaggcccctggggatggaaatgggaggtaaaaaggccccagcattcctcccacgcagtcttggaaccacagactagatagagacaattgctcagaagaggcccctgactgagagacggggccccagcccagtgatgcaaattctaaaacacgctcaaagagcaacacatcattaccgggaatgggtgtcaggggaaattaaatatcatctcctcattattcccagctagttaataaaacaagcagatggtaacagtccaggagaacaagatctccaggtacctgtgcaactcttcttactgggtgaaaacctagaggaactctgggatggtgacactgtaccctcccagagccccagtcatgtctgtttatcagaaagtgcataaacttttcactccacttaacttcaaaagccaaagactcatgcaatcctcagtacttaggatcttggaggaagtttcagagtttgaaattaaatttccttttattttattttattttgagatggagtctcactctttttgcccaggctggagtgcagtggtgcgatctcagctcactgcaacctccgcctcccgggttcaagcgattctcctgcctcagcctccccagtagctgggattacaggtgcccgccaccaggcccagctaatttttatatttttcagtagagatgggttttgccatgttggccaggctggtcaaatttccttttaaaaattttaacagggccaggcgcgacggctcacgcctgtaatcccagcactttgggaggccaaggcgggtggatcacgaggtcaggagatcgagaccatcctggctaacacagtgaaaccccatttctactaaaaaaaaaaaaaaaaaaaaaaaaaaattagcggggcacggtggtgggctcctgtagtcccacctactctgaggctgaggcaggagaatggcgtgaacccaggaggcagagcttgcagtgagccgaaatcgcaccactgcactccagcctgggcgacagagtgagactccgcctcaaaaaaaaaaaaaaattctaacagttggccaggcgcaatggctcatgcctgtaatcccagcactttgggaggccgaggcaggcagatctcaagacgagcctggccaacatagtgaaaccctgtctccactaaaaatacaaaaaaaaaaaaaaaaaaaattagctgggcatggtggtgggcgccctgtaatcctagttactcgggagtctgaggcaggagaatcgcttgaatccaggaggcggagattgcagtgagccaagatcccgccactgcacaccagcccgggcaacagtgcaagactacgtcccccaaaaaaaaaaaaaaaaaaaaatctaaccattaaaataatgagtattgatggcatggagtccccacctaccggccacagagaaaagtacatgtatacaaccaacttcctgtcccaccaccagggtcagagcacccgggagcacaggcgaagagacagttgacgccggctgagagggagaaggggtggagcactagctggcactgaacactcacagtgagtacgcattgagttttaaggttttttgatggccatgagatgtttatagaaaattgttacaggtgtggcgtaacaatcgactcgcagtgccttatcttgtaagaagcctctcctggaataaagacgccagagtactgcgacaccgtttcatgcctaaattaacaagacaagagaagcaggtcaagagaatgcggaaagccctagactaaatgccggcagcttcaacgatttcgtcttttaaaactctggtgaaaaataactaggtggatctggaccttatgctcacaaccctaaaaatgacattaatatcagcatctgctatcttccagatgtgaccaaagaatcgatcaaaacacatgctttaggtctgctggctagacaggacagaagcagtaagatcctcctgagtcgatgaattccttactcactgcttctactgaggtttgagtggcatagcactgttgttagttctggtaacaaaccacttaggacatagaagactggtgaaactcaactttattaaacttaaacagagaagctacttctgcacatgttaaacacacatggaaccaaacagctcgatggagacaccctgcactgcttatggtgatgctgcaggaatggcggcagcgatgcccgctacactccatggcctgctgcacrtgtgacaggacagttatttcatctatgcttacacctgcaggtcccttaccctagaaacactctatatcttcttaggtacttcccttgaaacaggatgagttctagaggaaataaaactgctgcacttacaaacctagaaatattcagggaccaagattagttgttcagtgacctaggaaaccttagaatcctgtaggttcctcaggagaggtgcttccaagtacttgagaatccacaggcagagatgcttccctttccatggtggatgtgtatgtcactccaggacaaactgcggagtcacggagtgtggaacacatctggttgtgtacagtacactatcccagaggaaaatcacaaagcaacacaactctgcagcaaaaactagtcccaaagtcagaagataaaactagcaaaaactttgcacaatatttagagaaaagctctagggtgtggagagtaygggtcttcctttttctccatgcaccaagcagagcacagtatcattccttaagctataaacaaaaacccttttgtataaatatttaaatagtaacagacacactgaactaggacaaaaatgacccactgggaaagaaagcctgaggtatccctttagttgccatgtttcttaaactgggttgcttacacccatgatcaacacagtccatcttcctacagcactgattttattcagagatttaggagaaatgttttgtcttagaatgaaaagggactggtagatattaatgaatacatgataggagtacaaaagaaaagactgaggaaatgataactttaccaagcagcttcaaggatcaaccacaccctcgatggtaagctttctctttttctagggcgacagatggaaaagtttccgaccaacgggaaggttacgatctggtaccagtccagcactgacaaatggagatatgagctcactcactcacagctgtgctcaccttcatgggaagagtcggccctctactccagtacgatgacacacaaaccctggctgcactggggattatgggatcggcttctctgaaactctcttactttttaaaaatcctgtagaaggatcaggtaacaggaaaatggccggtgaattctgtaaaaggaagtgagtagaactgttttgggttagaaaagaagcactttaggcagccaccatgggaagaaggcgggtcaccttctcactgaagataagagaccaagtgctgatggacagcaacaggcagtgtctgaaaactagtccgataccatcatggtctttgagggaaaatctgattccactggggtttccatgtcaatagtggactcaaatttaaaaagtctccagtccatttccagaagtacaagtgttttctacatgagtagaggaatcagaaagaaaccaactcaactctttccttcccatccctccttaaggtagagtccgactgcttttcttgccaatctttcatttaagtgtctcctcctaactcctttacttctttttcctctttcttctccttcatagagcagatccttaagtggcctttccttgactaacattcattttcttcccatctttctttctttttaatctttctatcttaaaaaatcaacaaagaagtctttcattggctttagataattaaagccaagcaagctaaacaaatgttggtctttcctatagaaaccacgtttaaaatggttacataagcaccaagcttcctacccccatcacacaccttgtccttgagaactggtgttgctgtgtttcagttctgtccagttctccctggtgaccttttcctcccttgattagttccatggcactgaaggctaaggaaaaaagggagcrggtgggtccaggaggggactgacctaggagacaggctgatatttttttttacttttagacaagtaagaaatgaaaaaatgtgcaagactattccctcagcaaatgctcccttcaggttcgaacttggaacttcccagctttggtcatgtattttatgcccttaaagggtttgtacttttctccatacatatccagacgattcaccttgagtcctagaa

SEQ ID NO: 17585 - DNA, 19864 bp, Homo sapiens
  misc_feature (1)...(19864): n = A,T,C or G, or insertion/deletion polymorphism (see Tables 1-2)
accagcctgggcaacatagtgagacccccccccatctctacaaaaaataaaaaaatcttcccgttgctgtatgtggagcccctctagattgtcagtgatagaaaccacttcaaactggctcagccctaaaatagcgatgattttgtggctcacgtaactgaggattccaatgggcacagctggttgcaggccccgctggacccagctctctgctggccccaggccacttgctggcagcttcccacccactgtcagagcctgtccccccggtggtggtctcacaccatcttcacccctcaactccaggggtgacgcttcctggcccacctgggctcctgcgccttccctgaaccaccctcggtgaccagggtgggtgaccagacctggaggtggggttgccctgctggagccctgtgggaggaggggagaaggtggctcccgtgctgggtgggcagggggcgcgtcttgtggagtccagctctgtcctggcatcggtccctgccccacacagccttaaaattccttcccaccctcaaagcccagcttgggtgtcctcgggggcctttctcccgccttccatggggcttcctgctctgccgcaggtaccttttgttgcccttgtcgcaggccgcaagctctgcaggccgtgaacagagagtgtccgagagtggaastagcggaggtgggggacagacggctgggccggtgaatgctggcctcaaaggctgatggcccagaagccctgtcatctggaaatccccatttgccgtggggtgtgggacgttcctggggcggtgagctgtcagggagcacagcgcaggcagctctgaggaccctccctgaatccgcatgcctgcagcctacaccctggcccgtgtctacggcgtggagagtgacctctcagaagtggctcgccggggctcaggcagcgcctgccggagcctgtatgggggctttgtggagtggcagatgggagagcaggccgacgggaaggacagcatcgctcggcaagtggcccccgagtcacactggcctgaactccgcgtgctcatccttgtggtgagtggggtggggcgggtggagcagcagcccggtggcctctgtccctagtcagggctgctgccgggagcaggagcgaaggcgtccatccaggctttgcttggctcctggggtcagcgggggctgaaggaacagaagcgtggttgagtgctcaggaaccgctcccatgcggcgggcgccaccacccgctgggatctggaagttgcccctgcgtcacccctgctgtggccgggaggcctctgtggtcaggcaggtggcactgactcccacccccgctgcctgcattggctgagggagggccgagtgtttgaggctgaggtccttggggctggccccctgcagggtgtggcccaggctgtctctccctcgtgcaggtgagcgctgagaagaagctgacaggcagtaccgtgggcatgcgggccagtgtggagaccagccccctgcttcgggtaaggccaggagcgggtggtcccggggccctgggagtcacgcttgtgcccggctctgccctcagcctctgtctgggcccgagtgttctcacacctgcggcagccccgccaagaccacgtgcaggagccaaatgcagagatggggctcgagccgggcctccaaccccggagtctctcctcgaaccctctgctgtcgagacccccagcggctccatgggaaacaccctgtgccttgcagttccgggccgagtccgtggtgcccgcgcgcatggcggagatggcccgctgcatccgggagcgagacttccccagcttcgcccagctgaccatgaaggacagcaaccagttccacgccacctgcctcgacaccttcccgcccatctcttacctcmatgccatctcctggcgcatcatccacctggtgcaccgcttcaacgcccaccacggggacaccaaggtgacgcgggccgggagggcagaggctgcgctcgcgctgtagcgcgtgtctaggcttgtgctgccgtggagacggccccggggctcgcgtgcagggcaatctgtgtctgaaagctccaccctgctgtgtgcgaagctcactgaccatctgggttcttctgtttcattttgtttcttgacttgcccgggtcacggccccaccaccttcttcctgggttcacaggcagacgtgtcaagtaccaggcacttggggtcacagctccactccagtgtggccctgagggcctagactgagctcttggagagcccaaggccgcctggcagaccagagggttggggagacaagggtcaggcaccacgtgaatagccagggtgactgctgtgggttccaggtggcgtacacctttgacgcgggccccaatgccgtgatcttcaccctggacgacactgtggctgagtttgtggctgctgtgtkgcacggctttcccccaggctcraatggagacacgtgagtgtggaccccgcccctcctcctttttgggagatggtgccaggaactctggtcggaagagacggaggcacctgaaggctgtggygctgagacagggagtcccagggcaggcagcagtcccccgagtgtgggagccacgggcagggtgtccccatagagccatcccacagcccacgtccacagggaagaaagagaggccgctcacgcgtgtgtgagcaacgcccagggtctcccacctcctgagtgacagcgtcccctgcagctcgggaccccgcaggctcttattctatagaacagtggcttaggaaacacgcctgcactcccagatgtgtgcgtaagtgtccgacattttgaaggaaaggagtcaaagcccctgatttccttcttactgaagcgagttagagccagtcaaggcggccgggtgttgaccccgccccggcagttgggtgtcttttcttgggtggggtccggcagctgcatcttggygccacagagcccccatgtacgccctcctcggtgcacagcttggccctgaaccgcctcttcccctgcgctgctctgtgggggtgccacagagcccccatgtacgccctcctcggtgcacagcttggcccagcctccttacgccccggggctgttgatttcttccctcccgtgttttcatggtgtcttattctcaatgtgagaggcgcctcccatttaagggtgtctggaagcgtgtggggatgtgcgtctgtcccgggtgggagcaataacaccttctaatggtcaggggcctgccctgtggggtggactcagacccacaccccaggactgcccgcctgggaagcaccaggctcgtggctgctgctccgggtggggcttgcaggcttccgctgttctgcagaacacggtgacgaacgcaccagcttgaattgggcgcttccctgagctgttaccccatggggcttggcagcacccttggccagatgtgggtccagcctgggcatagctgtttaccacataacctaaaatttcctgtctcagccattcgagagcatataatcctgcggtgttgaggacattcacagggtcatgtgagcaccacctcaagccacctccttaactttttcatcacccctaaaagaaacctgtccccacagcagccacctgccgtctccccctccctgagccctgacggccaggaatgcacttcccatctctggacttgcctgttgtagactgttgtagacgcttagagaaacggatgcattcaccgtgcccctgccctgcttttccaggtttctgaaggggctgcaggtgaggccggcccctctctcagctgagcttcaggctgcgctggccatggagccgacccccggtggggtcaaatacatcattgtcactcaggtgaggcctggggctcacccagtaccccggggtttcctttcctgccaggggggcccgcccagcccccagggcccttaaaggcwaagcgcggctccctgtccctaccgtgtctcaggcaggaagccagaacgcctttgtccattcatttgctctcaaagtggacattacaggccactggtgatgctcagagcagcagggctgcgctgagggtgggagggtgagtctgacacaggctcccagggagacaggtggggagtatcagacccttgaatagggagcgcctgggtnnnnnnnnnnnnnnnnnnnnccccaaccaccccagcagaccggggttcctgccctctgacctgctccgagggccaagcttgcatccagtgatcacggccgcccaagccattgccgccaccttcctctcaggggctgcctgttcccaggctctgtggttctctgtcccccctgtgacagaagcagtgcccagggcagggggctcgcagctggcaggggcggctgtgcctgcaggagctgcgtgtgggtgtcaccactcaggcgctttaccttctgaccaggacccacaggaagggcgggggcacaccgctaccctcctgtgtccggccctacagatgctgggcacaggatgaggcgctgccattcctggtgacctgacatggatttctatccccaggtggggccagggcctcaaatcctggatgacccctgcgcccacctcctgggtcctgacggcctgccgaagccagctgcctgactgcctcagcagggaccgcatgccgcttggagaaggggtggcctcgccggagctagggagcggatgtggtgggctggccggactcctgggacatgtgggtggtggcttgaccccgggcccatgggcagcttgctgtggggcagtgcagggagtcctgcggccgcccaggtgtcaggagaggtccccgccgagtgcttcagctgccctaagctgcaccagcgctttgccaagatgggatggggagggggtatgagaactggcagagcctcggtgcagcagggctgaagggctttctcaccccagctctggctatgcccagttctctgagaaaggagctcagtggggaggtggtccctccagcggaccagggaaggggtcaccgtgctgggagcagcctccttgggcctcaggaaaccaccaagtgcctcggatggtggctgcccacggcgcttctgctgagaccctgcccccggcccaggtgtctcggagggtggctgcccacggcctgggtgtggctggaatggtggcaggagtgggcaccagtgcggccccggtggccatggggaataaaccagcattgctgcctccggcctccgccgtttttctgtttcgtaaaccagcatcccggggttcctgctctgagtgaccctggcacctstcagggagtccaggtgtgccccatgagggcctgggggaggggcaggctgggcagagccacagaggggctcccctcaaaccccacattggctcaggtgggaccctcaggagcaaccccaggtctaaagtcttcccatgggcgctgggctcaccacccccacgccagcccctgcctcccgtacccaggccggacgtgacggggccgtccctgcattctgtgctttcccagttgtacacatcctgtcccctccctcgagtctcagtcacagttcagtgacctggtgacgggaggccccctgcagtgtctgacccaggccacgcctgtgccagcccagagccagggggaggaaatgggggctgggcctctggtccccatggggaggccacccttgtccttggtagcatcagggtgcagaggtgttcccgggctgtaggggtgactcccccaccccccaaggctctggagaggccgatttgctcaggaagccgaccttcacaccttgtcctgctattaatagacgcctggttgacacgggaccctcggttgggtccggagcattgggcaggggcacttgtcagtgtttgagagctgaagtttgggaagccctggggaagcgcaggaactccccgcctgggctggggctgccgggcagggcccctcctatgcctcggcgtggctagagagggcgggggcagaaggctccgggacagccctgcaccctacagatgcgggtctccgcccagccgcggtcacctggggggctgggggcggggcctgggcggggcggggttcggccgggagcgcaggggcggcagtgcgcgcctagcagtgtcccagccgggttcgtgtcgccatggggcagatcgagtgggccatgtgggccaacgaacaggcgctggcgtccggcctgagtgagtgcacgtcagggacggtggaggctgcagcctggaggggtgtcccaagaccccagccgggacctcgggctacttacagggtggggaagtggggcgccaggcgggccaggccgggccggggtcaggccaggagggtgcggggaacgggggcgggaccctcaggccgcgggctggaaggaggagttctgagacccccagtaattcccttgcagaccctgcggagcgcggcgcccctcccccattcccttctctcggtcccccgactccgcgaaggaggaagttgcagygcaggggaagaggcggttcagccccggtggtttccggggtcaccgccccgaagcccccgagtgggggctccggcctgggcatcgggagaagctcccctgcccctcggtagccagctggcctggaggtcgctctccctgggcttggggtggggaatgggctcatgccctggggctcagcccttctcatctggagtctgcgctggaggcggtctgagatttcacaaggcgccgaaaccacccagtgacggccctgcccagcccagctgcacaggcactttgctcttggggtgggatggcacagcccccagtcaccctcctgtgcatttgctcagaggttctggtgagggcagcggactccatttggaaatggaccctctcgggaccagggccagggagtgtctggcccagcacgggtgaggctgggctcaggcgaggtctgagggcagaggcaccactgcagcagctccaggaaggacctgcaccgggggaggagtgcctgggaagggcctgggggctgagggtgaggaggaggggcccgcygccaccactcccctggggctctgagcgccctccctgttgtctggagggtgcgtggcagctggagtgggagcagagacctcagggtgggagggctggaggacggggccctgcagcctgtcctgtgcccaggaaagtgacckcctgcttcgagtcagcggccaagaagtcggtgggtcagttcagacagctctycccagagctgccccgtgagactcaccctgcctgccccgcactccctacaggaagtagacggactgagggcacccagctgggagccaggagacctgggctctagtctggcctcctgctgaaaccctccaggggctcctggcccgaagagttagagccagactggacgccctgcactgcccgccctggcctcccggctctccggccccctcctccagctgccgtgcttcctttctgttcctagatctcctgagcgtgccccagggcctcggcacaagctgctgcttctgcagagcctcatggctgtctcatttatttctcaattcaaatgccacctgcctggggaggtccttccagaccgtgcagccccaggaggcagctggcccggagacagcagggccttgacaaagagtcccccctgtacacagcaggtgctctgtaaatgtggctgggtgccagaatacgtcctcagacctccctggtggcaccagcggcagctttgcaccctctttcggatggcaggctcgggaccaggacggtccccaaagatgcatggacaattggctgagtagactcaaggacactgccctcccctcctccgacgcagacagacaaacccagagagttaatgtgtagctgggctcaaaccaaggataggaaatcttccaacaagaccatgtggagacaaaaacagaatggctggcagggcaaggtggctacacctgtaatcctagcactttgggaggccaaggcgggcggatcacgaggtcaggagatcgagaccatcctggctaacacagtgaaaccccgtctctactaaaaatacaaaaaattagccgggtatggtggcaggcgcgcatagtcccagctactcgggaggctgaggcaggagaatcgcttcaacctgggaggtggaggttgtagtgagctgagatcacgccacggaactccagcctgggtgacagggcaagactctgtctccaaaaaaaaaaaaaaaaagaaataaaatagtaggaaggaccaggcgccgtggctcatgcctgtaatcccaacactctgggaggccaaggcgggcggattccctgaggtcaggagttcgagaccagcctggccaatgtggtgaaaaccctgtctctaataaaaatgtaaaaattagctgggcatggtggcgggcgcctgtagtcccagctactcaggaggctgaggcaggagaattgcttgaaccctggaggcggaggtagcagtgagtcgagatcgcgccactgcactccagcctgggtgacagagcaagactccgtctcgaaaaaaaaaaaaaacagtaagggggaatattggacaatacccccccaaaaatgtgcagaaatagccatatcagacgaaaccgaaattaaggcaaaaccgctgacgggttaagaggaactccgtatcggggggaaaaagacactcccccaagaagatgcagaaaccacactcggcctgttagctttcagtgcatcaaacaaagactcatggtgacaagggggtccatttgggggtcccagagcccactggggcytgcaggtcgggctgtccttggccactcctgggacccagagcccgggcatgtccagcaccccctccgccagcccgtgcgccacaggctctgctcttcaccagtgcagaggggtgcctcctgggggtgtccccgaccctgtcactgtgctgtggggatgggtagggggcagctctgggtggcctggtggcccacagtaggtagagaaggggggtggcccaggcccccgggacrggagccccacagtgcctgacccacttctccccgcagtcctcatcaccgggggcatcgtggccrcagctgggcgcttcacccagtggtactttggtgcctactccatgtatccttccacctgaggctggggtgggcggggaacgcccagggcagagctggggagccacttcacagtgagctgtttgcctccgctccccaccaccgcagccaggctgggacacagggtgggctgtgcacgggttgggcagcccaggccccagcagccaggcccctcgccaggaccatgtggcgatcagcggcagacccgccagtctaagtcctggtgagtggtgggcagggggtgtcaccagagggccagggccagcactgaggcctccctgttggactgctgggatcccctctgcccgctcctgtcagtcatcccccttgaccggcccctctacctcctctgccccatctcagccctgccgcccagccggaccttgcgacaaggagcactgggcagggtggtgggagggagggcgtgggcagccccgagtgccagacctgttggaacctcccgtggctgcctcctggctctgtgacctcaggcagtggctgcccccgaccttttttgagacagggtctcgctctgtcccccaggctgcagtgcagtggtgcagctgtgactcatggcagcctccacctgggctcaggccaccctcttacctcagcctctggagtagctgggaccacaggcacacaccactgcacctggcttttaaattttttgtagagatgagggtctcactatgttgcccaggctggtctcaaactcctgggctccagtgatcctcccgcctcagcctcccaaaatgctgggattccaggcatgagccaccgtgctcgggcccctctctgtgttgtcttcagtaaagggagttccctgtggcccctcaggctgagctgggctgttccttaaccacatggcttcagtgtggcgggcgtgtttgtgtgcctgctggagtacccccgggggaagaggamgaagggctccaccatggagcgctggtgagtcycctcctgctctgggktctctccgggggytgcggggcccaggcagggctcacagggttgggtggagcttggtttctcacttggaggctccggaaccaaccctttggtgcttgtgggtaaaccaaggccggtgcctgcccggtgtgttttgtgggaggaaagaggcctgggtgccctggggtggtcagcagggcagcaaaggagtcccgagtgggagaggcccagccgcgccgtctcgccttcctccctcccccaggggacagaagyacatgaccgccgtggtgaagctsttcgggccctttaccaggaattactatgttcgggccgtcctgcatctcctgtgagtccccgtcccgcaccccctctagggctcaggagggcttggagccgaccctccccactgtcccaccggccgggctgcctggacaggagccacccccacttacctcagtgtttttccaaacaaaaattcgggtccctggctctggcagggcctgtgtctgctgtctagygtgcaggatttgtaaggatccactccaaatccgaggagctccgatccgtcgccagggtctggggtcagcatgcactgctggggggtcttgcctgggcttcctggtagggtggagggttccgtgctgtgtgtctgctggttactgccggctgaggccaggacacccacacgtggctgcttcctcygagcaagtgcaccagagccgctagygkccacatcaaggcygagaacacccaggaccgaaacaagccccggtccgcrcacgtcccctgggtctgcagtctgccttgtcctgagactttgtggccttggcccccagacctggggctccgttcccctttctgagtgcccttctgtgtccctgcctctcacccgctgtcccccaggctctcggtgcccgccggcttcctgctggccaccatccttgggaccgcctgcctggccattgcgagcggcatctacctactggtgagtggcgccctctgaggtcggccccggccacccccatccccagcccctgccctgacaccctcggacacgcatggcccttgaagccggctctgtaggctgagccaaggctgggagcaagtgtgagcctgggcgtgtgctcacagcacggcggggacgcagcggttgctgctgccatttttggcgtgtctagtgtgtcgggtcatttccttgcatttcctcattaacccgcaccacagccctgggaggggtactggggtccccactttacagacaaagatgcggaggctcagggaggtgctgtgactggcctggggtcacgcagccggccgaagaccgtgcctgcgcttgggtcccattatcaggcttttctcacctaaaccctattcgcgctgattcatgggcggtgccaggacgcagacattttcttaaactgccgacacctgcgtttggtttatgactgctgcaccctgttagaaggctgcccatcccatgggatacagtgatctctctgagaggccagggatgggtgggaggacagggcgcagcctggccaggccttgggtgaaatgccctctgcctgccctgggctccggaacagacggctgcaggccacctctcactgcgggggtctctgggtggacagagccctcagactttgcttatttaaatccttttgtccatagagccaagtccctcctgccmgcagaggcaactgccctccccttgctgtgcgtcttctagtgtgtgtgcgtgggaaaggtgcagcactttctgtgtacgccttccgcgtatggaagtggagttctgtttcaagcctcactgacctgccaccggcagaactctcctttagaaccccttcctgttgccaagtgctcatctgggctgttgctttgttttccgggggccacccgcatcccccccgtctccctgctgccacgcacagctagtggctcctggagacctcgggaggaattccttgtgctaaacccagagaggaattgctgggtcaggcatcagcctctgcaccgttcaccctgccgggctcagctgctccccagcagacaacccaccaccagccatgtggccccatctctcccaccatgcactaggctttctcccacgcttgccagtttcacagcacgagctggccgtgtggagcttggactcgcccttctctgactgtggatttgagctgttggagtttcttctcccttgagttgcctgttcaaatcctttgcccatttttctattgtggtttttgtatttttctttttcttcttttttttttgagatggagtctcgcgccatcgcccaggctggagtgcagtggcgtgatctcggctcactgcaaccttcgcctcctgggttcaagcaattctcctgcctcagcctcccgagtagctgggactacaggcacgtgccaccatgcctggctaatttttggtatttttagtagagacggggtttcaccgcgttagccaggatggtctggatctccttgaccttgtgatccgcccgcctcggcctcccaaagtgctgggattacaggcgtgagccaccgcgcccggcctgattgtctttttcttaagttgcaggaagtccacatatattttagctatttagcctttgtaamctttaracactggggatgccttcatgctttctggtgagggtctgttaacttggcscgtggagtccttcactgcacggaagagcagaggtttccctgttcacctgctctatggtctgtgctttgtgaaaacacctttccctggccctgggtcctgccttcacgttcctgccttttcttctatcagccttctagttttgcttttcagaatggaatgtttccgttttggagtcaggtaggatcacacatgtccagtttctctttctgttcatgacgtatatgatgtgacatatttttccaccagatattatgggatagaagatgaaaagcacacactcccaggtccacttgacctgttgcagtggaacctccgggcatgggcccaggagtctgtatttttagtaaaagccagtggaatcccgtggtcttcaagctctccccccaccacccccatgtgcagaaatgcctgggcacccttggggggctgccggccagcgtgggtgaatggcgcccaccagacggagcagggcctgctactctcctgggccacccctcctgctggacctcgggcctgcctccctgccttccctgcccttggcaccttgagaggagaatttgagtactagaatttgcatctgggagtgtccaccacgggatcttccagaagcccaggggttcgggccccactcctggcatgaagaaatagcttgggctggtgtcaggccgacccaggtcctggctgtgtggcctcgggcgcgtcacttaacctctctgagtggcagtcacaccatcctgcgtgggattcagacttgagcctgtcccagggcccctagcggggtgggcctccggggagggagggagggagggagggcgggcgctggggcgcggctcaacccttcagtgccccgcaggcggctgtgcgtggcgagcagtggacgcccatcgagcccaagccccgggagcggccgcagatcggaggcaccatcaagcagccgcccagcaaccccccgccgcggcccccggccgaggcccgcaagaagcccagcgaggaggaggctgcggcggcggcggggggacccccgggaggtccccaggtcaaccccatcccggtgaccgacgaggtcgtgtgacctcgccccggacctgccctcccgccaggtgcacccacctgcaataaatgcagcgaagccgggagcgcgtgagcctctgcctggggccggtgggcggggctggggtagcgatggttcccgaggcctgggcaggcaccccgtttcctgccagccgggccgcattccagtttcattaacatcagcatcgccttccttctcagcagcacacgaaatcccgggtaccgtatattccacgaaatatagtacctggattccaggtgtgtgcctccctagaaaggtcctcccgggcctggaggaggcagcagagtcctcccttgacagctcctgcaggccctgcaggccctccacacctaacgcctccctaaggggcttggattccagaggaggccgctggcgttaagtgaaaagggaacagggtcggagccacgtggtgagcctctaccctgcgcctcttttccgtagaagctggggtgaagctggtggcggatgtggccttgtttgcccccacactgatgctggggggccccccagctgcccaggacgctcaggccaagttgcaggggcttctggccaccccttcccctcacttgtgcggaggctgtggctggctgcacacacacctgcccacaggtcctcaccaccaccccagcccggtgcccccaaagctttgcccggcgtcagccacgtcccccacctttgggctctcgccaaggcacccactcccctgaggccggagaagcccttgcctgctgcttgtccacctgctctcccagcaactcacacttcagagccagggtcctctgttcctgggggccttcagaatccaccccccaccagccaacactcggcaccatacagacgtctcaatccagcctcatctcagccgtccccccaggtcaccaagcttcaggtcacccttgaaacccccacaccccacatccaatcctggcccaaatccagaccccagctacatgggccatccccacccaggccacctgccgcctcccgctctgccctcatcccctgaaaccatcctgatgctgccattgaaacccaaagcctcaccccagtgcctccggctcagaatccgcaggctcagaacccacaggctcagctacctccagtgacagccacaagcttctgatggccccagggcagacatgatctgcacccccagcgccctgccctgcccctgcggtccccctctcacctggcatcagccacgcaggccactctctgacccttggacacacgcagcatgtgtcttctcagggcctttgcatgggctcttcctgctgcctggagctgttccctgcatggctgcctggctccttcctcctccccttcaggtcttcgaggcctccctgaccctctgcttagaactgcagccccttggccgggcgcggtggctcacgcctgtaatcccagcactttgggaggccgaggcgggcagatcatgaggtcaggagatcgagaccatcctggctaacacggtgaaaccccgtctctactaaaaatacaaaaaattagccgggcgtggtggcgggcgcctgtagtcccagctactcaggaggctgaggcaggagaatggcgtgaacccgggaggcggagcttgcagtgagccgagatcgcaccattgcactccagcctgggccagagcgagactcctcaaaaaaaaaaaaaagaactgcagcccctcccccagagcctctgtcctggactcactcacagactacacaccacttgtttcattagtcaccgtggaggcaggaagggttttcaccattttgttctcggcctgttcccagtgccaggtgcttagtagaaactcatatggctgggtgcggtggctcacgcctgtaatcccagcactctgggaggccgaggtgggaggatcacttgagctcaggagttcgagaccaacctggccaacatggcgaaaccccgcctccactaaaaatacaaatatgagttgggtgtggtggtgcacgcctgtactgggaagctgagctgggaggatcgcttgaactcagaaggtgggggtggcagtgagctgaagtcataccacactgcactccagcctgggcaacagagcgagaccctttttcaagaaagaaaagaaactcaataaatgtgttgaatgaaaattccatctcctggacaagggccaccacctccaggaagtcttccctgaggcctcttgctttgggagtctgagtggagtccttgttcttctgtgcagcacccccacccccatctccaggcacctggacgcagtaggtgggtgagccagggggccaggcaggggaggggctaacaactgcccagcagccccatggcaatgtcagcccttggggccgggggcctagagactgagaccctgagactgtcacaggcctgggccccctttccacgactggggctgctccccccggggccccttaactaaaatctccaacagagcctgggtcccgaagcgtggctagttcaccatcagggagggcgcttggccttggatgttgatccgaaccacgaaggctgggggccctgccttgagccgacagccctgcagttcatcctcagagacttgccttgggggccgagagggtgcccctaggcgctcacatcattacaaagcatagggctcaaggcactgcttgaggaaggaggctggttcctgttcccaggggtgtcctcaggggagacactgtgtgggcagagcagggacacctgtgacccccccgtgctacagctcagtcccacctgcatgcactgctcgcggctgcgtagacctttctggaaggacaccccagaattgggtccatggctggcctggaccagggctgaacgggagaatgtcgcattgaatgttggcctctggggatgtgttcatcagtttaataatacacgtacacttaaataattgtttaagaaacaggggtacttccaaggaggttgggaagaggcagcctgcgggggcctgaggccagtgatagggtaagggaagccgggagcaggacagggagccaaggtacaggcagccgtgtgacaccttttctgcagctttaagggctggaagaggtgctgagctccttctacccccaactactgaggctggagatgaggagaacagtggggggctgtcctccagacacggggaatgcccagaccccaagggtagtgttgggggaggcatataaataacaataaatacacataaatagggggtgccctctggggagcacacgtgtccagtctaggggccccacggcctcggcggtcacactgaacggggcagcacgcaggtgcagccgacggggacgtggatgaactcggtgtggaaggcaaaggccccaggtgtggggagccccgagccgtcgcgggagcagggccggcggcgcagcaccagcaggctctggagcagccgcacggagttgagcgcagctgtctcgcggcccgtccgtgcatcgatacagcctctgcacaggcactcggcgaaggccagcttctgtggatagcggtcctcatccgtgtccacactgcgggacggggtgcacagtgagtctctggccctaccctgtcctcctggaggcccctctcccctcagggcccctctccgtgtactcaggataggacctgaggcagcgagggctgagccacacgggcttggggtgcagtcgggctcacatgtggtggtaatccacgtctccccagggccctccaagagcacagagcagggtccggaggcctctaggagcctcccttccacttcatcacccagccccacttctgcaggagctcaggtgacgggcccagaatttccccaggggaccctggccacctaggacagtgggaggcagggcacggccagccgcaagcagcagctcagccgtccaggtcaggagggccggagggagggagctcaggtggccacgcccacttgacaggtgagaaccgccaaggcccagagagctctccgggcagtcagggccccgccaggggaggggcagccccacgccacagcggaatccccaggtcctcaccggtatctccagggtgagatggagcgctggtgggtgtctgcctccaacacctcctccggccgcagcaccgggcactgggtcgtagctgagggcctctcgtgcctccccctgtggcttgctgcctccaggctggacaccagggctacaggcaaagcctgcccccacttggcacctcgagccagcaggtgtgggggggcctggccgaggggcagttcctcagccgagtagcagtgtggggtaccgtgactgtgggggtgccccctgagggaggggtcatggtgggccaggcatgtgtgcagccaggtcagaaacaggaggccggggaggagctggtgaaacaggcaggtgggtggttaggaggtgcccagggcagggggcacctcacttccacctcagctttccttgttcccagcggaaagatggagtacagccctccctctatagatggggaaactgaagcccagagaggctagcccttcagcccaagacacccagcatgccagcgctccgaggatctgcagctgcctcccctacccccagactgaggggtttcccagaccccatcccaacaccctcctcccaggctcagagaaccccagcccttccatgccaggctgcacatccaagcagcatccatccgagcggcatgtggagaggctcaccgtcatggtggcggcagcggggcaggctgggcttggagcggcctgcacacctggcggcaatcccacaggtgcacctggccatgcacctggcagcagccgctcttatacctgaggccacacctgggggaaattccggcaccacttcctcctcgggaagtgcccagctggggcgcttcttccttctctggtccccgcagcccccgcctgctgtgcatcaggacacagacatgcaaggaggccccgggaggcgctgtcctgttacccccctcccccgagagagactccgcccaacctgagcacctacacagggtgctgccttgtctgacattctcaaactttttttttttttttgagacagggtcttgctgtcacccgagctggagggaaatggtgctgtcccagctcactgcaacctccacatcccaggttcaagcgattctcctgcctcaggcttccgagtagctgggattacaggcaccccccaccatgcctggctaatttttgtatttttagtacagacagggttttgccatatcggccaggctggtctgaggctcctgacctcaagtgatctgctcgccttggcctcccaaagtgctgggattacaggagtgagccactgcgcccagccttgaacctcctataagagggtttctgcttgcgtatccgtcagcaccttgctgattcaacttgtaggttttcatctggacctgatggtggcggggcgcttttgcaccctatacagttcttctccgtctgctgctggtgggtgccaagggtggttcagtgttttagctgagatggtcaagatcaggtgaggctcacgtgcccccttcacccaggtgggagaggtcccggagatgggggaggcaggcacgtcttcaggtctctgttgggtttctgtgttgtttttttttttgttgtttttttgaggcggagtctgactctgtcgcccaggcggggagtacagtggtgcgatctcggctcactacaagctcagcttcctgggttcacgccattctcctgcctcagcctgccgggtagctgggactacaggcgcccgccaccacacctggctaatttttttgtatttttagtagagacggggtttcaccatgttagccaggatggtctcgatctcctgacctcgtgatctgcccacctcggcctcgcaaagtgctgggatcacaggcatgagtcactgcacccggcctgggcttctgtggttttattgagaaaaaagttcaagctaaaaagtctgagttggaggtgtgaggagtgaggtgtgaggtgtgagtgaggcatgaggcgtgaggcgtgaggtgtgaggtgtgaccagcacacacaggaagctttatgt

SEQ ID NO: 17586 - DNA, 24475 bp, Homo sapiens
agcgggtgtgtggtgtgaggagtgagtggtgtgaggagtgggtgtgtggtgtgaagaggagcaggtgtgtggtgtgaggattgggtgtgtagtgtgaggaagagcaggtgtgtggtgtgaggattgggtgtgtagtgtgaggaagagcaggtgtgtggtgtgagtagtaggtgtgtggtgtgaggaggagcgggtgtgtggtttgaaggagtagaggcacttgactgggcttccaagaagtttgacagtgagggaaaggaaacaggatggtaactcaagtgattaatagggtagaaagaagtctgttgtttggttttattttgttttactagagaaaccatgtaggcaaacaggaagcagccagtgagggaaaggaaatagcgggggaatgtgtaaggagaatagttctggtgtggagatacagaaagagtcccatggacacactaagaaattgaatattttggtggtaaaaatgagagaaaacgagggcatttacttaaagtgggaagtaataccttgctatagctagacattgttagaaaatcaagaatggagaagatttagaaaagacagtgcctcaggaaaaatgaaaaatgaggcattccagccacacagctggattgatttagtagaaaagagagttttggcaaaatccacttcgcagtttcctgcctctacatacacagagcggcctggaatggaaatgtttacttttctgccatctgttctcgtgggtctgtcaaactagtttctggacagtcgttgactctcaatgggtcattttctccattctttcttatcctcaacaccctctagttgggaggacaatagatacaggggcagaaatggaaatgtttggggctaatcaaaaccataaggataagatcctccatgctcactctagctactctctcacttgcctggaccatggcggctgctcagcaggccttttaatcagcctcatctgtgggttgaattcactaccacggcttctctaagtctccacttccttcagctccagccttagccttgattccatctgtcatcctcaagagaactctttgactctcaagacaactctgttttttttttttttgtttttttttttttgagacagagtttcgctcttgtcgcccaggctggagtgcaatggcacgatctcggctcaccacaacctctgcctcccgggttccagcaattctcctgactcagcctcccaagtaactgggattacatgcacgtgccaccatgcccagcttattttgtattttcagtagagacgaggttcctccatgttggtcaggctggtctcgaactcccagcctccggtgatctgcctgcctcagcctcccaaagtgctgggattgcagacgtgagccaccgcacccggccttaaggcaacttttattttatctgtgtgtatctgtgatgcgaattgctgctccttggagatgtgtggtgtgatgacccaggttccctcctgtcttcttcaacctcatttcttcaccatccatccccacaccaagagtaagacccatgaccacccgctagggccaggtcctcacgacctttcacttaaactcttactccaccttttaattgttcttcttatttataacctctcttcagtccagtctatcctagatactatggcccggttagttttattaagtcagcatagatcgttacatggctcagaaacaaacaatgtctgctcattgctggccttttgatgtttaattcctgcccctccactatctggttctagcctaccattccaagctgcttctctttatatgctctatgctgattcccccagacccttgttattcttcacttacaatccaagatttcttaccacaatacctttgctttttgcttctaatcccaccctcatttaacttaatttcaatgccaaaattcaatccacctttcaaagtttatctcagtgtccacttcccctacaaagactttgtggatctccccaatagaatatgatttttccttttttaaaatcttaaaacatgactctttacttctcttattgtatattctccatcctctcttacaatagagattctcaactcatcctcattgttacctgggatgctttctaaacttgtgtatacctgggccccaccccagagattctgattcagtagctggagtggagctcagtccattctggctgccaaataagatatcatagactgagtggcttataaacaacagaaatacattatttctcacagttctggaggacggaagtcagatcagcctgctaacatggttaggttctggtgagggccctcttctgggctgcagactgccaacttttcattggatcctcacttggtggaaagacagaaagagagttctctggggtctcttttataagggcactaatcccactcatgaggcctcacctccttaaggccccacctcctaataccgtcacactgggagttaggatttcaacatgtaaatttggggttgggggacacaacatttagttcataaaagaagcctacttgtatgtttaatatagattctgatgtagtgccaagactgagaataatcacttttaaaaattttttcctcattgagagaacaaaggagattttaggaagagtcaatgaaaaggtaaatttgaatcatatctctgaatctgttttcttctttaaaatggggataataactcccacttctctgggttgttatgaagcttaaggaaggtaatagatgctgcatatctaagacttagcacagtgattaatccataatgacttgtgagatctgagtgtatacatttatactctgtgcaaaggatatgagtcacacacatatgttccctggctgaacttgaacactggctactaaaggaagctccatggaagttacttcacttggtggcttaacttagaagcacttctctttctggaaaagaagaaattttcagcatttctaactcattcacagaacggacgcatgaactaatgtggctataatttcaccacattcataatacaaagaggacagcacagtgaagggtttacacagactttttccatgtatgatctcatctaatatccttgatgccctatgagggagatgttaatgcactagtttcacaggtgtggaaattgaacctcagaagaacttagatttgccaaaagttgcataagtgggaagtggcaggactgtaatttgaacccagtaagtttaatttccatccaaatgctctttacctttcaccacaactggccccaacaattgttctgttaacttgatcagggtatatggacatccattctgatcatgagagttcaggaaggcatgaagctgaggacattttgccttggcttatgtgaatcaaatgagccacggcttcactgggtataattctgtgcttagcggacgctgttccttctactggatcacattccccattggcaactcctactcatcattcaagattcaggcacatgtgctcaccccagctggttcaactcatcctttattttataactaaaaaacaaatagactatatctatgcaatctgtgtcatctcctcgggcctagaaagcaaaactgaactataaaaatacacctgctatgttgctgtagaacccacatctatatccttatccttataagaatatccttatccttatgagaataggctgctgccgaaggggcaggagggaggctagtaatagagaggcagaaagagcctacattgccttgtgagttttctgggcaaactaaatttctttcatcttcttaacttgccctgaaactcatgttataatgaacaataccttcatttttaaaactttgttggcttgtttgttttttctagcaagatatctactcaacrggygaacaactcctgttcgcactgaagtgtaaatgactgatttgatttttgggggagagagcctgagagaactcagtcccagggaccagaagcaggtgaggcacagacaccacggaggtagacagtggtcaggtgtggagaaaggattcagaaggcacaagctggagccctgaaagcaaatgcagtatagccttctccaccactgcaccagggctgggcctgttggggggatccagacccaaccgttcaattttttaacatagcatttacccaaacaccaaaaactaagtttaccgaagttttagattctcaactaaatcacttgctgttatgttcagaagaaagtacatttataaaccttgtaagcaagccattgcatcaaaataactcaacatagagttagaccaatgttaaggcattttcgtggaggaaaaagcattttttcaccaaagacctaatgtaaagaaagccacattaagccatgaactcaaggaggatgaacatgaccgtgatctttgaacaatttggcaggaagctgtcacatttatattaatacaaagaatgggttgctacatctctgcatgtctacattctacctcttcatgatccggttcaaattccacctccctcatgaaaccttccttgatttcactccctccacaccactgctgtttcctccaaacacccacagcattttatccaaacctctattaatttatctccaatactctagcaccatcacagcatgtggcatgtagtagatgacaggaaatgtttactgaatgaatgtaggaatatacatcattaacattaatctgctgtccagatatgttctaacccaagacacctttctttggatcattttcaaagttcctaagtgacctcaggaaagatcagaactccttatcatagcatctcaaatacactctttacatattaatacatgctatgtatcatacatgtagacacatgcatttatacacaagaatacctgcctttaccaaatatgtatgcatatatgtaaatgagtattcacaaagactgtgtatgataacaaactacatgcatgtggactcagaataagtgggaccaggttacatgatttgaaaagcatgcccaggggcctctgacaaacagtctcctatgtagccatattgtctggaaatctctcagtgtcttactccttgaagatgtacaacatctcattctccctctcccttgtcttctgcctgtgaatataagccaaagtatccagctgttgaaggcctagagctgctgctccactatggcccagccagagactcaagtgggagactaccatgcagagcttatagtagctcccagctcagtctctctaaacataccctctggggttgaatcctggcccctccacaaatgaaacatgtgacttaaacaggtcatctaaatgtctctggatttgatttcatctgtaaaatggagatagtaatagcatctccctcccaaggctatgtgaagatggattggggtaatatgtggaacacagtacaaatgtctgggcaatcataattttttagcaaatgttcattattatcatcatcagtattgttctctttatcttttccatggaaagtctaacttatagactagggattttctaatatgttgataccaaaccacatcctccagaagcagctctaggccccatacaaagcctgctttgtaataacacagtcactcattctctccacatacaatgagggaggataagtacagagattctctagttgggctccttggtcccaagatatctaccacaaacctcaaaatattcccctgcataagttaattcaacctcaacatcttacatagtcaaaaaatgtatccacataacttcaggattagtcccttgttccttttcctcaaccaattttgtaaaaggaaataactaaaacatccaaaagcaaagagtagaaagttggagttttgaaagactgttgaaagactcccccatttgggggtactaaatcacattataaaattgcaaaactgtcagagtgtaattaacctatgttgcttcatattcctgatgcagcaattgtttaagacatggctttaaagaggactgcaagagagctgtgagtgacacatgatgctgtgaacctcagggtgctcgccagggaagggccctacccagagggacagaaagaaagccaggaggggtagagtttgaagagaagatcatgttctvcctgaagacgcttccatttctgctcttactccatgtgcagatttccaaggcctttcctgtatcttctaaagagaaaaatacaaaaaytgttcaggtaaatgaactatcagttaggtgatgtttgatttgctgattattaggaaatagtgtgggttgttttctcttrttaaytaaaacagcctgaaagaaaktatttgggtgattagtttgagattgaacatctccttttagtgatttggagggttccaagctggtaaggactaggccttttaaaagccggacatgaaaacaagctgaattctttaaaggctgggaaaatactgctgtagagttacccctagttgggaaacttttgtagaagaawtggttttatttataaaatggtatcattttctttctcatttacctaaggtttttccttccaggatatctgcaatcaagttrctatatgtctggtgcttccatacaggcattttctttgccgccaaaaattccagatatagaaaataatgtgaggatggtagattacaatgaactagaaatcagtacacagtaaaatcatatttcccagcatcagattgtggactgtttataaactcttggaagcattataaaagcagaaccaatagtttttttccattgtttcacagtctgaaagtgaacccaaatttttaagaaacacaagggaattctgtcacaaatctctcatgcacagttttcttagcattatagtttggagaaagcattattattattaagaggttatctcttaattgtaacccccgggttaatgtaaagtccattgagtgcttattctatgcaaggcaactgctacacatttcacaaatatctcatttaatcctcacaagaaccttattggagcattattattttcatttcagagacaaaaatatcttaaatcagataaataatgtggccaagtgctcacagttaattcatggcagagttaagatttgaacccaggcctgtctgattccaaagcgtgtgatctggtcagtgtcacctactgctgtggttagagtgtgtcccttgaatttatgtgttaaagatttagtagcccatgtgacagtgggtcctttaagaagtacttaggtcattaagaaagattaatgacactcttgtgtgactggattaatttttgctggagtgggttctggctcttgcagaactggattagtaattaatagaatgggtattataaagaggggctgccctttgtgttttgccccttttcacacatgcttgctccccttttgtttctctgccatgttatgacacagcacaaggccatctcagaagccaaccagatgcagccacctgatcttggacttcccagcctccagaattgtgagagaaaatcagccccttttatgtataagttacccagcttcagatattctgttatagcaacagaaaatggactaagacactgacaaggtgccaggtgttcacaggcagcatgaggtctagttaggttacatttcactrtgtatgaagaaacttttaagccaaacttaaaataggtaatttttaggctaaactctttggattttgactaaatttaacacttccaaagagttactttggtgaataaaatgctaatatcaatgatattgctgttcccctaaaagatatttgaaattattttgaaattatcagttctcatttgagaggcaacatggtgagttaaaatctgaatcatcacttggaaaattccttaattctctgtgcttctgtttgttcagcagaataaataagccttttctacagtagtgaagaggataaaaaagaggaactgcactgatgcaacaaatacctcaagagaagtcaattaatgttagtcctaatttttttgtaaaaacaagaagacagtctcctgactgtagagtagcactttgcctgtgtgatgtgatcctcatcccttatgagacacccttttttatgcataaccattaactggagcactgagtggaggaactgttctttctaaaaagagttgttctctcaaagccaacctacaaattaatttgtgttattgttcctgtggctgtcaagttatcagacctctgtagtaacttagaaagggttgcaaaatgaccagagaactggaggtcctttcacagcaagacccctatgtgcttgtctttgtccaggactacctggaaaagttctaccaattaccaagcaaccagtatcagtctacaaggaagaatggcactaatgtgatcrttgaaaagcttaaagaaatgcagcgattttttgggttgaatgtgacggggaagccmaatgaggaaactctggacatgatgraaaagcctcgctgtggagtgcctgacagtggtggttttatgttaaccccaggaaaccccaagtgggaacgcactaacttgacctacaggtgatatctctagggtttcaggatacactcatttatccagtatggactgggctcttatatgacagacactgttcttgggatacactaggaacaagtagataaatatmcctgcctttgwagagtgtgagtagtgaatgaatatgagaatgaaaatgttgagataccgtgggttctttccactccaaggcttcccgttttagtcttccttctccaacaatctaaagaggactayagcaatgttaggctgtctctctaagcacttactttaggacccaacaaaggcttaatcattgctggagagagtcaagtccctcctttcatacatcttaataataataataatatctaatatttgtggaatattattactatttgacaagtaatgaactaaatgctttatatgtatttaatccccacggcagccctatgagagggatactatattagtatcctcattttatgaataggaaactgaggtttaaagacatgtattaacttgttcagaacccacatctgtcctccaccctgagacctgcactccctccttatcctctccagtggtagcacascatgatgcaactcacttcaaaacagaacaactcatcagttgatggactactgttctaaataacatttaactcttcatacatcctctcattttgaaggattcgaaactataccccacagctgtcagaggctgaggtagaaagagctatcaaggatgcctttgaactctggagtgttgcatcacctctcatcttcaccaggatctcacagggagaggcagatatcaacattgctttttaccaaagaggtaggtacaaagcagtcatgctcagttttgctttctttggctaacctgaaacttggcaaggatctaatacaaatgttcttatttcagatcacggtgacaattctccatttgatggacccaatggaatccttgctcatgcctttcagccaggccaaggtattggaggagatgctcattttgatgcygaagaaacatggaccaacacctccgcaagtaagttaatcaagattatgtccacacacagcttctgaattaaccttttacagattagaatacacacacacacacacacacacacaataaaggtaacataatatttcaaactcacaaaaagtgatcatttgaaatttttgcwacctcatgatactaagtcaatttgggatttttttaaaaaaagaaagaaraagacatgctgaatctgattactgaccttacttcttaggtcagagatcagaaaatacagactacggccaaatcctgcctgacccctgtctgtataaataaagttttattgaaacagggccacatttatttgtttctatatcataaatggctgctttcactctacaatggcaagctgagtaattgcaacatggatcatttggcttacaaagcctaaaatatttgctatctggttctttacagatactgctttagaatatctttattttaatattcccaaatttagtgatgtttgaaaagagcctatttttccatttttggaaattcatttagaaattataatttctataattagaaattagcctatttttccattttttggaaattcatttagaaattataatttctataattagaaattagtctattgagaaaagaacagacaccttccctctcatctagttagttcatctccttggagctcttcttcagtggtatgcttctgtacagcaagccactcctttcaggagaaggctcctattaagaaggactgggctgcttgaagggaagaaatgaggctgaggacaggtatacccagaccatgtggtacttcacaaaatatggggtaacaatatgccagagagcacttttagaaaataatcagaaaggcaccttttacctttgcttggcacctgttcctcctgccattttctcaacatgggtatgttacgagggtctattctacctaagtccatatgctaggagctgtgtgtagccaaagataggtaataaccctcagctcctctccattccctgttgccctcctcactagttcggatgatcattacctcttacctgaacgaatgatctagattcctaactggactctccatctccagtatgtgctccctctaatttttcctaccattgcagcagggtttgtttttggaagcccatcttggatcacatcactctcatgcttaaaagtttcaatgtttacacattctgcaccaaataaggtccaaatacttccacttggtattgaaggctcttggtgcttgttcatccttgtctttcttggcttgtcttcttatttcacgtattccattcacatcgggctaacacccacattgtacattcactgtttctaggtcacaccctatgcttttyatcttcctcacatttgcttgaattgcttcctctccctgaaatactcttcccatgccccamrcaccaccttttaaaatctctctcatcttgccatgctatgtatgtcaaaggccaccttctgtcttgccttgtcctggaaatgagaacttcctctgcagaattctgacagcttttgtatctccttctctgtcatcactcactgtgtgctttcaagttgtttgcacacatctctcctcttctagactatgcactccctgtagagcagagaaccacaacaaattgcccacagttcctttcacggtattccaagcattcaaagatatttttctgaaatgcactcatgaatgcataattaaaaggatgtgatgataagaaacaattcttagagcatgrgtagaattttagcaggctaattatcaacaggaagttgaacattgcagtaagagcatggatcttgccattatacctgggtttgaccccaatctgtcacttactagttgagggaccaagtaccagctattcaaaatctatgggcatcagtcactttactataaaaatattgttaataaaacttcrgaaaaatgttatgaggattgcataacattagattgcctagtatgttgtaggtactctacaattatggctttttttaaaagtaggcatatacaaaaatgcatcagtgtgtttgtgaggcagcatgtagactggctggactgaaggattcatgttaaaaggcaagcactcaaatatctgctggagccaagtggaggaggtcttgaaggccaggcaaaagaggttgggctttatttgataggaagtgagatcctgggaaggttttaagtctccagttgtgaacggcactatgctcatggaagttaaaacatggagaaagagagcaataagggtaggatttgtctctctccagtagagaattcctagagcatcttagaaagctcagaaacagagaagagctggtgctaagctgtgggtgatgagggagccaacatgagccagccctccatctgaggctgctccactgctgggctggcttctcttctaactacttgctcacagggactctactcgtgaggctgagtgtctgggacagtggagatggtgattgtgggaatgcaagagaagaggggttcccaaagtcatgacggctctgccattacttctccaagtctcagatgcacatttgtaaaatgtgagaattggaataaatgcagcttttctgggttctaagagtttataagaagttcatactcacctagtcgccatctatgaccactatcttgattcttctcaatgtccactttctcaggtatctgaaagaaagatgaaaaagacagccatgggaagggctatttccctgagcagttttgacttggaggttgcattccttgagatcatgtttctgccaccctgggatccacactgagctgtttaccacccgtgtttgcatttcagattacaacttgtttcttgttgctgctcatgaatttggccattctttggggctcgctcactcctctgaccctggtgccttgatgtatcccaactatgctttcagggaaaccagcaactactcactccctcaagatgacatcgatggcattcaggccatctatggtaaggtcttctcaagagagtcatagtacatggtaggacctgggaataggcgaacactcccagaatctgaatatctcttcctttgcacttctgcagtttccataaaactgaactctgaatttccccagtaataaagcattaacaaagaaggtgtgagggactgagcctctattgctgccctaaaagaaaaaaagtttaagaagaaatgcactacagtgcttcccagttattgtctttggatggtggggatttttttcttcytttttaggctttccaaatttccaattttaaatttttttkggggggggggatggagtctcactctgttgcccaggctggagtgcagtgacgcgatcttggctcactgcaacctctgcctcccaagttcaagcaattctcctgcctcagcctctcaagtagctgagattacagatgcccaccaccacacttggctaatttttgtattttcagtagagaggtgatttcaccacaatgaccaggctggtcttgaactcctgacctcgagtgatctgcccacctcagcctcccaaaatgctgggattacaggcgtgagccattgcacctggccccaattttaaatattctaaaaagacatgactattctttttcctacagcaatcctgctcccagatgtatctatcaaagaaattctcatgtagatccataaggggacatgtacaaatcatgccaaagatgttcactgcagtcttgtttgtggtaatggaagttggaagacacctgggagtctattaggagaagactatacagataaaatgtggtagctgcacaccatgaagtgatgtgcagcagtgagaaacatggtactagatgcacatatggcaacagtacagatgggtctttaaaacttggtactttgtgaaaaagaaacagaatgagatatattgcacaatgtattaattaaattacacaatatataagtctatgtaaatttaaaatgtatataaacaaagcaaggcatttttcaagaagaagaaagggaatggtagtggagtatggagagaaaaaaagaaacttttttaaggcatcactgatacatttcaaggataagtataggggccttttgccatattgcctggataagaccattacatctctcttcacgcttgcccttctgttccctagttggctgtgaataaaaacaagaaaccaataagggatttactgctctctaaaaaagtgtggaatggaatggaatagtggattggagtgaaatataattgaatggagtggaacagagtggagtggaattggggaaagcccttttctgtctctggtgggacagcactataaaatcaagcaagcatgccagggtgccacaaccagggaacttttttgtgattgcagatatttcagaaatgttgagcctatcctaactgcctctattccccaatttcttcctcctgcccaccccaacaacacccctttattttgttcaccaatgtttttatcttaactattattatagcctttcattccacagtgagaaaacacatgaaaattcaaatacttatagaaaaaatattgctaaaatttgacttaggtgtatgctatagcgtaaaagactaatatcattctttcctgaaagtggattttggtgaggagagaggcaatagatactgagtgaccaaaaaagcagaaagagraactgaaaagtcagagaagaattagtttagaatttaaaagggaaggaaggagcatagaattcaaatttctttacttcacagcttgacctggaacttaccctgaaaaccatcattactcttattaaagaaacaaaaactttaaaaggatgaaatatacaattactttaatactttatggtatagtctggtagcacttaccttcacatgaagacccttcacctttytgagaagtctctgatgtacccaagagtcacaccggacttactctcataagaaagaccttttttttttttttttttttttttccaggactttcaagcaaccctatccaacctactggaccaagcacacccaaaccctgtgaccccagtttgacatttgatgctatcaccacactycgtggagaaatacttttytttaaagacaggtataaaattgaaatatttcttcctttgattcctcttactgacataccttaaaactggattcaaattaagtcacacgttagtcaccttttccttgaattctatacttgtgcttctcatcggaattttttataggttctggggcaccactaggattatcatagccccctgagcttaactttatcatcttcgtcttttaaagactatttgtaccatttttgtgtctatactgaatttatgcaattgagtattttctgggtaactcaagacatccaggagaaaaaaaaaacatgaaaacattcacaaacattcagatgcctttggtgatgtaaacagacatgggctacagctgcttgggaaccccatagctgaaacaccaaagcaccatccagttccatccaaaatcagtcaagtaaatggaacctgcgcttagctagctgtgcagcaaatcatcaaactgagcgaaatttttatttgtccattggctattttgtgagtgtgcaatcacaggctgagggtacatgctgttgcttttatcaatatgttcacagcatttastgggagcaataatgaaagatgctacaaagtaagatttttcaatgtccaaggcaggacaatgccaaatgtaatcaaataagatcactcccataaccttccctgaaagctgtgaagtacttgccagatggacaatatcactataaagcttcgccatatgctggtcactgtgctaggaactttgcattcgttcgattgttatattctcccagcaatcctacaaggaccatcactagcctaaaagtcacaggaactgcctacttagactgttatgtataagtgtgtgtgtgtgtttccttatgttccgttaggtacttctggagaaggcatcctcagctacaaagagtcgaaatgaattttatttctctattctggccatcccttccaactggtatacaggctgcttatgaagattttgacagagacctcattttcctatttaaaggtaacttcctaaagttttcatcttatgttagttctgcctgaagggagggggcaggacttctttgtggtccctttcaggttcatggtgagctaatgacagcattaagctggccaggcttttgccagaagactagggttgggccccatcaggaccactaactrctgtgtgaacctgagtgggttatttgcttttcagccctcagttttctcaccaacaaaatgagaccacactagactgtcgttagcattctttcatcctcatcccagatacaattctctaagactcctcaagctgtaatttggtttctgcataaaagtcacacaaactaaggcatccaaytgtggggccttgaatgtcttgctcagaagtttttattttttataggctctggggaaccattaaggctctcacagcccccctgaacttaactttatcatcttcatcttttaaagactatttgttccattttcatatctatgtgcaagaccaagaagtggtatatatatatatatatatatatatatatatataattttgtaaaaatggaaaagtcgtatttaacacttaacctgaatcattgacaggcaaccaatactgggctctgagtggctatgatattctgcaaggttatcccaaggatatatcaaactatggcttccccagcagcgtccaagcaattgacgcagctgttttctacagaagtaaaacatacttctttgtaaatgaccaattctggaggtaacgtaaactattttttcaattataggttgaaatctgtgtttctctaccctgcttacaaaccttcaagcatttcaaggtttaaaacaatctagatagtctctaataggttttaccgagaatatattcttttttacaggatgattgatgttaccatggcttttgaaatttttcatttctataaaattaaaatgtctatgcaatagtattgaggattctgcatcaagaaacaaagaaaaccttaacaaagcactagggtgagatacaaagaaagatttaagctaattctcacttatgagttcaactcagacatatgcaagcaaatgttatccagatagcctgcagaatttggttcccaagttgaacctattatgtatgtttatatatctatatacacacacaagggagttatactatataccaattaagtaaaagccttgaaaatataagcttactttgggtaataacagtgtgtcagccatcaagcctgttttagaattaatgataaccatatgttttataaatgtgtacccttaggtagagaaattaaccattcttaatcctagtaaacagggcattgtgagaactgaatgaaaaaatatgtgtgaggagactttgtaaattatatacaataaaaaaaatttttttcgttatattctgtattggtgttaaatcggatracattttgtttttaccagatatgataaccaaagacaattcatggagccaggttatcccaaaagcatatcaggtgcctttccaggaatagagagtaaagttgatgcagttttccagcaagaacgtaagtaggaaaaaaaaaacctaataaatgtgttgtttgtttgtttattatagaggagacagggtcttactatgctgaccaggttagtgtcaaactcctggcctcaagcaatcctcccacctcagcctcccagagttctgggattacaggcattagccaccgcacctggtgtttaaattttttaaatagcatgwttgcatttgaatgttatgttggaacaggggcagggttttctaactgaagacrtctgagatattctataagctaattcaataaatyatctctctttttttatagatttcttccatgtcttcagtggaccaagatattacgcatttgatcttattgctcagagagttaccagagttgcaagaggcaatamatggcttaactgtagatatggctgaagcaaaatcaaatgtggctgtatccactttcagaatgttgaagggaagttcagcawgcattttcgttacattgtgwcctgcttatacttttctcaatattaagtcattgtttcccatcactgtatccattctacctgtcctccgtgaaaatatgtttggaatattccactatttgcagaggcttattcagttcttacacattccatcttacattagtgattccatcaaagagaaggaaagtaagcctttttgtcacctcaatatttactatttcaatacttacatatctgacttctaggatttattgttatattacttgcctatctgacttcatacatccctcagtttcttaaaatgtcctatgtatatcttctacatgcaatttagaactagattttggttagaagtaaggattataaacaacctagacagtacccttggcctttacagaaaatatggtgctgttttctacccttggaaagaaatgtagatgatatgtttcgtgggttgaattgtgtcccccataaaagatatgttgaagttctaaccccaggtacccatgaatgtgagcttaccagggtctttgcagatgtaattagttaagttaaggtgagatcacactgaattagggtgggctctaaatccattatgactgttgttcttataagaagaagagaggcatagycacctaggggaggaggccgtrtgaagacagaggcagagattggagtgacgcatctccaagccaaggaattccaaggactgtaagccaccagtagaagctttgaagaggcaaggarggattccctccaatagccttcaagtgtgaccctgctgacacctgcagasttcggacttctatcctccaaaaccgtgagggaataaatttcctttgttttaagccaccaactttgcaatactttgrtacagcaaccctagacatgaggtactagacacagtacatctacacatatgaaaatgaatcaacacagaatgcagaagtagaacccttgctaaggactactgggcatcttcccaggacagcagccaaaagagaaccaccacttcctctcctgcctcctccttgctctctcctagagtccaaacccaaatgggccagttggatctgatgttcgtcagttctttacttctatttcctggggtactcaggagggcacacactatagataacttgggttagctgcataaaattcaatgtctcattaagttgcattaaactgagcttagatgtgtaagtttgctaacggatgggtttttttgttaagaactataggatttatgggaccaagtctagcgagtccagatatcaaaatcattataatgttatatttgctgttattagaatataatatagcttattatacaataaatatgtagactgtaaaatatatttctcactagtacctcctattttctttctctgttgaagtttttaaatcccacagataattaaattggcacctttatgcttgttcaaaaattaaaataatctattaaataagttcaaattaaagatttttacttcaaatgactgatttgtgatttgcttttaatttcttaaaatgttaccacataattcatctaaagtataaaaaggaatagcaaattttagatgttgtgcagatatataatgcttgtgtcagaattattataatattgataataaactttagatattgcttcagagtgtgtgaaatattttataaatatttgaggtcctcaaaaatttcctcaagtatgttaatacattattctcaaattattttacaaaataagaaaactgaaacaagtatatattatcattccattcattgatttattcagcaagaattaactacctacctactattaattatgtttcagggactgtgctaagaaaagtgagagagatgtataagcgattcatcatatcaacgtaacaaatgcaaaaggatctataagaattgaatattccatttttaatagtagcatcaatttcagactatcatgtttcctaaaactttctataatgccagttatgaaagttttaggaaaatgcaggcatgaaaatgagtgtcttatcttctcagaacacctgctagttgtgctggctatgatagactcttggctcaaacctcatctatacatctttgagatgagaactgatctcatactattttttaaccacatttgacagagtcatagacagtgaactgtaatatgaagtgtaataaagaattcagagttattccttttaaaaaaattatcttgttgacaacatgtagtattttccagctattacattgatattttgaatgggcacaagagatataaagacctaagcttagaatgcatttatttattttttgtttatttatttatttttgagacagggtcttgctctgtcacccaggctggtgtacagtggtgcaatcacaactcactgcagcctcaaacccctggcctcaagcaatgccccaccttagcctttcaagtatttgggactacaggcacacaccaccacactcagttattttcttttgtaaaggtggggtcccactacatttcccaggcttgtctcaaactcctgggctcaagtgatcctcctgcctcggcctcccaaagcgctgggattacaggcttgagccaccatgccaccctgcctaagctagaatttaaacaatgagattcatgtttatcttaggttgagattcttcaaaagcaaagcctaagtcaagacattggtgcaattatattttcaggacacagtcccaggaagcaagagtgaggtagcaagaagagtgagtcaaagaatgaggaaaagccaatacaattatgtgttatcaaggtttctgctatgggcaattgaagctcaattccaccaggggcctctgagaagcctgcagaccagcttccagtcgttcacatctccagtgagcaggaggctggaacattcatccttcagtttccattccccattggatgaggatgttccctgagagtgttaacttctttacacttccaggctgtactgtcatgctgacctggaaggcttgatggcatctcaatgctctgggaagaaagcaaaaagacacacagtctgtgcttaaagttgtattaggttggtgcaaaagtaaccacaattacttttgcactttgtcagagcaaagtgagttacacaaaccagtccaccccttgtgcaactaaattaatgctgtgggtatgtggcagaggacatcagaagaatctcctacagctttgttccttggagatttaaatgatgggaaattggatgagctttctctggagtaacttaccagcctcagaaaaaaaagaaattacagataccaacactggagaaatctcagtgtggcagggctgctaatgacctatcttaaccttcagtctacacttcttctgcagtgagactccaatttcatttgaggtagcaatgcgtcatattttgtagccttgcttacagctaggcttacagctggatatggccatgtgtttatttctagccaaaatgtgtaagcagaatgttgtgtggggcttctggaaagggactggaaaattactttttctctgccttcctccttctttctgcctgtaatgcagatgtaatggctagaggttgagaaggcagctgactcatgaggcattgtactgacagagtggtgtagcaaggtagatgttgcctacccttgatgatatggagctgtcaaacaaaccctaggcttccaaatctgggcacttttttttaatgtgaggcaaaaatacatttttatttaactaagcatctgttattttgggtttttgtgttacattcaaccaaatctcatcctgactaatacatcacatgaagggtgtgggaagtgccccacctccctgcagtgaaggtcatcaattcaccatccctgcctctacacatgagagcttccagtctgctttcttgcctctcattcttaagcagattgcacaacacaaagtcaccaaatatttttgaaaagattgcagtgtgaaaaacagagaccaaaggagagactttgaggaactagagacaattgtaggagcaaaagaaaatgtcgaaataaactaaagtatacttaacattaacattctttaaaaataagaagagactgggtacagtggtttgtgcctgtaatcccaacacttttggaaggctgaggcagaaggactgcttgaggctcagcattcaagaccagcctgggcaacatagtgagaccttgtccctacaaaaaaataaaaataaaaatattagctgggcatggtggcatgcaactatagtcccagctactcgggaggctgtggcaggaggatcactcgaacccaggagtttgaggctgcagtgagtcatgactgtgtcaccgcattcgagcttgggtgacagagtatgccttcttttgtttatttaaacaaacaaataaataaatataagaattaaatataagaatataattttggatgtaaaatatgtcttatttatttaataatttcttatttatttagttatgaattatgtattattaattatttagtaatttatttaaataaataaataagacatattttatgtccaaaaacactaatgaaatgcaaaaaaaaagcttaaaaatgtaaaagaatactcagaactggaaagagttcttggaaattaaatgtcttagctgaaattaacaatcggtgggctggaaagttaagttggtagaaaataggatatattagaagcataaagactcaatctaggaggtccaacagatatggaaagaaagaagagaaaatgaatgggtagaaaaggagaaaatgaataggaagaaattataaccaaaactatattggaaagttaccttaaattgaagtttccatgaaaaaaaggtccacttactgtccaaaaatgttaatacaaaagacctacatcaagagcataactataaaatttataaatatctaggtaaagagaagatttccaaaacctttcaaaagaaaaacatcaagaatcagagtataaaacttttcaacagcagcactagagtctggaaaataatggaatcttcattatccttcaaagttctcaggcaaatttattttagactgaaattctgtatccagtcatacaccaatcaagtgtgaggatgaaataaagggcattcttaggtatgaaaaaaatcagaatatttattttccttatattctttcttagaaaactcctgagagacatgttgcatcaaaacaagggagtaaatcaagacataggtagaagtgaaacccagtagccagagatctaacacagagacacaatacaagttttctggttaatgagaggatgacagttctacaacagacccagactggagaaggcaagcaaggggtctcagagggatgagttcaagggaaaaaaactgctgctatatttcctgtcatgtttggttattctgagagagtttaagagttctatggaagaatttggtaaagaattagcatataaaaatcaattcaactatcaactgcggagaaaaaaggctatacaagaaaggagatgtaaggccaggcatggtggctcacacctgtaatcccagcactttgggaggctgaggggggtggatcacctgaggtcaggagttcaagaccagcctggtcaacatggtgaaaccccatctctactaaaaatacaaaaattagccaggcatggtggtgcatgcctgtagtctcagctacatgggaggctgaggcaggagaattgcttgaacccgggaggcaaatgtcgcagtgagccgagattgtgccaatgcactccagcctgggtgacagagcgagagtccgtctcaaaaaaaaagggaaaaaaaagaaaaggatatgtaatcatagtatactacgtgattctcttgtgaataatattttcatggtcataattgtatgaacgctgattacgggcttaaacattcctataaccaaattaggaaagcagaaggagtgttaagtccttcttttccataggaagatgttaataataacatttaactttgaaaactcgagaaatagtagcataagcacgttatttacaaatgtggagttaaacataaagataaaaagctataaaaataatttaaagaagttacctttggggagcaggacttgaaggagcgaaaggttagggcagagagatgctttttcgttacaacaagatagcaccatttgacttccctttttctggtaactctatttttttttaaattttgttctgaaatattttagagtttaaaaaacacaaaagaacaatacaatgagcatacttgtacttagcatacttgtacttaataccattataacacaaatcctgatcatgtctgccttctccccttcatcccattgctccagaggccaattaaacaatttaaactatatacatatattaaaacagtaaataataatatttctgaaacaagatttataactgggatgagctttaaatgcaaaggaagtatgtatctacttagatcctataagttcctcagctatgccatataaattttgtttaggatatggacaaggaagatttagaaaggtgtatcgattgaggagttaacatttgggaagaaagggaagaaaattttaataattggtagaagaaaaggggaggacaagtgagggaggacattgctgtaactaagactgttccttcatctaaaagtagcccaagtaaagaagaatatattgaaattaatccaaaaggctctcactaactatattctcacttctgatgttaattttggccttcatcatccatgacctctatgactcttcatcttcccagtcagctgtcttgtccatgagaccctccatcccatcttcc

SEQ ID NO: 17587 - DNA, 24313 bp, Homo sapiens
agttcaagaccagcctggccaacatggtgaaaccccgtctctactaaaaatacaaaaatcagctgggcgtgatggcagatgcctgtaatcccagctacttgggaggctgaagcactataattgcttgagcctgggaggtagaggttgcagtgaactgagaccacaccattgcactccagcctgggcaagaagagcgaaactttgtctcaaaaaaaaaaaaaaaaaaaaaaaaaaattggcggggcatggtggtgcacacctgtagtcccaactagcaactcctcaggaggctgagatgggaggatctcttgagcctgggaggtcgaaatgcagtgagtcatgactgtgccaaggctgggagccatgattgtgccactgcactcccacctgggcaacagaacgtggcccccactcaaaaaaaaaatgcaattgtggacaagcaagggctacattgggtaaggcagcaccagttagagtgttagggagtttaaagagaaatgaccggccaggggctggcaggggagaggggatacagcaggagaggagggggaagtcagtcacagagccagggtaaggaagggcccctggacaggctgtcccagagccacgatcttaaataaaaggcagtggagggccaggcgcagtggctcacgcctataatcccagcactttggaaggccgaggtgggtggatcatgaggtcaggagatcgagaccagcctggacaacatggggaaactagtctctactaaaaatacaaaaattagccaggcatggtggcgcatgactataatcccagctactcgggaggctggggcaggagaatcgcttgaacctgggaggcggaggatgcagtgagccaagatcacacctccgcactccagcctgggcaacagagcaagactccatctcaaaaaaaaaaaaaaaaaaggcggtggagacacccagcactggttccctcctagagaaggggagagagccgagcccaaacacaggctatttttggagttgtgttgtttggagagcaaccaagccagaaatagtgctgttagcaagaccctgccttctccaacccccggctctcccagtgaaatcaccaggaatcagggaggctgggccccacattccagggagcctgtgtaacaggcagtgctctcttccccaccggaagggcttgggagctgagcatttgactgtaaaagggattctgggattccagagggacagagggactgagtcagagagagagagagagagagtggaaatggggggcaacctcctgcagcggaggagaggggacaggagggaaggcttggggaagaaagggtaggcaggaggtcagagagaagggagcaggaagcgggaggctcagagagagaaagggaaagtgaaaaagaaagcggggaagacagaagcaaagaggaagagcagagatcgggccagaaggcgggaggtcagggggcgatgggtggtgggaaggccagtgtccacccagggcccaccagtgggtgggggacagagggacagtcatggaaaatctgagtgtgatctacagtcacgaaccacctgctcagggacagatggagacatctttcccagtagctggaatcagaactttcccctgaaatccacagcccggtaactcactctcttatctctgaccctccggaagccagagatctagctatttcatcagcatggacttttctttctgtgcccgtgtgaccccttacaaaagagctcaagctggaaagagaggattggatcaagaaagagagaacttaggattcaggggaaaaggggaaagtgataaccccttgagtcagattctgagaagagggtttctctgagaggtcggtggggagcagcccgcaggcagctggaccctggtatggaagggctcggctcctaaggcaggtaagagaaggcagggccacgtgcatgaagtagaggcaggggtcatggccaagtctgggttctttttatttatttatttttttgagacaatcttgctctttcgctcaagctggagtgcagtggtgcaatctcagctctctgcaacctccacctcttgggttcaagagattctcccacctcaggctcctgagtagctgggactacaggtacgtgccgccatgcctggctaatttctgtacttttttttttttagtagagacggggtttcactccaagtctgggttctagagtagctaggcagccccagctcatcagagtcaatggagaaatcggaaacttcacatggacccgataacacaggttttgcctcagtttctaatacacatcttccctatgcctacaagtttccaccgatttgggaaaagacctcttagtaagtcagccacttctgagtccaaagtaaaacgctccccaccctccaccccaatcaggactagagctgctccccagctctcccgtgcccaaggatggaatgtcctttttgctctttgctttgtcctttgagacagggtctctctttgtcacccaggctggagtgcagtgttgcaatcatagctcactccagccttgagctcctaggctcaagcgatcctcctacctcagcttcccatgtagctgggaccataggcacacgccaccacactgggctaattttttttttttttttggtagagatgggatctcactgtgttgcccaggctggctcaaattcctgggctcaagtgatcttcctgcctcagcctccccaaagactgggattacaggtgtgagccaccacacccagcaggggtgtctattttggattggcatcaggatcatccacccaatctatgagtggggactaaattggtgactgctcctgcagagctctggctgtccacagaaaacagcagagacctggcaaggtatgggacaatggctcctggtatgacaggcagaggaagggatggaggctaagctgcagcctggagaggctggcgtcagacacctgaggaggccacatctagctatgtctagacccattgaactttcaagtcttcgaggcttggtactgcctgatccctgttcccctctgatccttaaggtcagagagcaaagccttgcggggtactttttttttttttttttttgagacagattcttgctctgtcacccaggctggagtgcaatagcatgatctcggctcactgcaacctccacctcccaggttcaagcgattctcctgcctcagcctcccaagcagctaggattacaggcacgcaccaccatgcctagctgatttttatatttttagtagagatggggtttcatcatattggccgggctggtcttgaactcctggcctcaagtgatccacctgccttggcctcccgaagtgctaggattacaggtgtgagccaccatgccctgtcttggggtacttttgaggacaagagttaagttcgggactgggcatgttggcttatacactttgggaggcaaaggtgagaggattgttccagcccaggaatttgagaccagcctggtcaacatagcaagactctgtctctataagaaaaaataataattagctgggcgtggtggtgcttgcctgtagtccccgatacttgcttgagcccaggagttcaagtctgcagtgagctatgatcacatgactgcactccagccttggtgacagagtgagaccctgtctccaaaaaaaaaaaaaaaaagagatgggtttggggctggacttgtcttcttccaagaggtcagggcagttgcttcttcctcaccgctaaccacactctcagggactccaaaccacaactaagaaaaggaaaaagacataaacaagaggcagtttcacaggaagagttctcctaatgtgtctgtgagcctaactttccgactgtggttctcctctctttccctgccagctgtgagaaaacaaagcctaaggcagattaaaaagcaggagggctgctcagtgtggttgcccttggtatctgtttactgaaaaaatycaaaacaaacatccgacgcttccacccactgaaacttcctgtgactctgctatcagctgttgccatggattctcccaactgaaccccaccacatacactaaacccaacagtccgtggaccccaagtatgccatctctccaatacaggaccccctgggcagcaccctggccacccttccatccacaacatccagaccacacggccaagggcacctgaccctgtcaaaaccccaaatccagctgggcgcggtggctcatgcctgtaatcccagcatttgggaggccgaggcagccggatcacgaagtcaggagttcgagaccagcctgaccaacatggtgaaaccccgtctctactaaaatacaaaaattagccgggcgtggtggtgcacacctgtaatcccagctactcgggaggctgaggcaggagaaccacttgaacctgggaggcggagattgcagtgagccaagatagtgctactgcactcagcctgggcaacaaaataagactccgtctcaaaacagaaaaacaaaaaaaacaaaaaacaacaacaacaacaaaatccactagtctagccctacatgctcacccactgctagccagtttccaccctctacagcagaggtacccaacctctgggccaggggcccgtactggtccatagcctgttaggaaccaggctgcataacaggaggtgagtggcaggtgagtgaaatttcatctgtagttacagccactcctcatcactcgcattaccaccagagctccactccctgtcagatcagcggcggcattagattctcataggagctcgaaccctattctaaactgttcatgtgagggatctaggttgcaagctccctatgagaatctaatgcctgatgatctgtcacggtctcccatcacccctagatgggaccatctagttgcaggaaaacaagctcagggctcccactgattctacacgatggtgaattgtggaattatttcattatatatattacaatgtaataataatagaaataaagcacacaataaatgtaatgtgcttgaatcatcccgaaaccatcccaccctggtctgtgaaaaaattgtcttccatgaaaccagtccctggtgccaaaaacgttgaggaccactgctccacagaatctatcggtcactcttcctcccctcacccccttgccctaaaagcacaccctgcaaacctgccatgaattgacactctgtttctatcccttttccccttgtgtctgtgtctggaggaagaggataaaggacaagctgccccaagtcctagcgggcagctcgargaagtgaaacttacacgttggtctcctgtttccttaccaagcttttaccatggtaacccctggtcccgttcagccaccaccaccccacccagcacacctccaacctcagccagacaaggttgttgacacaagagagccctcaggggcacagagagagtctggacacgtgggggagtcagccgtgtatcatcggaggcggccgggcacatggcagggatgagggaaagaccaagagtcctctgttgggcccaagtcctagacagacaaaacctagacaatcacgtggctggctgcatgccctgtggctgttgggctgggcccaggaggagggaggggcrctctttcctggaggtggtccagagcaccgggtggacagccctgggggaaaacttccacgttttgatggaggttatctttgataactccacagtgacctggttcgccaaaggaaaagcaggcaacgtgagctgttttttttttctccaagctgaacactaggggtcctaggctttttgggtcacccggcatggcagacagtcaacctggcaggacatccgggagagacagacacaggcagagggcagaaaggtcaagggaggttctcaggccaaggctattggggtttgctcaattgttcctgaatgctcttacacacgtacacacacagagcagcacacacacacacacacacatgcctcagcaagtcccagagagggaggtgtcgagggggacccgctggctgttcagacrgactcccagagccagtgagtgggtggggctggaacatgagttcatctatttcctgcccacatctggtataaaaggaggcagtggcycacagaggagcacagctgtgtttggctgcagggccaagagcgctgtcaagaagacccacacgcccccctccagcagctgaattcytgcagctcagcagccgccgccagagcaggacgaaccgccaatcgcaaggcacctctgagaacttcaggtaggagaaaakcaaactccctccaacctcttacttcgggcttaaggcagagaactcgcctccccagaatctcctccctccatgatcccccrctattcctctattttcttttcctcggacctgcagccttgggtcgaccctgccctaggggtgactgcaggagagcagggaggatggtcaggcgtcaccaacaaccccatcacccagtaacaagaacyttgactctctcagtccctctgcatcaagacacttacccatttcccacctcatgcctgctaacttgaatgaaacaatcgctgggaaagcattaagagaattaaggctgggcactgtggctcatgcctgtaatcccagcactttgtgaggctgaggcaggcagayawcttgagcccaggagtttgagaccagcctgggcaacatggcaaaaccctgctctcccaaaaaaatacaaaaattagctgggcgtgctggtgtgcctgtattcccagctacttgggaggctgaggtgggaggattgcttcagctggggaggcrgaggctgcagggagccaagactgagccattgcacccagcctgggtgacagagcaagaccctgtctctaaaaatraatgaaaggaaggaagaaagagagagaaagagagagaggaaagaaggaaggaagtaaagaagaaagaaagaaagaaagaggaaagaggaagaaagaaagaaaagaaagaaaagaaaakaaagcaaatttaaagcttatgcaaatcaaagatgttgtgataattgataattgagtctgggctaaattccccctgggctgcaaaggcagagagtggtaatgacttctcacctgcttttcttctaaggcttttttacgggacacagagggaagggagatggactggattccaagattcccacagggcaagatgggcgaagactccctgccactgcccggggataagtcagtctgagtgagacggagtrggatgggcttagaacctgaacatgtcatggtctcttcctgcaccttgccctagtgttcacttaccacctgcttgcaggaaacaagaagagcagggcccacagctggccagctcccctcccctcccrcctgtcttccagaacgattccttcaccagccctctttccattgctctaggatgcagatgtctccagccctcacctgcctagtcctgggcctgrcccttrtctttggtgaagggtctgctgtgcmccatcccccatcctacgtggcccacctggcctcagacttcggggtgagggtgtttcagcaggtggcgcaggcctccaaggaccgcaacgtggttttctcaccctatggggtggcctcggtgttggccatgctccagctgacaacaggaggagaaacccagcagcagattcaagcagctatgggattcaagattgatggtgagccacgggacaccaggggaggtgggtggcatgcagaacagacctaccagaagccaaggaaaggctggctctggcttagccgagccaagccccatacagctgtgctgcaggggccaccccatcttcttcccactacactccaagtcactggayccttgaatctccaagggtgtctgaccagtagatttacygcttattcaccaccgtgtgatcttaacctcgttwagtttgcccatctacaaaatgaggattatttgctgtcctaaagaattcatgagccgggcgcggtggctcaaacgcctgtaatcccagcactttgggaggccvaggmgggcggatcatgaggtcaggagatyragaccatcctggcyaacacagtgaaactccatctctactaaaaatacaaaaaaaattagccaggcgtggtggcrggcrcctgtagtcccagctactcgggaggctgaggcaggagaatggcatgaacccaggmggcagagcttgcagtgagctgagatcgtgccactgcactccagcctgggcgacagagagagactccgtctcaaaaaaaaaaaataaaagaattcatggaattacacttgtgaaatacttagcatagccatcactataggaaaaaaatctaaggccaggcacagtgcctcatgcctgtaatctcagcacttttggagtttgaggcaggaggatcacccaaggctaggagttcaaggccagcctgggcaatacggtgaaaccccgtctctaataaaaatataaaaattagtctgatgaggtggtgcacctgtaatcccagctactcaggaagctgagacacaagaatcactttaacccgggaggtggaggtggcagtgagctgagatcacaccattgcactccagcctgggtgacagagtgagacctgtcaaaaaaaaaaaaagaaagagagagagagagagaagagagagaaagaaagaagaagaaagaaagaaagagagagagagaaagaaagaaagaaasaaagaaacaaagaaacaaagaaagaaaggaaaagaaaaaaaaaactaaggccaggcaaggtggcttatgactgtaatttcagcactttggaagattgaggcaggaggatcacttgaggccagaagttcgagacaagactgagcaacagggagacccctgcctctacaaaaaaatttacaaattagccagatgtggtgacacatacctgtagtcccaactactcaggaggctgaggtgggaggatggcttgagcccaggagctggaggctgcagtgagctatgattgtaccactgcacttcagcctgggcaacaaagggaagccctgtctgaaaaaaaaaaaaaaagaaaaagaagaagaaagaaaatatttagggttcatccaggaggcagaggttgcagtaagctgacatcgcgccattgcactccagcctgggagacaagagcaaaactccaactcaaaaaaaaaaaaaaaaaaaaaacaggaagaaaatatttagggttcataayttaagaacagagaaaaatattctagcccaaagaaagggttgggatctgagacttttgaagaaaggaaggagatacagaaaagagatttcatcctggaatgaaatctccctccagagagccctgggaaagcacggtagcccccatccatcagagtggagccccttgtgggggaagtgggctcggctgggaaccctcaattcagcataagcctcacatgtcctctcctctctgtcccggtgcagacaagggcatggcccccgccctccggcatctgtacaaggagctcayggggccatggaacaaggaygagatcagcaccacagacgcratcttcgtccagcgggatctgaagctggtccagggcttcatgccccacttcttcaggctgttccggagcacggtcaagcaagtggacttttcagaggtggagagagccagattcatcatcaatgactgggtgaagacacacacaaaaggtgagcaggcagggaaaggaaacccatttcctgggcctcaagagaaagggaatttggaaataaatccacatawcccagttgggtgcagtagttcacacctgtaatcccagcccaacactttgggaggtctaggcgagaggaaggcttgaggcctggagtttgagaccagcctggccaacataacaagacctcatctcytcaaaaaatttaaaaaccagccgggcatggtggtgcacacctgtagtcccagctacttgggaggctgaggtgggaggatcacttgagtccagcagttcaaggctgcagtgagctatgtttgcaccaccacactccagcctgrgtcacagaacaagacctcatctctaaaaaacaaacaaaaaccaaatccacatatcctaaaaaatgctccttttcagcattctcttctctatggacaaagggctggatgctttaagaaccaaatcttaggctgggcacggtggctcacgcctctaatcctagcactttgagaggccaaggcgggcagattgcctgagcacaggagttcgagaccagcctggccaacatggtgaaaccctgtytctgtcaaaaatacaaaaaattagccaggtgtgttggcgcrtgcctataatcccagctgctcrggaggatgaggttcaargaatcacttgaacccgggaggcagaggctgcagtgagctgagatcatgccactgcactccagcctgggtgacagagcaagactttgtctccaaaaaaaggaactagacrggttcatttaaacccctgactgcagccctttgacatacatccarttgaggactggggactccgggaaacatctaaaaggcttaaaaactttgtctaacttcagccgggcatggtggctcacacctgtaatcccagcactttgggaggctraggcaggtggatcacaaggtcaggagtttgagacgagcctgaccaacatggtgaaaccccgtctcyactaaaaatacaaaaattagccaggcatggtggcaggcgcctgtaatcccagctattygggaggctgaggcaggagaattgcttgaaccccggagayagaggttgcagcgagccgagatcgcgccactgcactccagcctggcaatagagtgagactccatctcaaaacaacaacaacaacaacaacaacaaaatcgtctaacttcctgatcttcctgatcattgattttcccataggtatgatcagcaacttgcttgggaaaggagccgtggaccagctgacacggctggtgctggtgaatgccctctacttcaacggccagtggaagactcccttccccgactccagcacccaccrccgcctcttccacaaatcagayggcagcactgtctctgtgcccatgatggctcagaccaacaagttcaactatagtaagtccaagagccccttccccacagcccacagcaactgcatctcattcctggggtctcccaaggaatacccaaaatgtcaccctctgagggaggaagaccacagggaatgctcccctttaagggaggagagaccctagaatatactccagctttgacaaagatttcccaagcaggagacatcaggataatgggaacagaagacaggaggtttatcccatgaaggatgaagaagctgaaatccagagattccctcagggccacatttgtccacctgactccagggtctcatcttcgtgtgttgctagtgtgattacctggggatgagaaatcctkctgggggagttgaggttaagaggatgaggactccaggtgctgtggctcacgcctgtaatcccagcactttgggaggccaaggcaggtggatcaggagtttgaggtcaggagtttgagaccagcctggccaacatggtgaaaccctgtctctactaaaaatgcaaaaattagccaggtgtggtggcaggcgcctgtaatcccagctactcgggaggctgaggcaggagaatcacttgagcccgggaggtggaggttgcagtgagccgaacgaaattgagccacttcaccccagcctgggcraaagagtgaaattccattcaaaaaaaaaaaaaaaaaaaaaggatgaggactgggatgaactggtggctgggtgtggggaaaatggaagtgaaggaaggccaaaagagacagagaaggcctggcgcggcgactcacgcctataatcccagcactttgggaggctgagaagggggattgcttgaggccagaagttgaataccagtctgggcagcatagcaagrccctgcctctacaaaaaaaaawttttttttaattagccaggcttgktgacatgcatctgtagtctactcaagaagctgaggtgagsccaggcayggtggctcacgcctgtattcccagcactttgggaggtcaaggcgggtggatgacctgaggtcaggagttcaagaccagcctggccaacatggtgaaaccccatctgtataaaaatacaaaaattagctgggcatgatagcaggtgcctgtaattccagctactcaggaggctgaggtgggagaatctattgaacccgggagggggaggttgcagtgagccgagatcatgccattgcactccagcctgggcgacagagtgagactccttctcaaaacaaacaaacraacaaamaaaatacagaagctgaggcgggaggaacatttgaacyrgattcggaggctgcagtgagctatgattgcaccactgygctccagtctgtgtgacagtgagaccctgtctcttacacacacacacacacacacacacayacaygcacacacacagagagagagaaattagaagatactgaattggcagaagagaagggaaatagaaattaaaatactgaataggggagcagtgaacaggggatacccaaaagccaagagcgagagagagcctggcttccagaaatagtggagaagccaggagaactaggtgaaaacccagtgctgggttgccatcagcragagctggagccatttccaacraaccatcttgtcgtcttcacagctgagttcaccacgcccgatggccattactacgacatcctggaactgccctaccacggggacamcctcagcatgttcattgctgccccttatgaaaaagaggtgcctctctctgccctcaccaacattctgagtgcccagctcatcagccactggaaaggcaacatgaccaggctgccccgcctcctggttctgcccaagtaagccaccccgctatctcccygacctaccaacccctctctcctggctccctaaagtcaccgcccccaggttgaatttcccagatctgtgaygcttgcaggacatgcatgtgtgggaggctgatgggaaactgtggcctgggtttgattatgagtcttgcaatcatccctccccctgtttctgctggagggcagggracagctcttcctgaccacacccccacattgactatccccagaatacccagcaaaagcccccaaaaggagagtcagagaaatgagggaggtgggggcccaatcagtccacatctacttagggtcgccccatcagcacttccatccccaaccctttcaagtcaacatccaaacaaaagaaatcacttccaaggacggagcagctcaaagcgcagcttctagctggggttccaagaaagcagatttttcgaaatccttctgcagaaggaagcaaagagattttttgaaatctttctgcagaaggagaaggctggagctggggaactccagaattatagggaagcctcccaccacgctcatcccaaatttccggatgctataatgccaggcttggggaaagaggagaatttagttggttagctggtgcgtgctctcacttgcatcctctctcttcctcttttttttttttctcctctctctctggctcataaaaatggaggtaattagttgtgccctggtgagaagcagagagtgcacaaaggccccctgcttgagtcctcttcagggttagctctcagaaacacaatctgcagaacagatttttgttccaacatccttgcaggagaatttgcccttagcttcccccaccccagccaggctgaataaaattatgctgaaactactgtcttatttgaggaaagtaattagtcataggtgggagggggtggggagattgcagaagaatgttcatgaatattaggattttcagctctaaggggggactttgtaaacagctttagaagaagaaccaggccggctgggtgtggtggctcatgcctgtaatctcagcatttggggaggccaaggcgggcggatcacttgaggtcaggagtttgagaccagcctggccaacatggtgaaaccctgtctctattaaaaatacaaaaattagccrgcygtggtagcgagcgcctatgatcccagctactccggaggctgaggccagagaatcacatgaacctgsgaggtsgaggctgcagtgagccgagatcacgccactgcactccagcctgggggacagagcaagaatctgtttcaaaaaaaaaaaaagaaaaataggaaggaaggaaggaaaggaaaggaaagaagagagagagaaagaaagagagagragaaagaaagaaagaaagaaagaaagaaagaaagaaagaaagaaagaaagaaagaaaaagaaaggaaagaargaacgaacgaaccaggcctccctctccaaccttcacctccgtccctattctggccacttgattcgggggacacctggtaggggatggggaaaggtgggagctgccagccagaggggaccccggcttgagcagcctcttgctgctatctgcaggttctccctggagactgaagtcgacctcaggaagcccctagagaacctgggaatgaccgacatgttcagacagtttcaggctgacttcacgagtctttcaggtaagaagactttcctttgcattttctcaccccagtggactgcgggggcccctaagaggaaaaaggaacctctccttgagagcggcagctgatctaatcctgtatccacatctgtttcagaccaagagcctctccacgtcgcgcaggcgctgcagaaagtgaagatcgaggtgaacgagagtggcacggtggcctcctcatccacaggtgagtctggctcaggtgaggctccacgggtgtcgcctccatcgcccttcaggataactggtccccagacccggaaaggaccccgcagccctctcggcacagagcagytctgtctgtgctcagccatcacccactccccacctgtttctcagcctggaaaaygggcttgggaccatggaaccctgtttcctcgcctgatggctcctaagttccctgactgtgaaaaggcctcctaaagaaaracccaagttgttcccacagtgggaagtaaacttaagaaacatgcttatcaggctgggcatggtggctcccacctgtaatcccagcgctttgggggaccaaggcaggtggatcacttgaggtcaggaattcgagaccagcctgggcaacatggcaaaaccctatctctactaaaaatacaaaaattaggcaggcgtggtggcatgtgcctgtagtcccagctacttgggaggctgaggcaggagaatcacttgaatccaggaggcagaggttgcagtgagccgagatcacgctgctgcactccagcctgggcaatagagcatgactctgaagaaaagaaagaaagaaagagagagagagagaaaagaaagaaagaaagaaagaaagaaagaaagaaagaaagaaagaaagaaagaaagaaagaaagagaaagaaagagaagaaaagaaaagaaagagcttatcaataagcccttaaaggatttagataaatgtgtgtaagggaagagctgatccattgctaccaagctcctggaggaaaccaggtctcagaggatgtccctaaacttttaaggttcatattcaggaaaacaaacaacttccagctgggcttagtggctcacwcctgtaatcccagcactttgggaggccgaggcaggaggatcgcttgagcccaggaatttgagaccagcctgggcaatataatgagactgtgtctctacaaaaattagaaaaaaattagccaggcatggtggcatgcacctgtagccccagttacttgggagactgaggtgggaggatcacttgagcccatgagttcaaggctgcagtgagccatgaaggtgccactgcactcccrcctgggcgacagagggagaccctgtctctaagaaaaacggcgggggtgggggtggtgccagtgccagcatccctctgttctaagacattgtcccttctcttgcagctgtcatagtctcagcccgcatggcccccgaggagatcatcatggacagacccttcctctttgtggtccggcacaaccccacaggtgagcctggaacccatcaygttccacatcctcccacccattctttctctcaggaactagtcccgacagatgcagacatccctctatccctgagagggctctgggcagggaacccataaccctaccctgcttcctgtcccaagaggaggctaccttctatcacccacagacagtgccgggtccccgctctgtgactcaggcagctgcgactccagacagctcactcatctgcctagatctcagtccttccacccacatccagcctgatgagctgtcccactccttctgcttctcaacccccatggttcttccaccctcaggaacagtccttttcatgggccaagtgatggaaccctgaccctggggaaagacgccttcatctgggacaaaactggagatgcatcgggaaagaagaaactccgaagaaaagaattttagtgttaatgactctttctgaaggaagagaagacatttgcctttygttaaaagatggtaaaccagatctgtctccaagaccttggcctytccttggaggacctttaggtcaaactccctagtctccacctgagaccctgggagagaagtttgaagcacaactcccttaaggtctccaaaccagacggtgacgcctgcgggaccatctggggcacctgcttccacccrtctctctgcccactcgggtctgcagacctggttcccactgaggccctttgcaggayggaactacggggcttacaggagcttttgtgtgcctggtagaaactatttctgttccagtcacattgccatcactcttgtactgcctgccaccgcggaggaggctggtgacaggccaaaggccagtggaagaaacaccctttcatctcagagtccactgtggcactggccacccctccccagtacaggggtgctgcaggtggcagagtgaatgtcccccatcatgtggcccaactctcctggcctggccatctccctccccagaaacagtgtgcatgggttattttggagtgtaggtgacttgtttactcattgaagcagatttytgctyccttttwtttttataggaatagaggaagaaakgtcagatgcgtgcccagctcttmaccccccaatctcttggtggggaggggtgtacctaaatatttatcatatccttgcccttgagtgcttgttagagagaaagagaacyacyaaggaaaataatattatttaaactcgctcctagtgtttctttgtggtctgtgtcaccrtatctcaggaagtccagccacttgactggcacacacccctccggacatccagcgtgacggagcccacactgccaccttgtggccgcctgagaccctcgcgccccccgcgccccccgcgcccctctttttccccttgatggaaattgaccatacaatttcatcctccttcaggggatcaaaaggacggagtggggggacagagactcagatgaggacagagtggtttccaatgtgttcaatagatttaggagcagaaatgcaaggggctgcatgacctaccaggacagaactttccccaattayagggtgactcacagccgcattggtgactcacttcaatgtgtcawttccggctgctgtgtgtgagcagtggacacgtgaggggggggtgggtgagagagacaggcagctcggattcaactaccttagataatatttctgaaaacctaccagccagagggtagggcacaaagayggatgtaatgcactttgggaggccaaggcgggaggattgcttgagcccaggagttcaagaccagcctgggcaacataccaagacccccgtytctttaaaaatatatatattttaaatatacttaaatatatatttctaatatctttaaatatatatatatattttaaagaccaatttatgggagaattgcacacagatgtgaaatgaatgtaatctaatagaagcctaatcagcccaccatgttctccactgaaaaatcctctttctttggggtttttctttctttcttttttgattttgcactggacggtgacgtcagccatgtacaggatccacaggggtggtgtcaaatgctattgaaattgtgttgaattgtatrctttttcacttttgataaataaacatgtaaaaatgtttcaaaaaaataataaaataaataaatacgaagaatatgtcaggacagtcactgccttcaccttctccatttcacaccggtggtacaagaaatcagaagcctaggccaggtgtggtggttcatgcctgtaatcccagcactttgggaagccgaggtgggtggatcacctaaggtcaggagtttgagaccagcctggacaacatggtgaaaccccgtctctactaaaaatacaaaaattagccgggcgtggtggctggcgcctgtaatcccagctactcgggaggctgaggcaggagaatcacttgaagccaggaggcagaggttgcagtgagctgagattgcaccactgaactccaggctgggtggcagagcgagactccctctcaaaaaacaacaactacaaagacaacaacaaacccagaatcaaaatcctgttggtccatagacctcatgggtggaagagaccttcctacatccaggttggcccaacatgggggagtccatgaaatggtcacctcagctctgccacaagccccaaggataagttgattctgcccctgggaatcatcctcaaaaaggaaaaaaatgttcccctgccataaactttccacttatgcagatgggcctgctcgtaagtcactgtcactgtgggttcccaactctgttcatgacacttccttccagcaccaaatgcttcccacccctctactcccactccccattcttcaaacccagctcaagttccagttcctccacctaggacttcccatggatccagccaatatcactctcaggtccggcgcagtggcccacgcctgtaatctcagcactttgggaggccggggcaggaagattgcttgaggccaggagtttcagaccagcctggacaacatagtgagactcttcctctaagaaaagaaagagagaaagagagagagaaagacagaggaaagagagagaaaaataaagaaagagaaagagagaaagaaagaaagaaaaagaaaaagaaagaaagaacgaaagaaagaacgaaagaaagaaagaaagaaagaaagaaagaaagaaagaaagaaagaaagaaagaaagaaaagaaaggaaggaaggaaggaaggaaaggagggagggagggagggaaggaaggaaggaaggaaggaaggggatcaaaacatcatcactctcaactcgacactgactgagttttcttctccctggtctgtaacagtgcttggattctcgagtgttctttagctttgtgtgtgtgtgtcttaccctccccaagcccatcaaggtatcaggtttcttgaaaacaaggctctcttgttatatatactctagcatcttcttgaaaatggcttcctgaaaagtcttttattatctttctccagcatctcgaaggcttttggcagagggcacacttccctccattagtttctgttcaaatattcaaaaataattttttaaactgaaaaaagaccaataaccatctgttgaacttgtatactgtctaactccagaaccctgaagataggattcagagatgcagccccctgaacacccagctcatttctattgctttttaaacaattttttgtagagacggggttgcaccatgttttgaacttttgggctcaaacaatcctcctgcctcggcctcccaaattgctgggattacagttgtgagccaccatgcccagcttggctcaggtgtacctttcaacctccttataccctgaaagtatgactaattccaggccccaggctagtggctgaaaagttacctgtctctaacagatttgcttggaaagctaaacagcctctttttgcacaaaatgcttcaaaaagcagaacaaattagccctaactctgcagtatacagttcaaaaactgctcatccatgctgagatggctctagaggaaaaagagttcttcaaaaagccccctyaccacagaggaggcttgttccaggaaatgccccatttaacagactctcagctattgtgaggacaaaaatgatgtagactcacagcacgagacctgcccagccctgtttgactttgcctggccctgtcccttgcctgttctaagtttgtcttcccttctctatttttttttttcttttaagacagggtctcgctttgttgctgaggcaaaagtgcagtggcacaatcttagcttattacagcctccatctcctgggcccaaagccatcctcgcacctcagcctcccgagtagctgggaccacaggtgtgcgccgccaagccctgctaatatttgcattttttggagagatggtgtctcactatattgcccaggctggtctcgaattcctaggctcaagcaatccacctgtctcggcctcccaaagtactgtgatcacaaagtgctgggccaccatgcctggcccgctgttctttagggatgaaaaattaacaagatctgcctccagctaccgttattgtacatttcttgtaaacctcaaacagtggaattatttatctgctcatctgtgggcaaagagtatgaatgttgtaaatcccttaatggtaaaaatattcagtcaaaagcaaatttgtcaaggagacaccatctttttttgaaatcatttttttaggtggtttctcaagtaagctttgttgaaataatagtagcaagcggctgggcgtggtggctcaggcctgtaatcccagcactttaggaggccaaggtgggcggatcacctgaggtcaggagtttgagaccagcctggccaacaaggtgaaaccctgtctctactaaaaatacaaaaattaggccgggtgtggtggctcacacctgtaatcccagcactttgggaggccaaggcgggtggatcacgaggtcaggagttcaagaccagcctggccaggttggtgaaaccccgtctccactaaaaacacacaaaaaattaacgaggcgcagtggcgggcgcctgtagtcccagctactcaggaggctgaggcaggagaatggcgtgaaaccaggaggcagagcttgcaacgagccgagatcacgccactggactccagcctgggcaacagagtgagactccgtctcaaaaaaaaaaaaaaaaaaaaaagtagcaagcactcaggaaaactgagacacagagaggttgagtaacttgatctcattattatcattattttagagagggggtctctgttgtttaggctggagtgcagtggtgcaatcacagctcactgcagccttgaactgctgggctcaaacaatcctgtctcagcctcccaagcagctgggactacaggtgcgcaccactcactacccagctaattcgttttctttcttttttttttttttttaaaaaaaagtctcgctctgtcacccatgctggaatgcaatggcttgatctctctgctcactacaacctccgcctcccgggttcaagagattctcctttctcagcctcctgagtagctgggattacaggcatgtgccaccatgcccggttaatttttgtatttttagtagagatagggttttgccatgttggccaggctggtctcgagcttctgacctcaggtaatccacctgcctcagcctcccaaagtgctgagattacaggtgtgagccactgcacctggccccagctaattttttaattgtattttttgtagacacagggtctcactatgttgtccaagctggtctcgaactcctgggctcagcctcccaaagtgctgggattacaggcgtgagccactgcacccggccccagctaattttttaattttattttttgtagagacagggtctcactatgttgttcaagctggtcttgaactctggggctcagcctcccaaagtgctgggattacaagcatgagctactgtgcccagctgctgctatcatcattattacttaacagccacaggcagttgggcaccctgtgttccctgcctctacaccatattgcctctctctgtggcacgtgtgaacaggaacaggtctcccgaaacaccaagaagggctcagacgtaggcaagacgcggtggcgaatcacttgaggtcagtagtttgagaccagcctggccaacatggtacaatcccatctccattaaaaatacaaaaaaaaaaaaaaaaaaatagctgggcattgtggcgcacaactgtggtcccagctgctcaagaggctgaggcaggagaatcatttgaatccaggagacggaggctgcagtgaactgagatcgcaccactgcactccagcctgggcgatagagcaagacatcaagagagagagaaaaaaggaaagaatgaaagaaagagagaaagaaagaaagaaagaaagaaagaaagaaagaaagaaagaaagaaagaaagaaagaaagaaagaaagggaaaggaagggaaaggaaagggaaaggaaagaaaagaaagaaaatgaagagaaggaagggaaggaagggaaagaagaaagaagggaaagaaataaagaagagaaagaaagagagaaaagaagggctcagacgtggtcgagtataaaggtgctggccaggcagtggctcatgcctgtaattcgagcactttggaaggccgaggcaagtgaatcacctgagtccaggagttcgagaccagcctgggcaacatggcaaaacctcgtctccacaaaaaaaaatacaaaaatgagctgggcgtggtggcgggcgccagtagtcccagctactttggaggctgaggtgggaggattgcctgagccaaggaggtcgaggttgcagtgagccaagatcacgccactacactccagcctggggtgacagagcaagaccccggctcaaaaaaaaaaaaaaaaaagtgctgccctcacgtgccagtcatcagcagcttctgtgttgccaccagccgcggggccagcctgaacacttgcttcctgaaccaggtctttgatctcctcgccaccagaggtcgctttcgctccagtggaaagctcttccctgaagcaaagcagctgtggcttccaccaaaatcttgccaagttggaactccattcaatttaacgagtatttatttaaaagctgacctttagactgggtactgtgaagcattaaaaagaaagtgtcagctattcttaatagcagatatctaatgacaagggacatcaaaaagctggggaaaaaaagctatgctgaccaggtgcagtggctcatgcctgtaatcccaacattttgagaggccaaggtgggaggatcacttgaggcagccaggagtttgggaccagcctggacaacatggcgaaacactcaactaaaaataaaaaaacttagccaggcgtggtggtgcatgccagttactctggaggctgaggccggaggatcacttgagccctgggaagtcgaggctgcagtaagctgtgattgcaccactacattcaagccggggcaacaaagtgagaccctgtcttgaaaaagaaaaaagaaaagaaaaggaagaaaagctatgcaagtcactgcaaaaataatggaaaggaacactgtataaatgatcgctatagtctgaaatagagtgtagactcatcagaggaggggctgtttgaaaccataaaggataggctgggcgcggtggctcacgcctgtaatcccagcactttgggaggccgaggcgggcagatcacgaggtcaggagatcgaaaccatcctggctaacacggtgaaaccccgtctctactacaaatacaaaaaattagccgggcgtggtggcgggcgcctgtagtcccagctactcaggaggctgaggcaggaggatggcgtgaacccgggaggcggagcttgcagtgagccgagattgtgccactgctctccaacctgggcgacacagcgagactccttctcaaaaaaaaaaaaaaaaaaaaaaagaaaccataaaggataaatcagatgggtttggggtctatagggagggaatggcagggcattccagaaaacagcatgaacaaaatcacgaaggaaaacgtatagcagggcagatgcaagggacacgtgagaatgaactctcagatctccagctggtttcagc

SEQ ID NO: 17588 - DNA, 30145 bp, Homo sapiens
tgcgtccgtgtgtgagtgtgactgtgagtgtgtgggtctgagtgtgaaagtgtgtgactgtgagtgtgtgagtgtgtgggtgtgactgtgagtgtgtgtgggtctgtatgagtgtgagcgtgaccgtgtgtgtgtaggtccatgagtgtgagactgtgagtgtatgggactgtgagtgtaagagtgtgggagtgtgtgggtgggtgtgtgaatgtgagtgttgtgagtgtgaaagtgaggtgtgtgggtgagagtttgggtataggtatgtcagtgtgtgaggatgagtgtgagtgtgagagtatgtgggtacgtgaacgatttttttttttttctgagactaagtctcactctgtcgcccaggctggagtgcagcggtgcgatctcagctcactgtaacatctgcctcccaggttcaagcaattctcctgcctcagcctcctgagtagctaggactacaggcgtgcaccatcatgcctggctaatttttttgtatttttagtttcaccatgttggccaggctggtctcagactcctgacctcgcgctctgcccgcctcggcttcccaaagtgctgggattacaggcgtgagccactgtgcccagccatgaatgtgttttgtgtgaatgtgactgtatgggaatgagtgtgggtgcgttgtgagaatgagtatgtgtgtgagtgtgtgcgtgtgtgcaggcgcacacacagccacaccaggccctggtgctgcccctcaatcttcacattctcctggggctctatcttcaacaggaggccattgggctgtgaggtcactcggggtgtgtcctgagtgcccagcacagcgtctgcctcctgtttcctttctccctctgattctctgatgtcacccagatcctccagaacctttcaaagggaaatcagaattttacacttaatgaaatgagaatagaaaatgcaagcagcagggctgggcgtggtggctcacgcctggaatcccagcactttaggaggccaaagcgggtggatcatttgaggtcaggagttcgagaccagcctggccaacatggtaaaaccccatctctactaaaaatacaaaaattagtcgggcgtggtggtgcgcgtctgtagtcccagctactcaggaggctgaggtaggagaattgcttgaactggggagacagaggttgcagtgagccgtgatcaccccactgcactccagcctgggcgacagagcggggctcccaagaaagagagagagagaggaatggcaagcagcagggaatctgagctatgtcaccctctgcctgttgctgacccgacccaaaagcaactttcacagcagagagaaacttcctgaaccccacgcctcggggcagtccttggggtgatctagctctgtgagcatcctcttgctccttgacttccattttctcgaactgaaagatcaggtgagacgcgttagcaggtgacatcatggaagatcaagcagggaatgtccggggaaatcatgaccttgtggtcactgatgtcattgggaaccgctgggcatgaatagggaatgaggattcctctcaggttctcggcctggcccctccctgacccatggcctctcctcacaggtgctggctgcaggattcaacctcccggaggaggaggaggaggaagaggaggaggaggaggaggagaggaaggggctgctcccaggggcactgggcagcgccttacagggcccggcccaggtgtcctggccccagctcctctccacctaccgcctgctgcactccttggagctcgtcttatctcgggccgtgcgggagttgctgctgctgtccaaggctgggcactcagtctggcccttggggttcccaacattgagcccccagccctgatcggtggcttcttagccccctgccccccaccctttagaactttaggactggagtcttggcatcagggcagccttcgcatcatcagccttggacaagggagggctcttccagccccctgccccaggctctacccagtaactgaaagcccctctggtcctcgccagctatttatttcttggatatttatttattgtttagggagatgatggtttatttattgtcttggggcccgatggtcctcctcgggccaagcccccatgctgggtgcccaataaagcactctcatccacccctggcctccgcttctcttcgggtaagggctgtctgacacccagagggcagggcagcctggaacggggtcagcaacctctagccatcctgaacccctctctgctcctacatttttggggtctctggcccaccttcccctactatgtcctgctccggcaggcagttgccatagtaaccagcagcatcctgaggccgagctaccgtgttggaagctcaaggcagctcatctctgattctgaacagtgctccttaagccctcccaaccgccttcctttggcctggatgcagctccagaggtttgtgttatccccgcccagttctgagggtcttggtgcagggagttgggctgggaagtgggagttagagaggaaggcctgtaaggaaaatggtcgctgttccctcagtcttccttgcagtctttattgttttattttgtttttaaaagatggggatcttgctatgctgcccaggctggtctcgaactcctggtctcaagcgatcctcccaccttggcctcccaaagctctggggtgacaggcgtgagcccccgtgcccagcctccttgcagtccagacagctgactcaggctggggaggaaccagggcaggcaccctgagaggtggtctcagtggggtaggtggtccaccagcctgtgtcggagaatcagactccttaagttcacggtcttcccagacgtctggttttgcctgctccatgaatgatacatcaagacactgaggcccagagggtggagaggatgtgtccacagtggcagagggagcagggctcagtggcattggagcaagccttctggcacccactcagggcctggctcccagagcaccgggtctcagtcactggggcttaggccggcccagacgggcttgcagctcctgcatcatgccagggtgcgcgaggccaaacctggaggcggaagtcaggcccgtgagaacaggttcccaggtgcccgcggtctcttccccaccccagctgagttgccctgtgcctacccgtgtcccaggggccttctcctggctggcaccggggtcccatcatgcctcagagggcttggctccaggggttcctccagctggaggggtctctgctcaggagctgacagctcctcctcaggagggttgggggctgggggctcctcctgctgctcccaggccggagtccgacgaaaagagggccgggagcgacgctgtgaggagcttctcgagaggtgcacgcgactccttgggacagagacgtctaggagggacccggggagcggggcctgcaggaaagggggcacagaggaccatggggccggcttcgggattccactcgttccccccgagaccccaccaagagccctcacctcgctccagctgttggcagcacctcctctggcactgcccatggcctcagccgtctcggcttccccgactgactccggcgcagcttctgcaggggcctggtgtgttggctgctcctcctggcccctgacatgttccaggctttctggctcagtctccttggcctctgccctccggcccccggtcaccatgagaccctctgcatcaaggagccttggtgcctctccctcagggtggtagtccccacaccgcccctcactgtcttccctctgttctctctcctgccatccaacagcctcttcttccaacagcgtccacttttctagaagccccccagcctccaccatggctcccatcccctctgccctcgctgtctgggagcccgcgggatccagcccacagctgtcctctgcgcctgcagattcctcggcctctacccgccctccccaaggtcctccctccctggactcaaaagcctctacttggctgcctctgccagtcacctcttcctctgctgagccctccagaccaaattcttgcccacctgcatgctctcctgctgctgcctcttccttttctttcgagtcccagccttgcccaagcgccccttccaaagcttcaccagcgccagcagcgctgatgtgtgggaccacatcaccccccataatcccagcagccacagagccagtctgtgcatcctcacggtccgggaggcccacagccaccgcttgcagcctccagcctcttctggatgttctgtcagcctccgcctcctcatcctcagtttctctggcataggcctctcccagtgacgggcaaggccctgcgtctgcccctgtgcttccgtccagctcctggttctctgagacagatgcctctccctcctcagttccacatcccgcgtcctgggttgtcagcccctccccgcctgcctctgggacttctgatagttcagactctcggtctccttcagcctcagccgccagggtctggcctcccgcagtctcctcctcctcccgctgctcgccatcggccgcatcctcctgagtatttcctctctccatgtcctttctcgtgcggttttcccaggctcctgggaaggcctcggaggcctcaggctttacagaccccgcgtgcctgggacctgcctccaggctcctctcctgctcctctttgctcagggccagaactcccatgagctccacctcccctgcctccctttcctcgggttgcttagttggggtctgggcgccccccatcagctcaggtccttggcctttggtgacgctgtgtgtgaggccaccccattccacgcccagtaggccacagctagtctgggccgcctcactctcctcccctgtgagctcctcctcaggcctggcctctggagttgcctccaagtcggcagtgccttcagcctctccatctgagggcagctcagccactggatccctgctgctccctctctcctcctgggcctcctctgcctgtaccagctcttccatcctggcccggtcggccctgatccccaagtcctgcctcatctcagcctccttaccacgcaggtctacctggccctcaaagctctcccctgcctcctggcctcccacagcttccctccctgcggtctggctctcagcagcctcttctgttctttcagtgcccaggacctggggctgtttggggaaagggctcacctcagcctctctctcctcatccccctcctcctctaggacccagacttttccagtagcctctaggagcctttctcctgggactgctccatattctgtctgtctgactcccagcaggtcagcctcctctttgcctgaggttgtccaggcctcgtcccctcctgaggctgtcccggcctcctcccctcctgaggctgtcccggcctcctcccctcctgaggctgtcccagcctccccgcctgaggctatcccggcctcctcccctcccgaggctgtcccggcctcctccccgcctgaggctgtttcagcctcctccccgcctgaggctgtctcagcctcctccccgcctgagattgtcctggcttcctccccatctaaaattgccctggcctcttccctacctggggttgtcctggcctcctctctgcctaagattccccagtcctcaggctctgcccctgggccccacgtcccccatgccctagtgctttcacaggccttctccaccactaccacctcttctcctttcccagccccttcggccccaggctcctcagtttcccctgcatctgcctccctgaccccctgctccatctcccggttgtcccctgccgcctttggcccaacagcaccagccttcccctccgtctccccatgccaggtccactctgactccgcccctctggccatccctggctctcttgccctgacctcttcctcctcctcctcctgttcccagcttctcagcctctcttctctgttcacttcctgctcatgggactcctgcctctcctgggcttggccgctcctgtcttggcaagccccagaccctgccttggatttctttctggcctccaagtgggcgcttggctcctggcacctggcagccttggctgtctccccagccccactgtcctgcctctctgcttgggacccatgggagctgccatctccccagccccaggtctgttctacagctgagctccccacttcatgtcttctgtcatctccaggycctctcagccttccagccccctcgttttggctgcctctaaggccctccaggtcctcctgggcttcckcctctacaatcttccctgtctttcccaccgccaccacccccagttcctcagccgcctgcgcctcccgctctacagtggggactgcatctcccaggaggtaggagacaaaggtgccragggaatcctaggaaaaaagagagagagaggggagagtcattgaggagagtcccagccctttccctgggggccctggctggaggagcccaggttaaggaagagggtactgggatctgaaaggagaagaagaggatttgcagaaggagccagaaggggcatcgattaggggtacgaggacgcatggttggaggtggggactgaaattcagaaaatattaggccaggagtctgcctgaacctgagaaagcaatctccagtttgaggagatcagaaggaggaggggaaaggtgaggccccaggggaggtgcccggaagtgaggccccagggaatggggtgcaagtatctggcagctgtctgcccttctcaccagtgcccccctcaaggcctggtgcagcccagggaggtatagccggaggaagtccatcctgtctgtctctgtctgtgtgtccagaaagctgataatgaccgtccccacccaccaagacaagccaaccttccccaggaccaaaggcacttcctcttcccctgtctccctgatgcgtccccaccccaggccctgcccacggcccctgatgcccacagtagcccccactgcagcccgggaaatgggtgtacatcacacaggggactcaggtgcacatttggaaataaaggacaagcaagaggccagaaaggacaaagtgggagcaggagaccttagaactggggagggggagagggaggrgacatgtggcaacagcagctcaagtgactcaggtctcgtatcsgcacctcagccatttctgcctcccctacaagccacagccactctgcaagaggaagctggggtttgtggttcctgttttgcctgggaagaaagagtagcagtgaagagggggctggtgggagctctgacacatttcggcgtcattaatgcttcccccaggggcrgaagrggccggattggtggctctggggtgcatcccctcacctatgattaggcttgcaaaaaagaacttggctaaactttatattgtggatatctgtgtctgcctcccaccttcctgtgacttccttgatggcagatgccatgtatgaaacgctgctgaatttctagagccctgcacgttagtaggattccattttccatcagctgagtgacctgggaggcacactagagagggcacatttcttttcttttcttttctttttttttttgagacagtctcactctgtcacccaggctggagtgtagtggcgcagtctcagctcactgcaacctctgcctcctgggttcaagtgattctcctgcctcagcctcccgagtagctgggattacaggtgcgtgccaccacacctggttaatttttgtatctttagtagagacagggtttcaccatgttagccaggctggtttcgaactcctgacctcaggtgatctgcccaccttggcctcccaaagtgctgggatgacaggcatgagccaccacacccagacgagagggcacatttccaactgcattctgaaggcctggtggtgagaaagagcatatagaggtggcacagcccatagcagagatgaggccaaggacaagaagagaatgcaggatgccgctttccacctagaagaaggtaagggtatgattccttatttggaactacataaagtgaccttgctctacttctcttccccataccctccttctcccctccccagccccactttcctattccaattagggcaattctatgaaatcacagcatcagaatcttaggccttaaaatcatttagtctggccaggtgcagtggctcacgcctgtagtcctagcactttgggaagccaaggcaggtggattgcttgagctcaggagtttgaggccaccctgggcaacgtggcaaaatccagtctctacaaaaaacacaaaaattagctgggcacagtggtgcgcacctgctgtcccagctactcgggaggctgaggtgggaggatcacctgagcctgggaggtcaaggttgcagcaaaccaagatcctgccactgcactccagcctgggcaacagagcaaaaccctgtcaaaaaaaaaaaaaaatctggtctaagcaccacctttgatggaggcaggaatcytgcagcagcctggagccaacccaatggctccctgcctctggtgctctatttcttatcaccatacaggtctctaaggtcacctttaggtctaacattgtatgaatgattgtcagcaactttccaatttttttcatatayatatattttttttattttattttttactttttctttttttgagacaggatctcactctgtcacccaggctggagtgcagtggcgtgatcatagctcactgtagcttcaacctcctgggcacaagtgatcctcccacctcagcttccaaggtacctgtgactacaggaatgcgccaccatgcccggctaattttgttwtatatatatatatatatatttgtaccttggttttctcatctgtaacaccaggggttgaagtsctgtgatattttttggttctaggataatttggaaatagggatctcttaacatcttggatmctgccaatagatcattcmcgaaatccctttagatgagtgttatgtttacttaggtctctaaaacaatttgtaaggtcaacagatggggataagaatgacctgaagctggtcgtctttgttcscaaccagaaacagtcctgccycmaaaaaaaaaaaaaaaaaaagggagtaggcaggtggccatatttgtttctggcaagtgagtgctgaaggaaaggagctgaagcctcccacagtcataactggtgctggcaggctactgtctcggtcttgggcgccactgatctaaggtcacggctctgcttgctgctcccacccgctccagtttaaaacctgcggttccagggttctccagcccctccctttttcacgctccgaagccgagaaggcccaaagcgaagacagagaggacccggaagtagggaaaacctctgagcacgtgatgggggaacacgcgggtgctgtcacgtgatccgacaaacggcctctgcatagtgcagaacattctgctgctcttaaaggtacaggcctcagggtccctgctgtagacggggcgggggagagtacgatgggtggggcgtggtgggtcgtagggcgctcgagatggagcccccagcttccttgatggatcgcggggcgcgagtgccctagacaagccggagctgggaccggcaatcgggcgttgatccttgtcacctgtcgcagaccctcatccctcccgtgggagccccctttggacactctatgaccctggaccctcgggggacctgaacttgatgcgatgggaggctgtgcaggctcgcggcggcgcttttcggattccgagggtgagtattcccgcccaccctcatggaacgaccacctctggctcgcagcccacctgaggggartgagagctgactcggccccgggaggacacgsaaggagcggtcgtgcacctgagagtaggtgggggtcatgccctcttctcgctctcccaggggaggagaccgtcccggagccccggctccctctgttggaccatcagggcgcgcattggaagaacgcggtgggcttctggtgagtggcctgagacttcagcgagtgacaatggcatgagaagagggaagtgaccggaggaaagggggaagaaagagttaagctgcgcaaaggagctgaacccacaaatatttactgaatccactggtttgccccaggggcagcatgtaaaatttccaaacttcactccttatcaccttccggatttagcaagatcctcatacctaccacctgtaggattatttacttttttcttccagccaattcagccttaacgttttttagtgcacatatttttaaaaagaaaactttaaatcacgactccacttggaaaaccagcgttttcctagtgaacgtttaaataaatgcatcactactaaaacttttttatttttttaatttattttattttatcttatttttttttctttttgagacagggtcttgctctgtttcccaggttggaatgcagtagtgcaatcacagctccctgcagcctggaactcctgggctcaagtgattctcccacctcagcctccaagtaggtgtggctacaggtgtgcaccaccgcatctgcctaatttttatatttttttatagagatgggggtctcrctatgggacctgggctggtctcaaactcgtggcctcaagtgatcctcctacctcaaccttccaaagtgctgagattacaagcatgagccaccatgccgggcctgaaccttttttttttttttttttttkgagacggagtctctctctgtcctccaggctggagtgcagtggcgcaatctcggctcactgcaaactccgcctcccaggttcacaccattcttttgcctcagcctccggagtagctgagactacaggcgcctgccaccacgcccggctatttttttgtatttttagtagagatggggtttcaccgcgttatccaggatggtctcgatctcctgacctcgtgatccgcccgcctcggcctcccaaagtgctgggattacaggtgtgagccaccgcgcccagcttttttttttttttttttwaattttattttatttttgagacagagtctcactctatcacccaggctggagagcagtggcacaatctcggctcactgaaacctccacctccaaggttcaagctattctcctgtctcagctccccgagtagctgggattacaggtgcgtgccaccagacacagctaattttttgtatttttagtaaagacaggatttcaccatgttggtcaggctggtctagaactcctgaccttaggtgatccgcttgcctccacttcccaaagtgctgggattacrggcgtgagccaccgtgccccgccctgacataggggctttgggatcacagacttggattcacttccagcctccaaggcctctcccagaaactctctgtgaccactctccttttttttttttttttttgagatagagtctcgctcttgtagcccaggctggagtgcaatggcacaatctcggcttactgcaacctccgcctttcgggttcaagtggttctcctgcctcagcctcctgagtagctaggattacaggcatgtgcaacttcgcccagctaattttgtattttttagtagagacggggtttctccatattgctcaggctggtctcgaactcctgacctcaggcgatccgcccgcctcggcccctcaaagtgctggaattacaggtgtgagccactgcactcggcctcttcctttttattttttatttttgtgacagggtcttgctctgtcacccaggctagagtgcagtggcatgatcacagttcactgcagcctctgactcctggactcaagcaatcctcccacctcagcctcccaagtagctgggactacagtgcaagccaccacacctggctaatttttaaattttttgtagagatgggggtctcactatcttgcccaagcaccaaagcctgtatttttgaccccaacattgaatgaggatgggatctggtgatagagggaaaaaaaagagggggctgattgaagggcacaggtaagggaaggtttggcacaaaggctacagatggctgcaggatgaggagggagttgagacctgtcctgctccttccaggctgctgggcctttgcaacaacttctcttatgtggtgatgctgagtgccgcccacgacatccttagccacaagaggacatcgggaaaccagagccatgtaagtgactctctaccaccaccaccatggttagtccctgtgggaagatgagggggtgggacaaggtggggtaaagtttccagtctctggctgggcacagtggctcacacctgtaatcccagcagtttgggaggctgaggcgggcggatcacttgaagtcaggagttcgagaccagcctggccaacatggtgaaactccgactctactaaaaatacaaaaactacctgggtgtggtggcacacacctgtagtctgagctattcaggaggctgaggcaggagaattgcttgaagccaggaggtggaagttgcaatgagccaagatcacaccactgcactctagcttgggcaacagagtgagacaccatctcaaaaaaaagaaagctcttgaatgtgttatctaaacaaagtccatttacagggccatctgtggcctgtggtctagtagtgtgagactcatatggaaaccccctcttcattgtgcatgcagagacgctgaggtcctgagaagtcagtcactgctgacccaaagccatccttcaagtgaaggcagagctgggacgggagccaggctctgtgtgtctatccctctgcctccagggtgaaagacatgcttttctcccattaggtggacccaggcccaacgccgatcccccacaacagctcatcacgatttgactgcaactctgtctctacggctgtgcgtactcatctcacctggtccttgcctgacccagggcccctgggtctatagaccccactcccagcccttcactacccagctgggactgtcatgattaaaacagttgagacctgggctgggcgcactggctcacacttgtaatcccagcactttgggagaccaaggtgggaggatcacttgagcctaggagtttgagaccagcctgggcagtatagtgagacccccatcttaargaaaaaaattaaaaaawatatatatatawaataattgagaccttaatataatttctgaggctgaggcggatggatcacttgagaccaggagttcaagaccagcctggccaacatggtgaaaccccatctgtactaaaaatacaaaaattagccaggcatggtggtgcrcgcctgtaatcccagctactcaggaggctgaggcaggagaatcacttgaacccaggaggtggaggttgtagtgagccaagatcgagccactacactccagcctgggtggcagaatgagactcactctcaaaatatatatatatatagtttctgagtcctttctgtctgcaccatatattagctcatttaagccacacagcagtcctgtgagctaggygctatgatattcccattttccagatgaggaaactgaagctcagagagtataaactcttgacacacaactaaggagtgggagagctgagacttgaacccaggygtgcctgactccagagcctgtgtttgtagcaggcctgtttggccagctcctgcctctccttggccacgtggttgggagggttgtcccctggaagctctgcggtctcactctattctcctgtcccaggctgtgcycctggcggacatcctccccacactcgtcatcaaattgttggctcctcttggccttcacctgctgccctacaggtctgggtgagggtagtgggaggcagggtgggcaggagctgagaaaggggaggctgggatggctgagatgctgagagtagagaccgaccttccccctcccttcccttctcaccccctcagcccccgggttctcgtcagtgggatttgtgctgctggaagcttcgtcctggttgccttttctcattctgtggggaccagcctgtgtggtgagtgtgtggttctgtgtcagatggggagccccgaggaaccacatcagagcatttgtgggaagagtctccccagcctcccagaggaaagggattcattctgtcacccttagaagcctgctagggctatcagcagtaggcgatgggagactgggacaatttggaggggtaggcagtggaggagatgggagaaaatggatgamttagatggagattgaggtgaacaaagtcaagactctgtgatggaccagscacagtgactcatgcctataatcccagcactttggaaagccawggcaggcagatcacctgaggtcaggagttcgaaaccagcctggccaacatggagaaaccccgtctctaccaaaaatacaaaaatyagctgggtgtggtggcaggagcctgtaatcccagctactcgggaggctgaggcaggagaatctcttgaacctgggaggcagaggttgcagtgagccgagatcacgccactgtactccagcctgggtgacagggcgagactccgtctccaaaaagaaaagaaaagaaaaagactgatgaaggggcagagacatcaagggtgcatgtctgcccctggtctgataactgggtggatggaggtgccactctccatgaagggacacgcaggggagtggggctctgcttcagacctggaacctggcctatgcatgggatctattggagcctctatgagctgatactgaggaggccatggccagacacattagaggcctgggcagtgtggcaaggtgtggtgtgaccatcccagtgcttgtcctccccccaggtgtggtcttcgctagcatctsatcaggccttggggaggtcaccttccyctccctcactgccttctaccccaggtaagcaggtggagcagggagtgtggggagaggctgtcccatggtcagcctaggtcctcctgaatgttcctgtgttctccttcccagggccgtgatctcctggtggtcctcagggactgggggagctgggctgctgggggccctgtcctamctgggcctcacccaggccggcctctcccctcagyagaccctgctgtccatgctgggtatccctgccctgctgctggccaggtgagctgccctgagccgggagggagaggggtccaaggagagaaaacttggccatggctgggtgtggtggctcacgcctgtaatcccagcactttgggaggccaaggagggcagatcgcctaaggtcaggaaaccagcctggccaacatggtgaaaccccgtctctactaaaaatacaacaattagccaggtgtggtggcgggtgcctgtagtcccaactactcaggaggctaaggcaggagaatcgcttgaaccccggaggcagtggtggcagtgagccgagatcgtgccattgcactccagcccgggcgacagagttagactctgtctcaggaagaaaaaaaaaaaaagaaagaaaagaaaacttgattatgattgcaatcttcaagtccctaccttgctgtgaagggaggcggaatctggactctgatagccccaggtgtgagtcctggagctgccactttttagctttgtagcgttgaacaagttactccacctctctgaaccctcagtttccccatatctcaaatggcagttgttcttgctttccttggaggtgatgagggtaatgcattcagcacagtgtggttcccaaggtgattagaagtwggatgagggtggacyttawttgattagttccttttttttttttttttttttttaatcagtgttgaccaggttggcctcgaatgtgtarccttgcctgcctgagtgccagggcaacaggcctgaaccatggcgactccyttttttttttttttttttttttttttttgagacggagtctcatggtgtcactcaggctggagtgcagtgactggtgtgatctcagctcactgcagcctcggcctcccgggctctagtgattctcctgcctcagcctcccgagtagctgggactacaggcccatgccaccatgcctggctaattttttatatttttagtagagacggggtttcrctgtattggccaggctggtctcaaactcctgacctcaagtgatccrcctgcctyggcctcccataatgctaggaatacaggcgtgagccaccgcgcccggcctgattagttctgtgtattttcatgcatattacaaaacactttggccgggcatggtggctcacatctgtaatcccagcactttgggaggccgaggcgggcgcaccacgaggtcaggagtttgagaccagcctggccaatatggtgaaaccccgtctctactaaaaatacaaaaattagccaggcttggtggcgcttgcctgtagtcccagctacttgggaggctgaggagaagaatcgcttgaacccaggaggcagaggttgcagtgagccgtgattgtgccactgcactccaggctgggcaacagagcgagactccgtytaaaaaaaaaaaaaacacacactttgaactagccagacacacctggcccttcacaagattagtgcttaggacaagtctaagtagaaaaagtgagtccatttaaagaaaaatattaagtaaaaatatatatatacaggaggaatatggatatggcaaataacatgaagccagaacctaagtgactaaaatcgaggaagttctggcctagcacagagtgaacgtataattawkgggagctagagcgaccattagaataataatggccagaaaacagaactgactcgctaggtatgasccagcagtccgaacaagggcctgctgagcacagtggctcacagctgtaatcccagtgctttaggaggctgaggctggaggaccactagaggctagaaatttgagaccagcctgggcaacatagcgagactccatttatacaaaaaatggaaaatatgaggcgggcttggtggcacgtgcctgtagtccccgctacttgggaggctgaggcgggaggattgcttgagcctgggaggtcgcrgctgcagtgagctatgattgcaccactgcattccagcctggatgctggagaaagaccctgtctctgaaaaaaatcaaaacaaaatgaaggcccatgaataggaataaggagataaattcaggtccaaagaaagaagcctttgtccacaattggagctctcccgcacagcgtaggagccttagaggcagtgagctacccatctttgaaagtgttcaaaggtagaggtgttccctgggaaaagtggcctagatggtccctggggaccttcccagccagtagggttttctgaccctgccttcatcctactcctagctatttcttgttgctcacatctcctgaggcccaggaccctggaggggaagaagaagcagagagcgcagcccggcagcccctcataagaaccgaggccccggagtcgaagccaggtaggagacacagaccctcagagaggtcactttctttctctctgggtttggccttttcctctctgcaataggcaaagttaagaggggaaagagagtgagtgtactggttatgggaaaagcctttgtctatttgagaaatacttgttgaggacgagcacagtggctcacgcctgtaatatcccagcactttgggaggctgaggcaggaggaccacttgagctcagaagtctgagtccagcctgggcaacagagcaagaccttgtcgcaaaaaaaaaaaaaaraaaaaaaaaaagaaaagaaaggaaggaagggagggagagaagaagggatattaattgagtacttaccatgtgccaggcattccaatcacaagtgctgaggccctgcggtggggataagctgggatgttctagaaccagagaatggccagtgagactgggcagggtgggccaatgsccatctgtggagctgtacaagagacattggccgggcgtggtggttcayacctgtaatcccagcactttgggaggctgaggcagatggatcatttgagatcaagagtttgagaccagtctggccaacatggtaaaaccccgtctctactaaaaataaaaaaattagccaggtgtggtggtgcatgcctgtagtcccagctacttgggaagctgaggcacgagaatcacttgaacccaggaggcagaggctgcagtgagctgagattgsaccactgcactgcagcctgggcaactgagtgagactctgtctcaaaaaataaaaaaaattaaaaatcaaagagacgtgaagaggtctcacctggttagcttttattttcatcatgataaagtatgtataktacttgaagtttaccattttattattttttatcttactttatttttttgaggyggagtttcgctcttgttgcccaggctggwgtgcaatggcgcaatctcagctcactacaacctctgcctccygggttcaagtgattctcctgcctcagccacccgagtagctgggactacagacacctgccaccacacatggctaatttttgtatttttagtagagatggggtttctccatgttggccagggtggtcttgaactcctgacctcaggtgatccgcccacctcagtctcccaaggtgctgggattacaagcatgagccactgcgcccagccattttaaccatttttaagtgtccaatccagtggcatggaagtgagttcccactgttgcgtggtctggttaattctgtcataccggtgcctctttgccgagtcttcagtgtgaaaacttcatctgcccttctctctctgttcccctgcaggctccagctccagcctctcccttcgggaaaggtggacagtrttcaaggttcggatgatggctggggtatgtccctgtggggcttgctcacctccaggccccccgcttatatcttctgccttttccagggtctgctgtggtacattgttcccttggtcgtagtttactttgccgagtatttcattaaccagggacttgtaagtgaggggtgctaggaggggtgyggaggtggcgattggggctgggacccacacagccccgtccatctcccctgtctggtatttgttgcagtttgaactcctctttttctggaacacttccctgagtcacgctcagcaataccgctggtaagaggagcgagggcagtgggctgggagggcgccgtggtgatgcagctgccstgcccagtaggcaccggggggagcgggatggtccctggaggagcctcctctcctccccccaaccctaacctcaggtaccagatgctgtacyaggctggcgtctttgcctcccgctcttctctccgctgctgtcgcatccgtttcacctgggccctggccctgctgyaggtaccaaacccctgcccctcacttcactcccaccttggctcccagcttggctcccagcttccccaaaccccctgcttcccactatcagtgggaagtgtaaatttttttttttttttttgagacagagtctcgctctgtcgtccaggctggagtgcagtagcgcaatcttggcttactgcaacctctgcctcccgggttcaagtgactctcctgcctcagtctcctgagtagctgggattacaggcgcccgccaccatacctggctaatttttgtatttttagtagagatgggattttgccatattggctggtcttgaactcttgacctcaggtgatctgccggcctcagcctcccaaagtgctgggattacagggaagtgtaaattgtacactatcatttcttagcacagggaaccaaagtccagcagagctccatgtaaaatgtatagcctcaggagccaagcaaaactgagcttcagtactcagccactgtgtgacttagggcaggtctcagaacctctctgagcctcaatttcctcatgtataaattgggtgtggccaatacctatttttcagggtagttgtaagaaatagagatgagagaaagaatcgaagaacaagattttgtagtgtgtgtgtgtgtgtgtgtgtgygygtgtgtgtgtgtgtgtgtgtgtgtgtgtgtgtgtgttttaagcattgggattgggccggsccaggtggctcatgcctgtaatcccagcactatgggaggctgaggcaggtggatcatttgagcttggtagttcaagtccagcctgggcaacatggcacaatcacatctctacaaaaattagccaggtgcagtggcgcacacctgtagtcttagctactgggaagctgaggtgggaggatcacttgaacccatgaggtcaaggctkcagtaaccaakgtcatgccactgcactccagcctaggsaatagagcgagaccctgtctcccagaaaaagaaaaaagaaaggaaaagtcggaaccttcctctgtcgcctaggctggagtacagtggcatgatcataggtcatttacctcaggcaaagagacaggctttcaaataatgtttctaactataagaaaatgtacagttcttttattctagatagttaattataatagaattggtgrctttgaagtcagtgggttatttatcttgagggtggtgagcaaattcaactgcccttggcaaacagtagtttacagctttaagggsgcaaacacccttccttacaacagtctaataaaaggagtttcatataaccagcattcattgtttcaaggttacaaatccacagcccctgcaggtaactgttacaataaactgtcaactgtgacaggaaagtcttctgcctttgaaatttaggaacttggccagtcctggtggctcacacctgtaatcccagcactttgggaggccaaggcaggtgaatcacctgaggtcaggatcaggagtttgagaccagtctggccaacacagtgaaaccccgtctctattaaaaatgcaaaaattagttgggcgtggtggcacctgcctgtcatctcagctactcgctaggctgaggcaggagaattgcttgaactccggatatggaggttgcagtgagccgagattgcagtactgtactccagcctgggccacagagcgagactccatctccaaaaaaaaagacttaggaactcaattctgtgatagcmaaatacagaaatagagattatactttaggstaggtgttgtggctcacacctgtaatcccaatgcttttggaggstagggtgggaggatcamtygaagccaggagcttgagaccagactggacaacatagtgagaccccccacctctacaaaaaattaaaaaaaaaaataagccaggtgggagaattgcttgagcccagaagtttgagagagcagcctgggtaacatcacgagacctcatctctacaaaaaacaacaacagggtgtggtgacattcacctgtaatcccagctactcgggaggctgaggcaggaggatcgctttagcccaggagttccaggctgcagtgagccataatcatkccactgtaccccagcctgggtgagaccctatctcmaaaaaaaagattacactttcatattatggmaaaagcatgtaaatatcctccagcctccttccttatttatctgagcagtgctgcaagcccagggtttgtacccacaaaaccccaaatttataactcagggtgcttgtagataccactgaaacatgtagcttatggttttaagctacatgtttttagctataatgttttttgttttgttttgttttttgagatggagtctcgctctgttgcccaggctggaatgtagcggtgcaatcttggctcactgcaacccctgcctcccagattcaagcgattctcaagcctcagccttccgagtagctgggattacaggtgcgccaccacgcccagcaaattttttgttttgttttgttttgttttgttttttagagacagagttttgctcttgtagctcaggctagagtacaatggcgtgatcttggctcactgcaacctccgcctcccaggttcaggcgattcttctgcctcagcctcctgcgtagctgggattacaggcacgtgccaccacacctggctaatttttgtattttttagtagagatggggtttcgccatgttggccaggctggtcttgaactcctgacctcaggtgatccacccgccttggccttccaaagtgctgggattacaggtgtgagccaccacacctggctagaggtgtgtcctttttaatgctcatctttaagtctacctcagatttaatgaattaggacctctagggtaagccccgcttggggcatttgtacctagatccccaggcrattcttacatatacgaaaagtatgaaccgccacgaggaggcctacacactgcacaagaggcaatgtggcgtggtcagtgctgggaggatggcacctccttgagagactggggcacagaggtgggacctacaccctggggtggggatcgaagaggcttcctggccaggtgcggtggctcctgcctataatcccagcactttgggaggctgaggcaggggggcagcgactgcttgagaccaggagttcgagcccagctgaataggatgcccggctactcccaccttgttttaccatagtgaaccaacggtttttccaataggggcaattttgctgcccagcggatgtttggcaacgtctgcaggcatgctttggttgtcacaactgagggatgctatgggcatctagcgggcagaggccagggatcctgctawatgcgctgccatatacaggacagccctcaccatgcagaacaaccagcaccaaacgccaagagtgctgcaattgagaaatcctggtttcgatggtcccacttccyttaagaagcctccawttttttttttttttttttttttttttttatgagacaggatcttgctctgtcacccaggctggagtgcagtggcacaatcatagcttactgcagcctccacctcctaggktcaagcaatcctcctgtctcaractcccgagtagctgggactgcaggtgcgtgccaccatgctcaactaatttttaaattttttgtagagacggagttttgttatgttgcccaggctggtctcgaactcctggcctcaagtgatcatcccaccttggtctcccaatgtgctggtattacctgcatgagccactgcaccaggctgaggttgagaattttttttttttttttttgggatggagtctctctctgttgcccaggctggagtrcagtgctgcgatcttggctcactgcagcctytgcctcccaggttcaagtgattctcctgcctcagccttccaagtagctgggactacagaaccactacacccagataatttttgtatttttagttgagatggggttttaccatgtttagtagagaccaggccaggctggtctcgaaatcctgacctcaggtgatctgcccacctcagcctcccaaagtgctgggattacaggtgtgagccaccrcaccgggctggtgttgagattttatctagacctggcagccctctccttcaccagtaactcctaaaaccagggacccctggaggggaggccacctctccttccctgccccgccctggtcccaggcttagcctctccccctgttcacagtgcctcaacctggtgttcctgctggcagacgtgtggttcggctttctgccaagcatctacctcgtcttcctgatcattctgtatgaggggctcctgggaggcgcagcctacgtgaacaccttccacaacatcgccctggaggtcagcattggccgggcaagggctgggggtggcctgtccagggacacccagggcagggatgtctgggactgaagcctcacccctgctctctgccctcccagaccagtgatgagcrccgggagtttgcaatggcggccacctgcatytctgacacactggggatctccctgtcggggctcctggctttgcctctgcatgacttcctctgccagctctcctgatactcgggatcctcaggacgcaggtmacattcacctgtgggcagagggacaggtcagacacccaggcccaccccagagaccctccatgaactgtgctcccagccttcccggcaggtctgggagtagggaagggctgaagccttgtttcccttgcaggggggccagccattgtctcccacttggggagtttcttcctggcatcatgccttctgaataaatgccgattttatccatggacttcttatatcgtttttgtctctaaaaagaaacttttattatgaaagtaatacatgcccactttcctatatatagacagcataaagaaggtatgtcagcagatttctcccttttttgtttgtttgtttgtttgtttgtttgttttgacagagtctcactctgtcacctaggctggagtgcaatggcgtgatcttggctcactgcaacctccacttcccggttcaagcaattctcctgcctcagcctcccgagtagctgggattacaggtggtcactaccatgtctggctaatttttatatttttagtacagacgacattttgccatgttggccaggctggtctcaaactcatgacctcaggtgatccgcccaccttggcctcccaaagtgctgagattacaggtgtgagccactgtacctggcctctgccatctttgaggccttacgtattcattcattcatgcattcattgtttgggacaatctgtaaacaatcatgttggacattctttccagcatgaaagttttcagagaagtggaaagaattgtgcagtgaatcatcctgagtatgcgccaccctgttctatgttaacattttgttacagttgttttatcatgtagtccagcccccatcaaatctatgtattcactgttccatcagtgagtagatagagctaatgaatggcagggttggcacctgaggcattttattttattatttttttttatttttagagacagggttgcactctgtcacccaggctgaagtacagtggcacagtcatggctcactgtagccttgacctcctagactcaaacaatcctcacaccttggcctcccaagcagctgggactgcaagtgcatgccaccaagcccagctaatttttttttttttttttgtagagacgcgatcttcctatgttacccaggctggtcttgaactcttgagctcaagcagtcctgccttggcctcccaaagtactgagattacaagcatgagccactgctcctggcatcctgttatttaggtacagtttttatacacagtaaaatgtataaattgttacatatttttacagtaaactgagtctgggccaggcactgtggctcacacctgtaatcccagcactttgggaggctgaggcgggcagatcacctgaggtcaggagtttgagaccagcctgcacaacgtgacaaaaccccgtctctacgaaaaatataaaaaattagccaggtgtggtggcttgcacctgtagtcccagctacttggaaggctgaggcgcaagaattgcttgaacccaggaggcggaggttgtggtgagctgaaattgcaccactgcactccagcctgggcaacagagcaagactctgtctcaaaaaaaaaaacaaaaaaactgagtctgacttagtgtttctcatacttcattgttaccctttctactatatttgccatatctgaacctaacagtacttttatttacttaatatttttcattaaagcaactaacctttaatatacattcagttattttaaagggaaacattattaaaatcatgagtttgaggtgatatatatgtattttctactttactttaaatagttatgtaactattggagtttaaaatgaacatgcaagttccccctgagactactccattacgaccagtgatgtttgtggacccagatctaggaaatgctgacccactggttaatagcatgggctttgggggcagaaggaactgactttcaggtgccaaccctgccattcactagctctattaccttgggcaagtcacttcacctctctgcacctcagtttcctgatctgtccaatgggataatagtagcaccagcatttcataagttgcttttggaaactacatgagatcatgtcaacactcaataaacatcagctctgatcatgctatgatatgactcctgcctctcacctttgcattgcattatacccgtgtttctcaaaccttagtgtgtactggaggccttgttttttgtttttgttttcttggagaccaagagtcttgccctgtcacccaggctggagtacagtggcatgatcatagctcactgcagtctcaacctcctgggctcaaggggtcctcctgcctcagcctcctgagtatctaagactgcaggcacgcaccaccatacctggctaatttttatatttttggtagagatggggtttcaccatgttgtccaagatagtcttgtactccagagctcaagtgatccacccaccttggcctcccaaagtgccaggatcacaagtgtgagccactgcacctggccctgcctggctaatttttattttttttctgtagagacgaggtcttgctttgttgctcaggctggactggaactcctggcctcaagtgatccacctgcttcagcctcccaaaggtctgggattattacccatgagccaccacacccagccacaatattttatttatccatttgttagttgatggatattggggtttcaattttttgacttaactatgaatcatgctgctataaatgtttgggtaaagtttttgtgtggacacatgttttccatttctcttggataatatcaaggagtggaattgctgggttgatggtaattttgtttgatcctttgaggaactacccgactgtttcccaaagtggctgcaattttacattccactggcagtgtacgaggactccacgtccccaccaatacttgctcttttccattctttttccaccgcaacctccgtctccccggttcaagtgattctcctgcctcagcctccctcttttttttttatttttgagacagtctcgctctgttgcgcaggatggagtgcagtggtgctatctcggctcactgcaatctcagtctcctgagttcaagtgattctcccacctcagcctcccaagtagctgggattacaggcatgcgccactacacctggctaattcttttttgttgttgttttttgtttttgttttgttttgttttttcagatggagtcctgctctgtcaccaggctggagtgcagtgacgcagtctctgctcactgcagcctccgcttctgggttcaagctattcttctgcctcagcctcccaagtagctgggattacaggcacccaccaccacacctggctaatttttgtatttgttatggagacgaggtttcgccatgttggccaggctggtctccaacttctaaactcaggtgatccaccggccttggcctcccagagtgctgggattacaggcatgagccaccgtgcccagcctcttttccgtttttgttttttttttttcctttggttgtctggtttggtttttattatagcctttctagtgagtgtgaagtggtatctcactgtggttttgatttgcatgtccctggtgactaatgatgctgagcatcttttcatgtccttattgaccgtacatatagttctttgagaaatgtcttctcagatcctttgcccatttttaaatgggattgtctttttttattaaagagccagagatctgaagtctttttgagttgtaagatttcttcatatattctagacagaagtcccttataagatacatgatttgcaaatattttctcccattctgtgttgtctttttacttttttgatattgtcttttggtacggaaagacacttattttgatgaagtccaatttatctattttttgtttggttgcttgtgcttctggtaacatatctaagtgggagccaggtgcagtggctcatgcctgtaatcccagcactttgggaggccaaggcgggaggtttgcttgagaccaggagttcaagaccagcatgagcaacattgcaaggttctatctctataaaaaattaaaataatgataaaaggaggccgggcgtggtggctcatgcctataatcccagcattctgggaggcaggaggacaacttgggccaggagttcaagaccagtctgggcatcatggcaaaaaaagaaaaaagaaaaaattatcctggcaaggtatgcctgtagtcccagctacttgggaggctgaggcgggagaattgcttgagcccgagaggtggaggttgtagtgagctgagattgaaccattgcactccagcctgggtgacaggaatgaaaccctgtctcaaaaaataaaaataaaataagccaggtgtagtgctgcgtgcctgtactcccagctactctggaggctgaagtgggaggatcacttgagcctaggaattcgaggctgcagtgagctatgatcataccactgcaccccaatgtgggcacagagcaagaccctatctcttaaaaaacaaacaaagaggggcggggtgcagtggctcacgcctgtaatcccagcactttgggaggctgaggcgggcagatcacgaggtcaggagatcgagaccatcctgcctaacacggtgaaaccccatctcctttttttttttttttttttttgaaacagagtttcattctttttgcccagactcccgggttcaagcgattctcctgcctcagcctcctgagtagcggggattacaagggtgtgccaccacacccagctaattttttatatttttaatagaggcggggtttcaccgtgttggccaggctggcctcaaactcctgacctcaagtgatccgcccacctcggcctcccaaagtgctgggattacaggcgtgaaccagcgcgcccagcctcctacattttcttctaagagttttatagttttagctcttacatttagatcttgttttcattttgaattaacttttttgcaggtggtgtgatacagcagtctgtgcagaaaaaagttaacatagtagaccctaactgctaactttatttttacttttattttttattttgtttagagacagggtttttgtcacccaggatggagtgaagtggcgtgatcatagctcaccgtaaccttgaactcctgggctcctctgcctcagcctcccaattagccaccacacccagctaccttttgtacatttttttggtagagacggtgtctcactatgttgcccagtctggtctcaaactcctcagctcaaatgatctgcccaccttgacctccagagatactgggattacaggcgtgggccactgcaccagacccaggtttattcttacaccaatacaacactgtcttaattactatagctttgtagtgagcttttgaaaataggaaatgtgaatcctccaactttttttttttggagacggagtctcgctctgttgctcagactggagtgcagtggcactatctcagctcactgcaaactccatcttccaggttcaagtgattctcctgcctcagcctaccaagtatctgggactacaggcaggtgccaccatgcacagattccttggacatccctgagaggtcaatcatgaaggtcaacttggttttctccccctcatttgggttcagaatttaaagtccacacacacaggcagtaagatgattatagataaggacatcatcactcggtttcggatgttaaattgtctaggtgggttaggggtgatttgagatcacacaaccttgtgccacaaagaggaattcccaggccagagggagacattttattgccatgttatgatcttatcattgagttgaaaggcaatcttgtttcattttggattctttcttatgtttatgtcttataagggcactttgaatttccaagcaaataataattttgaattagcttttaatcattgacttctagcacagttatatgatcagaaacgtgctgtgtgatttgattgctctcaaatatattgagatttgctggaacaaaataagtcaggttaatttttgtaaatgtaccatgcttgcttaaaatgaatgtatctacat

SEQ ID NO: 17589 - DNA, 16301 bp, Homo sapiens
cctaatgggagaaaagcatgtctttcaccctggaggcagagggatagacacacagagcctggctcccgtcccagctctgccttcacttgaaggatggctttgggtcagcagtgactgacttctcaggacctcagcgtctctgcatgcacaatgaagagggggtttccatatgagtctcacactactagaccacaggccacagatggccctgtaaatggactttgtttagataacacattcaagagctttcttttttttgagatggtgtctcactctgttgcccaagctagagtgcagtggtgtgatcttggctcattgcaacttccacctcctggcttcaagcaattctcctgcctcagcctcctgaatagctcagactacaggtgtgtgccaccacacccaggtagtttttgtatttttagtagagtcggagtttcaccatgttggccaggctggtctcgaactcctgacttcaagtgatccgcccgcctcagcctcccaaactgctgggattacaggtgtgagccactgtgcccagccagagactggaaactttaccccaccttgtcccaccccctcatcttcccacagggactaaccatggtggtggtggtagagagtcacttacatggctctggtttcccgatgtcctcttgtggctaaggatgtcgtgggcggcactcagcatcaccacataagagaagttgttgcaaaggcccagcagcctggaaggagcaggacaggtctcaactccctcctcatcctgcagccatctgtagcctttgtgccaaaccttcccttacctgtgcccttcaatcagccccctcttttttttccctctatcaccagatcccatcctcattcaatgttggggtcaaaaatacaggctttggtgcttgggcaagatagtgagacccccatctctacaaaaaatttaaaaattagccaggtgtggtggcttgcactgtagtcccagctacttgggaggctgaggtgggaggattgcttgagtccaggagtcagaggctgcagtgaactgtgatcatgccactgcactctagcctgggtgacagagcaagaccctgtcacaaaaataaaaaataaaaaggaagaggccgagtgcagtggctcacacctgtaattccagcactttgaggggccgaggcgggcggatcgcctgaggtcaggagttcgagaccagcctgagcaatatggagaaaccccgtctctactaaaaaatacaaaattagctgggcgaagttgcacatgcctgtaatcctagctactcaggaggctgaggcaggagaaccacttgaacccgaaaggcggaggttgcagtaagccgagattgtgccattgcactccagcctgggctacaagagcgagactctatctcaaaaaaaaaaaaaaaaaaggagagtggtcacagagagtttctgggagaggccttggaggctggaagtgaatccaagtctgtgatcccaaagcccctatgtcagggcggggcacggtggctcacgcctgtaatcccagcactttgggaagtggaggcaagcggatcacctaaggtcaggagttctagaccagcctgaccaacatggtgaaatcctgtctttactaaaaatacaaaaaattagctgtgtctggtggcacgcacctgtaatcccagctactcggggagctgagacaggagaatagcttgaaccttggaggtggaggtttcagtgagccgagattgtgccactgctctccagcctgggtgatagagtgagactctgtctcaaaaataaaataaaattaaaaaaaaaaaaaaaaaaagctgggcgcggtggctcacacctgtaatcccagcactttgggaggccgaggcgggcggatcacgaggtcaggagatcgagaccatcctggataacgcggtgaaaccccatctctactaaaaatacaaaaaaatagccgggcgtggtggcaggcgcctgtagtctcagctactccggaggctgaggcaaaagaatggtgtgaacctgggaggcggagtttgcagtgagccgagattgcgccactgcactccagcctggaggacagagagagactccgtctcaaaaaaaaaaaaaaaaaaaaaggttcaggcccggcatggtggctcatgcttgtaatctcagcactttggaaggttgaggtaggaggatcacttgaggccacgagtttgagaccagcccaggtcccatagtgagacccccatctctataaaaaaatataaaaattaggcagatgcggtggtgcacacctgtagccacacctacttggaggctgaggtgggagaatcacttgagcccaggagttccaggctgcagggagctgtgattgcactactgcattccaacctgggaaacagagcaagaccctgtctcaaaaagaaaaaaaaataagataaaataaaataaattaaaaaaataaaaaagttttagtagtgatgcatttatttaaacgttcactaggaaaacgctggttttccaagtggagtcgtgatttaaagttttctttttaaaaatatgtgcactaaaaaacgttaaggctgaattggctggaagaaaaaagtaaataatcctacaggtggtaggtatgaggatcttgctaaatccggaaggtgataaggagtgaagtttggaaattttacatgctgcccctggggcaaaccagtggattcagtaaatatttgtgggttcagctcctttgcgcagcttaactctttcttccccctttcctccggtcacttccctcttctcatgccattgtcactcgctgaagtctcaggccactcaccagaagcccaccgcgttcttccaatgcgcgccctgatggtccaacagagggagccggggctccgggacggtctcctcccctgggagagcgagaagagggcatgacccccacctactctcaggtgcacgaccgctccttgcgtgtcctcccggggccgagtcagctctcattcccctcaggtgggctgcgagccagaggtggtcgttccatgagggtgggcgggaatactcaccctcggaatccgaaaagcgccgccgcgagcctgcacagcctcccatcgcatcaagttcaggtcccccgagggtccagggtcatagagtgtccaaagggggctcccacgggagggatgagggtctgcgacaggtgacaaggatcaacgcccgattgccggtcccagctccggcttgtctagggcactcgcgccccgcgatccatcaaggaagctgggggctccatctcgagcgccctacgacccaccacgccccacccatcgtactctcccccgccccgtctacagcagggaccctgaggcctgtacctttaagagcagcagaatgttctgcactatgcagaggccgtttgtcggatcacgtgacagcacccgcgtgttcccccatcacgtgctcagaggttttccctacttccgggtcctctctgtcttcgctttgggccttctcggcttcggagcgtgaaaaagggaggggctggagaaccctggaaccgcaggttttaaactggagcgggtgggagcagcaagcagagccgtgaccttagatcagtggcgcccaagaccgagacagtagcctgccagcaccagttatgactgtgggaggcttcagctcctttccttcagcactcacttgccagaaacaaatatggccacctgcctactcccttttttttttttttttttttgaggcaggactgtttctggttgcgaacaaagacgaccagcttcaggtcattcttatccccatctgttgaccttacaaattgttttagagacctaagtaaacataacactcatctaaagggatttcgtgaatgatctattggcagtatccaagatgttaagagatccctatttccaaattatcctagaaccaaaaaatatcacagcacttcaacccctggtgttacagatgagaaaaccaaggtacaaatatatatatatatatatataacaaaattagccgggcatggtggcgcattcctgtagtcacaggtaccttggaagctgaggtgggaggatcacttgtgcccaggaggttgaagctacagtgagctatgatcacgccactgcactccagcctgggtgacagagtgagatcctgtctcaaaaaaagaaaaagtaaaaaataaaataaaaaaaatatatgtatatgaaaaaaattggaaagttgctgacaatcattcatacaatgttagacctaaaggtgaccttagagacctgtatggtgataagaaatagagcaccagaggcagggagccattgggttggctccaggctgctgcaggattcctgcctccatcaaaggtggtgcttagaccagatttttttttttttttgacagggttttgctctgttgcccaggctggagtgcagtggcaggatcttggtttgctgcaaccttgacctcccaggctcaggtgatcctcccacctcagcctcccgagtagctgggacagcaggtgcgcaccactgtgcccagctaatttttgtgttttttgtagagactggattttgccacgttgcccagggtggcctcaaactcctgagctcaagcaatccacctgccttggcttcccaaagtgctaggactacaggcgtgagccactgcacctggccagactaaatgattttaaggcctaagattctgatgctgtgatttcatagaattgccctaattggaataggaaagtggggctggggaggggagaaggagggtatggggaagagaagtagagcaaggtcactttatgtagttccaaataaggaatcatacccttaccttcttctaggtggaaagcggcatcctgcattctcttcttgtccttggcctcatctctgctatgggctgtgccacctctatatgctctttctcaccaccaggccttcagaatgcagttggaaatgtgccctctcgtctgggtgtggtggctcatgcctgtcatcccagcactttgggaggccaaggtgggcagatcacctgaggtcaggagttcgaaaccagcctggctaacatggtgaaaccctgtctctactaaagatacaaaaattaaccaggtgtggtggcacgcacctgtaatcccagctactcgggaggctgaggcaggagaatcacttgaacccaggaggcagaggttgcagtgagctgagactgcgccactacactccagcctgggtgacagagtgagactgtctcaaaaaaaaaaagaaaagaaaagaaaagaaatgtgccctctctagtgtgcctcccaggtcactcagctgatggaaaatggaatcctactaacgtgcagggctctagaaattcagcagcgtttcatacatggcatctgccatcaaggaagtcacaggaaggtgggaggcagacacagatatccacaatataaagtttagccaagttcttttttgcaagcctaatcataggtgaggggatgcaccccagagccaccaatccggccccttccgcccctgggggaagcattaatgacgccgaaatgtgtcagagctcccaccagccccctcttcactgctactctttcttcccaggcaaaacaggaaccacaaaccccagcttcctcttgcagagtggctgtggcttgtaggggaggcagaaatggctgaggtgcsgatacgagacctgagtcacttgagctgctgttgccacatgtcycctccctctccccctccccagttctaaggtctcctgctcccactttgtcctttctggcctcttgcttgtcctttatttccaaatgtgcacctgagtcccctgtgtgatgtacacccatttcccgggctgcagtgggggctactgtgggcatcaggggccgtgggcagggcctggggtggggacgcatcagggagacaggggaagaggaagtgcctttggtcctggggaaggttggcttgtcttggtgggtggggacggtcattatcagctttctggacacacagacagagacagacaggatggacttcctccggctatacctccctgggctgcaccaggccttgaggggggcactggtgagaagggcagacagctgccagatacttgcaccccattccctggggcctcacttccgggcacctcccctggggcctcacctttcccctcctccttctgatctcctcaaactggagattgctttctcaggttcaggcagactcctggcctaatattttctgaatttcagtccccacctccaaccatgcgtcctcgtacccctaatcgatgccccttctggctccttctgcaaatcctcttcttctcctttcagatcccagtaccctcttccttaacctgggctcctccagccagggcccccagggaaagggctgggactctcctcaatgactctcccctctctctctcttttttcctaggattccctyggcacctttgtctcctacctcctgggagatgcagtccccactgtagagcgggaggcgcaggcggctgaggaactgggggtggtggcggtgggaaagacagggaagattgtagaggmggaagcccaggaggacctggagggccttagaggcagccaaaacgagggggctggaaggctgagaggrcctggagatgacagaagacatgaagtggggagctcagctgtagaacagacctggggctggggagatggcagctcccatgggtcccaagcagagaggcaggacagtggggctggggagacagccaaggctgccaggtgccaggagccaagcgcccacttggaggccagaaagaaatccaaggcagggtctggggcttgccaagacaggagcggccaagcccaggagaggcaggagtcccatgagcaggaagtgaacagagargagaggctgrgaagctgggaacaggaggaggaggaggaagaggtcagggcaagagagccagggatggccagaggggcggagtcagagtggacctggcatggggagacggaggggaaggctggtgctgttgggccaaaggcggcaggggacaacygggagatggagcagggggtcagggaggcagatgcaggggaaactgaggagcctggggccgaaggggctgggaaaggagaagaggtggtagtggtggagaaggcctgtgaaagcactagggcatgggggacgtggggcccaggggcagagcctgaggactggggaatcttaggcagagaggaggccaggacaaccccaggtagggaagaggccagggcaattttagatggggaggaagccaggacaatctcaggcggggaggaggctgagacagcctcaggcggggaggaggctgaaacagcctcaggcggggaggaggccgggacagcctcgggaggggaggaggccgggatagcctcaggcrgggaggctgggacagcctcaggaggggrggaggcygggacagcctcaggaggggaggaggccgggacagcctcaggaggggacgaggcctggacaacctcaggcaaagaggaggctgacctgctgggagtcagacagacagaatatggagcagtcccaggagaaaggctcctagaggctactggaaaagtctgggtcctagaggaggagggggatgaggagagagaggctgaggtgagccctttccccaaacagscccaggtcctgggcactgaaagaacagaagaggctgctgagagccagaccrcagggagggaagctgtgggaggccaggaggcaggggagagctttgagggccaggtagacctgcgtggtaaggaggctgagatgaggcaggacttggggatcagggccgaccgggccaggatggaagagctggtacaggcagaggaggcccaggaggagagagggagcagcagggatccagtggctgagctgccctcagatggagaggctgaaggcactgccgacttggaggcaactccagaggccaggcctgaggaggagctcacaggggaggagagtgaggcggcccagactagctgtggcctactgggcgtggaatggggtggcctcacacacagcgtcaccaaaggccarggacctgagctgatggggggygcccagaccccaactaagcaacccgaggaaagggaggcaggggaggtggagctcatgggagttctggccctgagcaaagaggagcaggagaggagcctggaggcaggtcccaggcacgcggggtctgtaaagcctgaggcctccgaggccttcccaggagcctgggaaaaccgcacgagaaaggacatggagagaggaaatactcaggaggatgcggccgatggcgagcagcgggaggaggaggagactgcgggaggccagaccctggcggctgaggctgaaggagaccgagagtctgaactatcagaagtcccagaggcaggcggggaggggctgacaacccrggacgcgggatgtggaactgaggagggagaggcrtctgtctcagagaaccaggagctggacggaagcacaggggcagacgcagggccttgcccgtcactgggagaggcctatgccagagaaactgaggatgaggaggcggaggctgacagaacatccagaagaggctggaggctgcaagcggtggctgtggscctcccggaccgtgaggatgcacagactggctctgtggctgctgggattatggggggtgatgtggtcccacacatcagcgctgctggcgctggtgaagctttggaaggggygcttgggcaaggctgggactcgaaagaaaaggaagaggcagcagcaggagagcatgcaggtgggcaagaatttggtctggagggctcagcagaggaagaggtgactggcagaggcagccaagtagaggcttttgagtccagggagggaggaccttggggagggcgggtagaggccgaggaatctgcaggcgcagaggacagctgtgggctggatcccgcgggctcccagacagcgagggcagaggggatgggagccatggtggaggctggggggcttctagaaaagtggacgctgttggaagaagaggctgttggatggcaggagagagaacagagggaagacagtgaggggcggtgtggggactaccaccctgagggagaggcaccaaggctccttgatgcagagggtctcatggtgaccgggggccggagggcagaggccaaggagactgagccagaaagcctggaacatgtcaggggccaggaggagcagccaacacaccaggcccctgcagaagctgcgccggagtcagtcggggaagccgagacggctgaggccatgggcagtgccagaggaggtgctgccaacagctggagcgaggtgagggctcttggtggggtctcggggggaacgagtggaatcccgaagccggccccatggtcctctgtgcccsctttcctgcaggccccgctccccgggtccctcctagacgtctctgtcccaaggagtcgcgtgcacctctcgagaagctcctcacagcgtcgctcccggccctcttttcgtcggactccrgcctgggagcagcaggaggagcccccagcccccaaccctcctgaggaggagctgtcagctcctgagcagagacccctccagctggaggaacccctggagccaagccctctgaggcatgatgggaccccggtgccagccaggagaaggcccctgggacacgggtaggcacagggcaactcagctggggtggggaagagaccgcgggcacctgggaacctgttctcacgggcctgacttccgcctccaggtttggcctcgcgcaccctggcatgatgcaggagctgcaagcccgtctgggccggcctaagccccagtgactgagacccggtgctctgggagccaggccctgagtgggtgccagaaggcttgctccaatgccactgagccctgctccctctgccactgtggacacatcctctccaccctctgggcctcagtgtcttgatgtatcattcatggagcaggcaaaaccagacgtctgggaagaccgtgaacttaaggagtctgattctccgacacaggctggtggaccacstaccccactgagaccacctctcagggtgcctgccctggttcctccccagcctgagtcagctgtctggactgcaaggaggctgggcacgggggctcacgcctgtcaccccagagctttgggaggccaaggtgggaggatcgcttgagaccaggagttcgagaccagcctgggcagcatagcaagatccccatcttttaaaaacaaaataaaacaataaagactgcaaggaagactgagggaacagcgaccattttccttacaggccttcctctctaactcccacttcccagcccaactccctgcaccaagaccctcagaactgggcggggataacacaaacctctggagctgcatccaggccaaaggaaggcggttgggagggcttaaggagcactgttcagaatcagagatgagctgccttgagcttccaacacggtagctcggcctcaggatgctgctggttactatggcaactgcctgccggagcaggacatagtaggggaaggtgggccagagaccccaaaaatgtaggagcagagaggggttcaggatggctagaggttgctgaccccgttccaggctgccctgccctctgggtgtcagacagcccttacccgaagagaagcggaggccaggggtggatgagagtgctttattgggcacccagcatgggggcttggcccgaggaggaccatcgggccccaagacaataaataaaccatcatctccctaaacaataaataaatatccaagaaataaatagctggcgaggaccagaggggctttcagttactgggtagrgcctggggcagggggctggaagagccctcccttgtccaaggctgatgatgcgaaggctgccctgatgccaagactccagtcctaaagttctaaagggtggggggcagggggctaagaagccaccgatcagggctgggggctcaatgttgggaaccccaagggccagactgagtgcccagccttggacagcagcagcaactcccgcacggcccgagataagacgagctccaaggagtgcagcaggcggtaggtggagaggagctggggccaggacacctgggccgggccctgtaaggcgctgcccagtgcccctgggagcagccccttcctctcctcctcctcctcctcctcttcctcctcctcctcctccgggaggttgaatcctgcagccagcacctgtgaggagaggccatgggtcagggaggggccaggccgagaacctgagaggaatcctcattccctattcatgcccagcggttcccaatgacatcagtgaccacaaggtcatgatttccccggacattccctgcttgatcttccatgatgtcacctgctaacgcgtctcacctgatctttcagttcgagaaaatggaagtcaaggagcaagaggatgctcacagagctagatcaccccaaggactgccccgaggcgtggggttcaggaagtttctctctgctgtgaaagttgcttttgggtcgggtcagcaacaggcagagggtgacatagctcagattccctgctgcttgccattcctctctctctctctttcttgggagccccgctctgtcgcccaggctggagtgcagtggggtgatcacggctcactgcaacctctgtctccccagttcaagcaattctcctacctcagcctcctgagtagctgggactacagacgcgcaccaccacgcccgactaatttttgtatttttagtagagatggggttttaccatgttggccaggctggtctcgaactcctgacctcaaatgatccacccgctttggcctcctaaagtgctgggattccaggcgtgagccaccacgcccagccctgctgcttgcattttctattctcatttcattaagtgtaaaattctgatttccctttgaaaggttctggaggatctgggtgacatcagagaatcagagggagaaaggaaacaggaggcagacgctgtgctgggcactcaggacacaccccgagtgacctcacagcccaatggcctcctgttgaagatagagccccaggagaatgtgaagattgaggggcagcaccagggcctggtgtggctgtgtgtgcgcctgcacacacgcacacactcacacacatactcattctcacaacgcacccacactcattcccatacagtcacattcacacaaaacacattcatggctgggcacagtggctcacgcctgtaatcccagcactttgggaagccgaggcgggcagagcgcgaggtcaggagtctgagaccagcctggccaacatggtgaaactaaaaatacaaaaaaattagccaggcatgatggtgcacgcctgtagtcctagctactcaggaggctgaggcaggagaattgcttgaacctgggaggcagatgttacagtgagctgagatcgcaccgctgcactccagcctgggcgacagagtgagacttagtctcagaaaaaaaaaaaaatcgttcacgtacccacatactctcacactcacactcatcctcacacactgacatacctatacccaaactctcacccacacacctcactttcacactcacaacactcacattcacacacccacccacacactcccacactcttacactcacagtcccatacactcacagtctcacactcatggacctacacacacacggtcacgctcacactcatacagacccacacacactcacagtcacacccacacactcacacactcacagtcacacactttcacactcagacccacacactcacagtcacactcacacacggacgcacatacacacagtcatgctcacactcatacagcccccccacacacacactcacagtcacacccacacastctcacagtcaggtacactcacacagacccacacactcactctcacactcacggacccacaccctcacacacagtcatgctcacactcatacagacccacatgcactcacagtcactcccacacactctcacactcacagacccacactcacacactctcacagtcacactgtcacactcatggacccacacagtcacactcactctcccacactyacggacccacacagtcactctcacactcatgaacccacacactcatggacactcagtcacactcacactctcacactcacacacactcagagcatgggatcactgaatgagccagcgagtcttctttcccacgtggtctggggtggtggagggtggccgggctctacctggaagcggaggtgccgctgcagatcgcggaggtccagcctcatggcccacagctgcatcctctccatgttggtccagcggccctgggtccccagccctcccagcrgggcatggaagggctgaagcgtggtggagatgaagcagagacgctccgggtcctgaaggggagggagatggtcaggaaaggtccacaggccaaggatggccatatcacacccaccccctccctatcygggtctccttcccattccacgctccagcctccagtccatccctgtagctcttcccccacctcagcccagctgtgtccccattccttccatctccactgtctgggacatttgtcccatctccttttccagcctccctttcactcctatgccaatgatcttctctaacccaccccctctcagtccctgaagcactctccatccacagccctgttcccttccctcytccaccatcccatcatacctcctgcccatgtgtttccatcccatcttcagcctcattcccattcctaaccccaactccatccttcctccatgtgcccagactcactctttccatctttccatcccatctccaacctcattcctaaccctattccattcccttccccaccagcaatccccatcccttctccatcccatgcttaacgttcaccctcatcatcaccttctcatctctaactatccgcattctcacccccagtgccacctccacccaccctccatgctgctgtgatctgtctccagcctcattccagtcccatgcctgccgcgttccatgcctagctccactcttacctcttcccaaccccacttccttattccagcttcatctttattgttggtttgttttgagatggagtctcgctctgttgcccaggctggagtgcagtggcgcgatctcatctcactgcaacctccacctcctgggttcaagtaattctcctgcctcagcctcccgagtagctgggattacaggcgcacagcaccatacccggctaatttggtatttttagtagaggtggggtttcttcatgttggtcaggctggtctcgaactcctgacctcaggtgatccacccacatcagcctcccacagtgctgggattacagtcgtgagccactgcgctcagctaatttttgtattttttagtagagatggggtttcgccatgttggccaggctggtcttgaactcttgacctcaggtgatccgtgctcctcagcctcccaacgtgctgggattacaggcatgagccaccacgcctggcagtttatttatttttctgagacagggtttccctctgttctccatcctggagtccaggatcataactcactgcagcctccaactcctgagctcaagcaatcctcccatgtcagcctcctgagtagctgggaccaaaggtgtacaccaccatgcctggctaactcttaaatttttttttgtagagacaaagtttcactatgttgcccagactggtcttgaactcctggcctcaagcagtccttccacctgggcctcccaaagtgctgggtttataggtgtaagtcaccatgcctgtctttcatctctatgtccaatgacatattcagccttatccaggttctatccccaatgcatctccagctcaatctccagcctcatcttgcaccctggccccagcctatcacaagcttcccgccccactccaccagccctcactcacagagaggcggcgccaggcctggaaggtcagggaaacatcagggagctgctctcccaggggcaggaggtacaggttcactcctggcaggtgagattccgcctggggggcaaggtctgttagtgggggccagaagggattgggggtctgcccatctccagcgccagctgcattagggggacttacaaagcggtgggcctggccccgaacctcggmgagcagcttcctggcgagatgcaggctgactgtgaactccctccgcagctcctgcaggctcagctggggcctccctgggggccttgggaatccccagacaccagcttgaaccaggagcaagggaagcagcaacaggctgagccctggagagatgggaagagggtggcaagacagggagagagcttgagaaggaagggaacatgccttttctgagcctgtgctagctgtgagcacggtgcaggcactttgaccagcatcattcctctgcctcctcaaaaccacaatggaggctgggtgcggtgactcacacctgtaatcccaacaatttaggagaccgaggcgggcggatcatgaggtcaagagatcaagaccatcctggccaacatggtgaaaccttgtctctactaaaaatacaaaaattagctgggcatggtggtgggcacctgtaatcccagctactcaggaggttgaggcaggagaatcgcttgaacctgggaggcagaggctgcagtgagctaacaccactgtgctccagcctgggcgacagagccagactctgtctcaaaaaaacaaaacaaaacaaaacaaaacaaaaccccacgatgcagccagcacggcccccatatggcatctccgcatggtgtgcccacttttgcaaaaagaccagaagcctgatcctttttttttttttttgaaacagagttctgttctatcacccagcctggagtgtagtggtgtgatcacagctcactgtagccttgaactcctaggctcaagtgatcctctcgcctcagcctcccaagtagctgggatcacagggacacaccactgtgcctaactgtttctatttttttgtagagacagggtctcactatgttgcccaggctggtcttgaactcctggcctcaagagatcttcccgcctcagcctcccaaattgctgggatcacaggcatgagccactgtgccgggacagagactggattttgacccccataaactcccttggccaaatgcctttttcagtgagcaacctgcacaaccacgtgtggcagcc

SEQ ID NO: 17590 - DNA, 161700 bp, Homo sapiens
  misc_feature (1)...(161700): n = A,T,C or G, or insertion/deletion polymorphism (see Tables 1-2)
atgcttctaatcccagcattttgggaggccgaagtgggtggatcacctgagatcaggagttggagaccagcctggccaacatggtgaagcacagtctgtacgaaaaatacaaaaattagccgggcatcatggcaggtgcctgtaatcctagctactcagaggctgaggtaggagaatcgcttgaacatgggaggcggaggttgcagtgagacgagatcacaccattgcactcccgcttgggcaacaagagtgagactccatctcaaaaataaatgaataaataaataaataaagatttatgatcaagtaactaattacctggacatcctctcctggcataagaaacagaacctatgaagccaccctagactgttgcccaatcctatccaccaaaaggaacctctatcttgagtcttgtatttactagtcctttgcactgtctctaaagatttttacaataaatatatatacccaaatcacagtctgacctgtttttttaacttcgctgtacagagaactcacactatatgtattcttctgtgatgcatgttatgtgtaggagagttatctctgatgtgggagggtgctgttcaatcatttttactgctaaaattttacttttcgtaattatatcagaattttgttaattcccattgatgcatatgtgattgtttccagtttttttgccataaacattggtgtacacgtctctgggacacatagccaaagatatccccagagtgtatgatcaggagcagatggtgggattatacagtgtatggacattaatcatacaagataaggctaatttgatttcccaagtgcttgtaccaagaatgggaaagaacttatgttgctcatgtgttctgaaaacattcagttgaaggtggagattacatgttaaaaaaccattgtcttggctacagaatcaccctaggcattttttcatattccattaataccttccttttctttacttttatcctgtaaattatggcattatactttaagcataagattcaaataatgcttctttttagcctaaccacatagagtttgtgaaaaagtggagggagggagaaagctctgagggaggaaaggaggaaagaaagatggaaggacagagaaagacaaaatgaacattttcaaaaaagaataggaggaaaggattagaaacagcaagtgtggctaatattattaaaatgcaggaaattaaaagatgtagataacatccatggaataacagaaacttaagaaagccttaatagttattaactgctgtgtcacaaactacctcaaaatttagtggcttaatacaacaaatatctgttaattcaaagagatactacraacgcgcrcaaaatagattttatgggggtggcagaagttggataaagagatggattttacaggttggaataagtaagagttattggtgtgcacatggcaatgctttttagtccaagtcctccaaggagcagatgccaagatgagcttaaagtctacggcatcttatgaggggacacacctgtaagggaatatgagacgcgagccagaaatccctggaaaaggcggcagacaatgatgcaagtgtgaccccaagtgctggacagaaggagacaaggtctgttcgacgcatcctagagcagaggcagtctaaggagagttgaggaagggcatggaggagtcctggagccacatttggccatcagaggagtcccatgtctcccagtaatggcctgccttagtgtgcttgctgtgaccggtcactggctgggaacaactcatggaagcagggcttctgcactaatcctgctgaggatgtcagagcacagaagcagagacgtgggacattacctaggagtatcactcaatccttccttcctgagggttctgggctcttgaatatcaaaccctctcaggctgggttgctggatgattctgctcacacaacggacaagggaaaccaggacgtccccaagtggattcctggtttccacacacacttctcctgccctcattgtgtgatagcagccctgcctcctcctcttctcacctgcttgtctctgggcacatactattcaaatatccctgggtgcaaccacaatgtgtagttccatggactctcatttgtctccttgccagggtgccctctttgggaaaccaggacctcctaccctgcagagtccagattttggaagtaagaagagcaaaatcaccctgggggtgaatataatgaataaaatacatacatacatacatacatgcataaataaatttatttaagtattcatgttatgtatttatttatttacttataagtaaatcaccctgggggtgaatataaggaatgagacacacctgctttgacttcttggtttttggacccgcgtattcttccttctgaaaacagtgccttagagacgtctttgattcaatacatgcatcacatcctgaaagatggcacccattcctcagagggtttcatccaagctggtactgagttgtgcctgtagagtcctgtccatgactctgtgtgcctggcagcacttgagaggcgcaggtggtgatacgaccaggggatcccatggtcagggcccacacttcatccccttccccaacaggtgtgtcccccaggcagataatgtactgaaattctgagccagtggatcaggaatgccaatagtgttgttgactgagggtctgagagcagagaggaaaaccacaccacatcgcatccctgtgagcctatccctgtgaggataaacttctgccccttccaggatggatggtgttcaagctattcaacttgtcacttaggggctagtcagttactttaagaaatggtgccctattggtgcctatcattggtctgcaatgctcacgagcagagtattcagaggaagcagtagctgggtgggccttggtagtggagagacagtgctgctggactcatttgtagcttcatccctgccactgtggttgctccactcacgggtccttcctatcaggcctgggctgatccatgatgcagactggctaacttcaatttgtcttcaatttgtttggttattcagggccacatcaggactgggtgttttctgtgggtgttaacatggaattgaggctcaaccgacatggaccgttttcgtctcatgatagatgccgctgggcctgtccagtgaatgactctatgggtcacatagaagccaatacacacgggcacttggaatcacatggttgcttggtgtcctatgctcaagcattctatcttatcagggccagtaacatgctaaaagttgcttctaacatggagcatgtttctctgctgtggactccatggccttactcctgatcccaggccctgcattctgactttcccactgatgcttggttcagctccatcctgcttctttccccagaccgccacctccagcaccaggggtctgagggatggtgactgactgcaccacagcctgggtctgctgcagtgtcctttccagtccaggccccactcaaagctggcctcctcctatatcacccagagtgtcagccaaagcaataaacttagatgtggaatgtggtgttgccagaacccagagaggctcatcaagtagtgtgcttccttccttctggtgaggatgcaagatgcaagtttgtcttttactttgtgtgtgtgtgtggcgggggggagctctgcatgcccctaaccactggacccataacacttcactgcagtggccactcttgaagctctgtaagttttatcttcaccttctgtagtgcacatgttttgccagggaattcagcgtactttcctgctgttgttcatccttcccaatttatgtgatattgccaatgaaatgaagagatttagtattctgtgggatgtctgatttgtccaggtctcttaaggtgatatttatagaaggttgaggagttaaggtagccctgatgcaagctatcaataaatgtattataaatcccatgtgaatgtgaatcattccatatccatcttctaaatgaaatgggagggaatgcactcaccaaatccacagctgcttgccatgtgcctgaggccttattaatctccccaggcagtgatatccagccagcatggcagctgcaatcaggactcctacttggtcaagtctggagtaattccattcattctttagccatatcaggcttctgcaggtacagattgctgagttatatggagataacaggcaatcccaacamcaccccrcatcgttcaggtctgtaatggcagtgccacccctataatacctgcagtaccctccacaagacccaccctggggcacaatattgcttctggtttggcttggatgagggatgtttccctttgggcttcagcacaatgagatcccttactctccagactagggacacagtgtggggtgactccagttgccagtgcatcaaggccaattatgcactcagagaatggggagataaccaggacaggatttatggaactggtgattccaccatggggcataatgtgtctaggtttattccctggcctctgtaagccccagtgtgatgggggacataatggtgctgtgggaatctgggcagcaatgtcagctcacacccaatgttaatacttatcccatctcctgattaaatggctataggctcctttgcagaagggctgatggaattgtcccagcatgtaaccatcatcgtgtcccaaggttctttctcttagggatatagatatgtccttagtcactggattctgaatctgaagcttgctcctcaattccacatgcttatcatagatatcaagcagtgcccttgctgtctgcccatcttttctgaccctgggacaccaccctttattaaccttccccacaactccttgaaggtcaagcccccttggctgatactctgggttatcacagtaaatgtgccctytatcttttgcaggtcactgaaaaggagggttcctaaagcattcactcctgaccctgagggaggtgggtgcactcactccaggactcaggtkcaccacagataagcaaaaaagtcctcacattcaaaattgtcctgggccacatgcagcccacgagccgcgggttggacaagcctgcatctagaacgtatgcaccataaccccagaaatttttctgtttttactttaaggatgctttctaaatgcaaaagcagtcatatccctagcagacaacaaatgtcagttgaatgaatgatcactgtagagcacctccctattctaaagcccatacctttattaatgtagccacagggcaaatgctgttttgtggcagctaaagaacataagttcacatggacatccatgccgccagtgcttttctcaccagggctgcttgtgtgtcctccctcctcccacaccaaccctcctgcacacttcagcacaaaaccatatatttctcttcaggaacaataaccctagccttatgggtacaattttccaaccacatatgaatctaaattagactctgctttataaatctatgagtttggattggagccagcactaggattactacaactcagagcaggaagaagagtaggagggcagaagaggagttccaacagaaagttaatcatgatgagaaactatgggacccctcctctctgcaaatgtcacaatctggttcctttaaaaagattggagaaaaatcgaaaatacaattgaggaaaaagccctgggaggaaggcaagacctggacaggtctgaaaatttgtctcttgataccacaaggagatttgtatgcagggaccaccctaggtgacatccaactccctgtgatcacaggtcttggtgggacaaggttctactgaagggccaaggacaatggagcagcaaagatgacccagccaagcagtgaccacataaagcccatggtggccrgaacagaaactgggcacagccccatctactctcctcccctgcaacaaatcagcataagcaacacgtggactctggaaggttctcatgysttccattwattttgtctctcaaattttaggaatcttctcctttaattaactcatcaacctctcatggcaagaatttgagaaagkaaatttatactmaggttctaattttaatagggaaggaaraagttacagctcagtgcaccatgaagttgagrcagagatggagacacctcagccccacctctctgsaacaggaaagatgattggrgagggagcacaggtcagcgtgggaagagggtcatggtggacatsggggtkgggtgstctccccacctcctcacattatgcctacangaacacagacacatgcaggtgcctttgcagaaacaaagtcagggtwcttcaagycacaaagggaagggcaggaacaamtcttgcctctcagtcccacacaaggcagctgtctcacactatagaaaaaaatattcatgaacaaattcrtatctrtcacagtgaggrgtcacacyttaaacagcccatcgcatgctcaatacatccaatgcaaagaaaccccatagcacagctgtgtccactgttccgcccaacacccaacacacatcaggccctccaagctctcacctttacaagctgtgagrgacayatcagagccctgggcactgtcactgcctggggtagracaaaaacagaacctggtcagatcccacagaagatgtggctagaggaggaattgtgrggtgggtgrgctcccccaygggctcccaaacacaatatcccaaggacctcaggcatcagcctccttcatacttacttgcagcctgagagtagctccctccttttctatctgtgrgaagaaaatgtcctgtgagataccagaaaggagycagggccttaaggtcctagaggaacctccaagtcttggacctcagagaagtttccagaaatgtgtgactgcagacccagggcgggatcaggaaacatgaagaaagcaggtgtgggtcctggaccaaccgccctcctgaaggtcctcagggaccttcccctgtgacttgtgactgctgggatcaggtcccatcaccgcygtaatcaaggtgataaatctgtccttcattttaacaggtgctttacaaaagagtaagtgctggcacacagggcccaggctgggtaggcccataattgtggrtggtgcttcccagtaacgaggcagggcacacttctacctgggtcttggaaccctcagtgagacaagaaatctcagacccacccttcatcccttccccacctgagctcttcctcctccacctcacagcagcgaccacagctccagygawcayagctccaaagagaacyaggccagcaatgatgcccacgatggggayggtgggctgggaagacrgctctgggaaaagaggggaaggtgaggggccctgaccctgctaaaggtcagagaggctcctgctttccctaaaagacatgacacccccgtctccctccttaccccatctcagggtgaggggcttgggcaraccctcatgctgcacatggcaggtgtatctctkctcctbtccagaaggyaccaccacagmcrcccacttctggaaggtyccatcccctgcaggcctggtctccacragctccgtgtcctgggtctggtcctccccatcccgctgccaggtcagtgtgatctccgcagggtagaagcycagggcccagcayctcagrgtggcytcatggtcagagayrgsgtggtgrgtcatatgygtyttgggggcgtctgtcaggaagagtcagawcattcaggcattttgcatctgtcatgggacactcctccagcacacatgtggctatcttgagaatggacaggacaccygggatggggaagrgagcacagaacccagacaccagcctggacacaggcacctgggataatctyctattccgtggaaaattctagtccctgaagagggaacagcgacttctggtcctgacctgagtggaggctgarrgactcagaagtgctggactcagacccccacacacattgagtgtgaagcagagaacaaggcctgagaggaaaagtcacgggcccaaggctgctgcckgtgtgtgtcaaagggaaccactcatcagtattcgagggatcgtcttcccgtcaytccttcagagattttatcccttaattgtgtcagagagcagggcggaacctcagagtcactctctggtacaggatctggaaacccaggaggattcctctccctcaggaccagagggagggygatattctagtgttggtcccaattgtctcccctccttgtgggaggccagcccgggagatctacaggcgatcagggaggcgccccgtggccccyggtacccgtgcgctgcagcgtctccttcccgttctccaggtatctgcggagccactccacgcacgtgccmtccaggtagrctctcaactgctccgccdsayggrccgyctcccacttgygctkggtgrtctgagcygccatgtccgccgcggtccaagagcgcaggtcctckttcarggcgatgtaatccttgccgtcgtargcgtmctgsyggtacccgcggaggargcgccmgtccgrccccacgtcgcagccawacatymtctggayggtgtgagaacctggccccgaccccacggtcagcccagtcccccgagccccgtccggccccgaccaacccggggggatttttggcctaaactgaaaatgaaaccgggtaaaggcgcctgggcctctcccggggcaagggtctcggggtcccgcggcttcggggtggatctcggacccggagactgtgggcgaccyggcccgtccgtgggggatgagaggtcgtgacctgcgccccgggccggggtcactcaccgkcctcgctctggttgtagtagccgcgcagggtccscaggtycdctcggtsartctgtgmstgggccttsaywttccstgtstbcysgtcccaatactcmggmyyctcctgctctatccacggtgcccgcggctccatcytctggctcgcggcgtcgctgtcraacygcacgaactgcgwgtcgtccacgtagcccackgcgatgaagcggggctcyccrckgccgggccgggacayggakgtgdwgaaatacctcatggagtgrgagcctggggrcgagsagtggctgagaccyacccgaccctcstccmggcgcggcthcccsggtcctgcgtccccgccrggmgggcccsttgcttctccccrcagaggcsgtttccccmcgaccccgcactcaccygcccwggtctgggtcagggccagrrcccccragagtagcaggasgagggttcggggmgscatgayggccatcctcggcgtctggggagaatctgagtcccggtgggtgcgtgcggrctttagaaccgcgaccgcgacgacactgattggcttctctggaaacccgacacccaatgggagtgagaactgggtccgcgtcgtgagtatccaggaagaaggaccctacataggttggsagagggagaaaagaaactgcggagttggggaatccccaaggctgggactccccaatccatacaccgccttcggggcctgagacyctgagagccacgcctggggccctgggacttcgccctgacccctctgctyctgtgccaagckctctgtctcaatgtctccctgagtcttggcccaagagctgtctgagaaacaagggagaaaccctcggcatgggccccgtccctctcctttcacttttyatcccgtaatctctgtccctgaactggactccctgactcccactccttacctgtccacctggactcttctagaagaaaaatcaycccatggagtttggtgccagagagtaagmttgctctgggaatggaggtgtagatttttgttgttgttgtttttgtttttaatcgggaaragttgcgcctgagtgcatgagacagaatagagaccaatttgctctttgtttattaactacagtgggtagcagaatcttggtaacccctgaatgatcaggaatctaataggtaaaaaatgtgactttggccccttgatgtataaatgtgtccaaaagccttacaacaggactcacaaagctactaagttkcaytttcccagacaatgtayctgtgactcctgcttgtagtattttaaatttaccatcattccatagctctgagtttctgtgtgagtccaggacatctcctcaatacaaagtagcgactgtgttcctatatgttgcaaccagaagccattacaagctttattcacctcaaatttgcaactgttcaatgcagtcacaatgcccttcactactgctcatgcactgcctgtttttaggaagtatccacttctaagtgttgtgtatattttataggaacacttagtaatttttaaacctgattaacataaaaaattaggttttaggcagacccacatgaggtattaaargacaactgccaagracaccctgctaggctctgtagatkgatgtattaaaatccataaaacaatgtatttaaacctaagaattctgctgctttcaaattctttcctctgctccttttcctcacctcctgcttctccagcccttccctccatccttctcatccttcaggccctcctctccccttagtccccaccacactstcactcgtgaattgtgacactagcactgtcccatgacctgctacgtaactgttcttttcacagtggtcctgctcctgtgagtcagagtgtcatttctccacttaaaacactccagtgtctccacctcggtcttgtgaagcttctggagtttcaggcacttgagcatatgaggggatacctggttcattgtagggactaagttaatttttgttgacttaatgaatgaaatatgagtgtattaaattgcatcacagataattataaactgtaaaacacggaaaaagttcagaaagattttattttatgcaactagtgtgtatatcaattcatcagttcatttgcwcactaccacgcctggcaaaacaacacccatttatctgcttataattccttggtcagaaatctgggcaagatgtggatagaatctctgttctgggcttccaaaagctgtgttttcattttgaatcctccttcaggtttatacagaggtggcagaacgcagtttcttgcagttgtaagactgaggttcctgtttctggctagctgtcaatgtagagaactgggaggggctcaattcctggtgctcaccagcgttctttcctacacagccccttaattttttttttttttttttttttttttgagaccgagtctggctctgtagcccaggctggggtacagtggcccaatgatctctgctcactagaagctctgcctcctgggttcacaccattctcctgtctcagtcccaagtagctgggactacaggcgcccaccactacgctctgccaatttttttttttttttcttagtagacacagggtttcaccttgttagccaggattgtctcgacctcctgacctcatgatccgcccgcctcggcctcccaaagtgtcgggattacaggcgtgagccaccacgcccggcccatagccccttccttttcaaagcccctggtggaggaaacccctcatgctgagtccctctcacactgtaagtctctgtgctcatgaagaacccagtcctttcaagggctcacctgattaggacagtccaagcaggataaacccagcataaagtcaactaattgagacccttaattatatctgctaaatcccttcacagcagcacctacattagagttggttgaataactggaggaaggtgactgaccaggagctgcttgttgaggccatcatagaatcagcctagcaagggttggatcttccttttgtgtttaattgggacacagttggaaagtgaagttcaagtaamgtgatcattgtgaatggtcataaaatacatcctcttcagccatggaaattgtccttacyttttaaaactaagttacatgtttaatatcttataattaatttaggccaggtgtggtggctcacrtctgtcatcctagcactgtggaaggcagaggaatggagatttgttgactccagaagttcaagatcagcctgggcaaaacctccatctatacaaaaaattagaaaattagccaggcatggtagttcatgatggtagtcgcagctactcaggaggctgaggtcagagagtcccttgaccccaggmgttcgacactgcagtgcatggtgatcatgccactgcattccagcctgggtgacagagcaagaccctgtctcaaaaataataatgatgatgatgacacatttagagcaaatgcaatttratgtgtaataatacatcctctcttgtgaaaatatattatttactgttgcataacaaattacgtaaaacttagctcgaaacaacaaatgtttctcatctcccacagtttccaatcgtcaggaatccaggagaggtttccctgagtgcttcctgctcagggccgctcacaaggttgcactccagttgtcagccaggggctgcagcatctgagggcttctctggggctgggaattcacaagaaacatggatcagtcacatggctgttggaaaaggcctggttccttgttgtctgttcccagaaggcctcagttctcagtcatgtggaccttcctgcagggctgcttatggcacagyggctggcttcccccagagctcatgatcccagattcagagagagagagaaggtggaagccgcagttagttttatgttctacacccagagtcacaaactgttatgttggcactattctataagttagaagtattagtccattctcacactgcyataaagaaatacctgagactgggtaatttataaaggaaagaggtttaattgacycacagttctgcatgactgaggmggctgccccaggaaacttacagtcayggcagaagtggaagcaaacccgtccttcttcaygtggtgacaggagagagaaatgcacaatgaagcagggaaaagccccttataaaaccatcagatctcatgagaattccctcagcatcaggagaacagcatgggggcaccgcccccattatccaatcamctcccatgaggtccctcccccaataggtagggattacaatttgcataacaaytcaagatgagatttgggtgggagcacagaaccaggccatttcagaagtgcctcattaagtccaagccacactcaagagagggaattaagctgcacctctagaaaggaacagtatcaaaggatttgaatataygttaaaagcaaaattataactattgtttcaggtttctgaaaatcaaagtcttcttgtatctaattakttttcattaactctttaagcttgtcttttaatttaatttttttttaagttccagggtacatgtgtgtaggatgtgcaggtttgttacataaatgtgtgccatgttggtttgctgcacctgtcaactcatcacctaggtattaaccctggcatgcattagctatttttgctaatgatcctcccatcaccaccctcccccaacaggccccagtgtgtgttgttcctctccctgtgtccatgtgttctcattgctcagttcccagttatatatgagaacatgtggtgtttggttttctgttcctgtgtgagtttgctgaggataatggcttccagcttcatccatatccctgcaaaggacttgatctccttcctttttatggctgcataatattccatggtgtatatgtaccatattttctttatccagaccatcattgatgggcatttgggttgattccatgtctttgctattgtgaatagtgctgccatgaatgtaaacatgcatatgtctttataatagaatgatttatattcctttgggtatataccctgcaatgggattgctgggtcaaatggtatttctggttctaaatctttgaggaatcgccacactgtcactgtcttccacaatggattaaccatttacttttccaccaacagtgtaaaagcattcctatttctcygcaacctygccagcatctgttgtttcttgactatttaataattgccattctgactggcataaratggtatctcatttgtcgttttgatttgcatttctctaatgatcagtgatgggagctttctttttcatatttttgttggccacatgtatgtcttctttagaagtgtctgttcatgttctttgtccactatttaatgaagttttttttcatgtaaatttgcttaagttctttgtggattctgaatactagacttttgtcagatgaacagatggcaaaatttttctcccattctgtagcatgtctgttcactctgattgatgatagtttcttttgctgtgcagaaaaaaattgcctaatctgattgcttttcatttacaaaaatgwgaatctcatacttcagtyaacacatctagyttagcatgatgccaataaytttggcttgatgctgtagcccgaaatggttagctygaattgagagacaagttattttcaaaaactggctatccratgggcattctataacacacttaacatcttttgttgtggtattgaatgagatgtgatagaagtgatttggacaccactatgattctaaatagcactgctattaygtgcttctgaattttttttctttttagcagtcytattctgtttccattcatatttgctattccatcactgggtattccttcctackcttttcatgtttcatttattttgatcartgatgtgcatttccaattctgtaaaagtttaattcmgttgtatgtgtggtaaaatgtaacrtmgaatctttgcaagatgaaattaccttgcayagcatattgaacattgtattattgaaaatctagagagaygccagtgagccaaggatcgaatgacctatatgtagccaaggccgttttcatggcatcctggtcctctctgtcacatagctccttacaattctctgtggttttcttccaatgtaagtagttcttgttaagaatctttgcaatgaactttgaaattcttttctttttcatttctataaaaaacaggtatattttaatttggaaaactctgtttaaggaattataatcaagtaactaccagggkgcccagcactggtgtaaaacacraaactgtaaaacwaccctgggctgctacccagtcatcctccagaaggagacygttgggagcaagtcccccaaaatctggtcataaactggccccgagactggccataaacaaaatttctgcagcaccataacatgttcataatggccctagcacccaagctggaaggttgtgggtttacgggaatgagggcaaggracacctggcccgcccagggtggaaaaccacttaaaggcattcttaagccacaaacaatagcatgagtgatctgtgtcttaagggcatgttcctgctgcagttaactagcccaacctattcctttaattcggcccatcccttcgtttcccataagggatattttaactaatttaatatttatagaaacaatgctaatgactgtaataaatatgtgggtaaatctctgtttggggctcagctctgaaggctgtgagacccctgatttcccacttcacacctctatatttctgtgtgtgtgtctttaattcctctagcaccgctgggttaggatctccctgaccgagctggtctcagcagaagactccatgctgagtcttgtgatacttattcctttgtatttcttcaaagatttgtgcaataagtatatatatacacatatatgtgtatatatgtgtatatatatacatatatgtgtatatatgtgtatatatacacatatatgtatccatatatgtatatatgtgtatatatacacatatatrtatccatatatgtatatatgtgtatatatacacatatatgtatatatgtgtatatgtatgtgtatatatacacacacacatatatatatgtatgtrtgtatatatatrtatccccaaaacaaatatcagttkgttttgctggtttttaagcttcctgtacagcaagttcctactgcmtttattttcccatgatgcacattatgtgtaggagttatctgtggtgtgggagrctgtcattcattcatttttactgctgaaggcttacatatggttataccacaatttcactagtttcctattgatgtatatgtggctgattccagtttttgccataaatattagtgtgcrtgtctcctgtgcacataggcaagaaagccccccagagtggatgattaggaatgggttggttggatgatasgttgtatggactttaaccatastagataatgataatamraattscaaagtgattgtggctacttaaacttttacaataaatgygtaatacttgatgttgatgatgtgttctgaaaacactgbgttgaaggaattgagttaaaagccactgtcktggctgtagaattatagcrggcatttttattcagactctgttaataacttcctgttgtttacttgtttctcatatacatgacattatatttttgacatatagattcagaaaatgcttacttacarcccaatcacatagagttattktatatattaggaaaatttcataataaaaaggaaaaaatggaggaagagagagaaagaaggaggaatggaggaaaaagcaaaagaagaaaagaaggaaggggaggggaaggaaagggagaaagaaggagggaaggcgatagkttgaatggaaatagagaagaaagagatggagggagggctagaaggaaggagaaagggaaggaagaggycaggcacagtggctcatgcctgtaatcccagtctttgggaggcygaggcaggcagatcacgaggtcaggagatagagaccatcctggctaacatggtgaaaccctgtctctactaaaaayacaaaaaattagccgggcatggtggcaggtgcctgtagtcccagctacttggaaagctgaggcaggagaatggcatgaacctgggaggcrgagcttgcagtgagccgagatcgagccactscactccagcctgggcgacagaacgagactttgtctcaaaaaaaaaaaaaaaaaaaaagaaaagaaaagaaaaaagaaaaaaaaaggatggaacaaaggagaaaagaaactaaaataaagaaaagaataggtgttgagaaactagaaacctatgtgtggctaatattatcaaaataggagaaaataaaacagatgtagttaacctctagagaataatggaaatgtaagagggcttcattagttatccattgctgtgtaacaaactackcccaaatttagtgacttgggatcactaaatgagggatcdtgttccmgtcattccctcagagattttatcccttaattgcgtcttcccgtcattgcctcagagattttatcccttaattgtgtcagagagcagtgtggaacctcagagtcactctctggtacaggatctggaaactgaggaggattcttctccctcaggaccagagggagggtgatattctagtgttggtcccatctgtctccyatccttgtgggaggccagccygggagattacaggcgatcagggaggcgcccgtggtccctggtacaggtgtgctgcagtrtctccttccygttctccaggtatctgcggagccactccacgcacstgccctccaggtaggctstctgctgctccgcctcatgggccgcctcccacttgcgctgggtaatctgagccgccatggccgccgcrgtccaagagctcaggtcctsstttagggcgatgtaatctttttacagagaatcstttttacagagaatggggagataaccaggacaggatttatggacccagtgattccaccrtggggcataatttgtccaggttwattccctggcctctgtaagccccactgtgatagggacataatggtgctgtgggaatctgggcagcaatgttagctcacacccaatgttaacacttatcccatctcctgattaaatggctataggctcctttgcagaagggctgatggaattgtcccagcatgtaacagtcatggtgtcccaaggttctttctcttagggatatggatacttcctcagccactggattctgaatrtgaagcttgctcctcaattcttttttttttttttattgatcattcttgggtgtttctcacagagggggatttggcagggtcatgggacaatagtggagggaaggtcagcagataaacaagtgaacaaaggtctctggttttcctaggcagaggaccctgcggccttccgcagtgtttgtgtccctgggtacttgagattagggagtggtgatgactcttaacgagcatgctgccttcaagcatctgtttaacaaagcacatcttgcaccgcccttaatccatttaaccctgagtggacacagcacatgtttcagagagcacagggttgggggtaaggtcacagatcaacaggatcccaaggcagaagaattttccttagtacagaacaaaatgaaaagtctcccatgtctacttctttctacacagacagggcaaccatccgatttctcaatcttttccccacctttcccccctttctattccactaaaccgccattgtcatcatggcccgttctcaatgagctgttgggtacacctcccagacggggtggtggccgggcagaggggctcctcacttcccagtaggggcagccgggcagaggtgcccctcacctcccggacggggtggctggctgggcggggggctgacccccccacctccctcccggatggagcggctggccaggcggggggctgaccccccccacctccctcccggacggggcggctggccgggcagaggggctcctcacttcccagtaggggcggccgggcagaggcgcccctcacctcccggacggggaggctggccgggcggggggctgaccccccaacctccctcccggatggggcggctggccgggcagaggggctcctcacttcccagtaggggcggccgggcagaggcgcccctcacctcccggacggggaggctggctgggcggggggctgaccccccaactccctcccggagtgggtggctgccgggcggagacgctcctcacttcccagacggggtggctgccgggcggaggggctcctcacttctcagacagggcggccgggcagagacgctcctcacctcccagacggggtcacggccgggcagaggcgctcctcacatcccagatggggcggcggggcagaggcactccccacatctcagatgatgggcggccgggcagaaacgctcctcacttcctagatgggatggcggccaggcagagatgctcctcactttccagactgggcagtcaggcagaggggctcctcacatcccagacagggtggcggccgggcagaggctgcaatcttggcactttgggaggccaaggcaggcggctgggaggtggaggttgtagtgagccgagatcacgccactgcactccagcctgggcaccattgagcactgagtgaacgagactccgtctgcaatcctggcacctcgggaggccgaggctggcggatcgctcgcggttaggagctggagaccagcccggccaacacagcgaaaccccttctccaccaaaaaaatatgaaaaccagtcaggcgtggcggcgcgcgcctgcaatcgcaggcactcggcaggctgaggcaggagaatcgggcagggaggttgcagtgagccgagatggcagcagtacagtccagcttcggctcggcatcagagggagaccgtggaaagagagggagagggagaccgtggcagagggagagggagaggcagagggagagggagagggagagggagagggagagggagagggctcctcaattcttacatgcttatcatagatatcaagcagtgctcttgctgtctgcccatcttttctgaccctgggacaccaccctttattaagctttcccataactccttgaaggtcaagcccccttgactgatactctgggttatcacagtaagtgtgccctctatctttttcaggtcactgaaaaggagggttcctaaagcattcactcctgaccctgagggaggtgggtgcactcactccgggactcaggtgcaccacagataagcaaaaaagtcctcacattcaraattgtcytgggccacatgcagcccacgagcygcgggttggayaagcttgcatctagaacatatrcaccayaaggcccgaaatttttctgtttttactttaatgatgctttctaaatgcaaaaacagtyatatacctagcagaaacaaatgtcagttgaaggaatgatcatagagaaccactctattctagaggcaatatctttattaatgtagcctcaggacaaatgctttatttttgtggcagctacagaacaacatcatctcacactgacatcagtgccacyrgakcttttctcaccagggctgcttgtgtgtcctccctccctccctccctccccccacacyaactctmctgcacactgcagcacacaaccatatttttctcttcaggaaagataaccctaggcttatgggtccaattttccaaccacatatgaatctaaactagactctgctttataaattgatgagtttctmttggagccagcactaggattactacaactcagggcaggaagaagagtaggagwgcagaagaggagttccaacagaaagttacctatgatgagaaactaygggaccctgcctcttggcraatttcagaatctggttcctttaaaaagattgcagaaaagatggaaaatacaatgaggaaagagccctgggaagasggcaagagcttgaamgatctgaaaatttgtctcttgataccacaaggaccctggwrtgcagggactgccrtaggtgacatccaagtccctgtgatcacaggtcatggtgggacaaggttctactgaagggccaagtgtgggtggaggattactcaggtgccgaggcaagagactgaaggcacaaactgttttagtataataaagaaaatagttagaataagaatagtcataatacaaattagatatagagatgatcatgaaaaattatcaatcattattataaacattattaatcattagcttttaatattactctttgttgcattactaagataacctaggaataactggcrggcatagggtcaggtgctgaagggacattgtgagaagtgacctagaaggcaagagatgagccttctgtcacgcccgcataagggccgcttgagggatccttggtcaagtggcaatgccaatgtctgggaaggcacctgttacttagcagaccaygaaagggagtctccctttcttggaggagtcrgggaacactctgctccaccagcttcttgtagaaggctggatattatccagagctacycgcagtcatccagaggcctaaacccctccctgtggtgctgtgcttcagtggtcatgctccttgyccactttcatgctcctcctgtactcctggttcctctttgaatttcrtagtagawaatggtagaagaaatagtgaaagtcttaaagtctttgatcttaagtgcagaaaagaaaatggtgacatatgctacctaaaagggaagggccccctatcctgtaatcacgtgacttgcttcaccttgtcaatcagttagaagattcaccttccttaccctgccccttgtcttgtatgcaataaatatcagcgagcccagctgttcggggccactaccggtctccgcatcttgatggtagtggtcccccsggcccagctgttttctctttatctctttgtcttgtgcttttatttattacaatctctcatctccgcacacggggagaaaacccgctaagycccgtagggmyggatcatacagccaaggacaacrgagcagcaaagatgacccagctgagcagtgaccacataaagygcacggtggcctgagcacccactgggcacagccccatctactctcctctcatgcaacaaatcagcataagaaacwtgtggactctggaaggttctcatgtcttccatttattttgtctctcaaattttaggaatcttctcctttaattarcccatcaacctctcatggcaagaatttgaaaaagtaaatttatactcagattctaattttaatarggaagtaagaagttacagctcagtgcacataaagttgagayagagatggagacatctcagcctcacstctatggagcaggaatgattaattattggagasggaacacaggtcagcatgagggaagaggrtcatggtggacatgggggtgggttggtctccccacctcctcatattatgcctacaggaacacaggcacattcaggtgcctttgcagaaagwgagtcagggtttttgaagtcacaaagggaaggcgtgaacaaatcttgcctctcagtcccacasaaggcagctgtctcacactataaaataaaatattcatgaacaaattcatatccgtcacagtgagggrtgacactttaaacagcccatcacatgytcaatacatccaattcaaagaaaccccatagcacagctgcrtccactattgcccccaacaccccccacacatcaggtcccccagyktctcacctttacaagccrtgagagacacatcagaaccctgcgcatggtygctgcctggggtagaacaaaaacaggacttggtcagagcccasagragatgcggctagaggaggaatctggggttgggtgagctcccccatgggctcccgaccacaatatcccaaggatctcagggatcagcccacttcatacttacttgcagcttcagagtagctcactctatctgtgggaagaaaatgtcctatragaggccagaaaggagtcagggccatacggccctaaacaaaccccctagcctttgatccyagagaagtttcctgaaagtgtaactgctgatcyaggacaggatcaggaaacatraggaaagcaggtgtgggtcctgraccaactgccctcctgaggtctgtcctcagcagggaccttcccctgtgacttgtgactgctgggatcaggtccccatcatcataatcatcaaggtgataaatctgtccttcaktgtcacaggtgctttacaaaagagtaagtgctggcacasagggcscaggctgggtaggcccatgagtgtggatggtgcttcccagtaaccaggcaggacacacttctaactggggcttgaaaccctcagtgggacaagaaatctcagaccccactcctcatccattccttacctgagttcttcttcctgcacatcacagcagaaaccacagctccagtgactacagctccaaggagaaccaggccagyaacgatrcccacgatggggatggtgggctgagaagactgctctgggaaaaaaggggaaggtgagcgtccctgaccctcagcccccagcaccgaccctgctgaagttctccagagaggctcctgctttccctaagagacatgaccccccctccactmatctcytrcctwacyccatctcagggtgaggggcttgggcaacccctcatgctgcacatggcacatgtatctctgttcctctccagaaggcaccaccacagctgcccacttctggaagtttccatcccctgcaggcctggtctctacaagctccatgtccygagtctggtcctctccatcctgctgccaggtcagtgtgatctccacagggtagaagcccagggcccagcacctcagggtggccttatagtcagagayggaatggtggatcatatgtgtcttgstgggggggtctaacaggaagwgtcagaaaattcaggcactttgcatctctcatgagacactccagcagcacgcatgtggccatcctgagaatggacaggacacctggggtggggaagggagcacagaacccagacrccarcctggacacaggtayctgggataatctcctatccgtggaaaattcyagtccctgaggagggaacagtgwcttctggtcctgacctgagtgsaggctgagggactcagaagagctggactcagacccccacacacattgagtgtaaagcagagarcaaggcctgagrggaaaagtaacggggcccaaggctgctgcyrgtgtcaaagggaacccctcatcagtattycagggattgtcttcccttcatttcctcagagatttcatcccttaattgtatcagagagcagggcagaccctcagagtcactctcttgtacaggatctggaaacccaggaggattcctctccctcaggaccagagagaggacgacattctagtgttggtcccattttccttctctctttgtgggaagccagcccaggagatctacaggcgatcagggagrcgtcttgtgttccctggtacccgtgagctgcagcrtctccttcccgttctccaggtgtctgcgagcctctccacgcacgtgccctccaggtaggccctgatctgctctgcaaattcttctgcctcccacttgcgcttggtgatctgagcckccatgtccgccgcggtccaggagcgcaggtcctagttccgggctatgtaatccttgccatcgttggsgtgctgttcatacccgcggaggaggcgccsttccagccccragtcgcagccatacattatctggagggtgttagaccctggccccgcccccgckgtcagccccgcccaccgagccccgcccccgccccgaccaacccgcggggattttggcctaaackgaaaatgaaacctggtaaaggckcctgggcctctcccgggtcgaggatctggcgggtcccgcagcctcggggtggrtctyggagccggagactcgcgggggggacccgggrcgtccgtgggggatgaggaggggtcgtgaccttcgccccaggccggggtcattcaccggcctagctctggtggtagtagcggcgcggcatgggcaggttcactcttgtcagtctgtgcgcgggcctgatgttcsgtgtgctccggtcccaatactccggtccmtcctgctccaaccackgcgmctgcggctacatcctcggagtcgccgcgtcgctgtcgaaccgcacgaactgcgtgtcgtccacgtagcccactgcgatgtaccggggctccccgcgacccggccgggacacggcggtgctgaamtaccttatggagtgggwacctgggggcgaggaggggctgagacccrtccgaccctcctccttgmgckgctccccgggtcctgcgccccagtgcgcgggcccctasctcctccccgcagaggycatttccctccggatcccgcactcacccgcccaggtctcggtcagggccagggcccccaagagcrgcaggaggagggttygggwcgccatraccccatcctcggcgtmtggggagaatctgartcccartgggttcgcggggacttctggaacagggaccccagcgacgccgattggcttcgctagaaacccgacaccaaatgggrgtgagaactgagtccacatcctgagtgtccaggaagaaggaccctacataagttgggagagggagaagagaaactgcggagatggggaatccccaaccctgggcctccccaatcaatacawcgccttcggggcctgaaaccctgaragccacgcctggggccataggrcttcgccctgaccccgctcctcctgtgccaagcgctcwgtctcaatgtctccctgagtcttggcccaagagctgtctgagaaaccagggagaaaccctcgtcatgggccccgtccctcttcatttttcatcccggaatccccgtcccagaactggactccctgcctcccactccttacctatttccctgaactcttctagaaaaaaactcaccccagggagcttggtgacagagagggagctcgmcgccagagaggcagagctcgccctgggaatggaggcgtagagacaggtttttgttttttttttctttaaatccggaaaagttgtgcctgagtacatgagacagcatagagacaagttttctctttgtttattaactacagtgggtagcagaatcttggcaacccctaaatgatcaggwatctaatcggtaaaaaatgtaactttggccccttgatvmataaatgtgtctgaaagcattacaacaggactcacaaagctactaagtttgactttcscagacaatrtatctgtgactcccgcttgttttttacatttaccttcattccacagccctgagttactgggtgagtccaagacatctcctcaatataaagtagcacactgygttactatatgttgcaaccgggagccagtacagactttattcacctcacagttgcaartgttcaatgcagtcacaatgcccctcagcagtgctcatgygctgcctgtttttaggaagtattcacgtctaagtggtgtgwatatcttataggaamacttagtatttttaaaacctgattaattaaaaaaaattagtttctaggcagtcccaaatatagtattaaaggccaactgcaaagaaggaacactaagtrttttttaaaccttattaacataaaaaacattagtttttaggcagtcctacattaggtattaaaggccaactgcaaagaacactgagcgaggctctgtagatggatgtaataaaaatctataaaacaatgtgtttaaacctaagaattctactgctttccaattccttccctctgctccttttcctaacctcctgcttctccagcccttccctctgtccctttcayscctcaggccctcctctccccttagtccccaccaccctgtcacttctaaattgtggctctagcattgtcccattacctgctamgtgactgttctctccacagtggycctgctcctgtgagtcagagtgtgtcatttcctcacctaaaacactccagtggctccacctcggtcttgtgaagcttctagaatgtcaggcacrtgagcatatgagggcatacctggttcatcttaggcactaaattaatttttgttgactgaatgaatgaaatatgaakgtattaaattgcatcacagaaagttataaaatgtaaaacactgaaaaattaagaaatattttatyttatgtaactagtgtgcatatcaattcatccgagtctgttgagcctgtgtatgaattttataagattgcataacaaattatcacaaacattgactttaaacaacacccaattattgttgatttatttgtttttagagacagagtctccctctgtcatccagggtgaagtgcagtcacatgatcatggctcactgcagcctcaaactcctgggctcaagggatcttcctgcctcagtcttcagartagvtaggactgcagrcaagtgccaccacdcccagcwaattaaaragaaattgtagagatgagtgtctcactgtttgatcttggctggtctcaaaktcctggatgcaagtgatcctcctgtgtcarctyctcagatgttaggattgcaggtgtgcattaccacgcctggccaaacaacacccatttatctgtttatagtaccttagtcagaaatctgggcatgatgtggatggaatctctgttccgggmttcccaaagctgtgttttcattttgaatcctccttcaggcttatacagaggtggcagaatgcagtttcttgcagttstaagactgaggtccsbgttccttgctggctgtcaatgtagagaacagggagggctgygctcaattcctgatgcccaccagbrttcttccctgtacagccccttcattttcaaagcccacagtggaggaaacccctcatgctgaatccctctcacactgtgaatctctatgctcaggaagaacccartcctttcaaggactcacctgattaggacagtccaagcagcataaacccagcctaaagtcaactaattgaggcccttaattatatctgctaaatccvttcacagyagcacctabattagagttggttgaataabdgggggaaggtgaatgaccaggagcttgttgttgaggccatcatagaatcagcctagcaagggctggrtcttctttttgtgttcacttgggacayagttgcaaaytgaagttcaagtaaagtaatcattgtgracggtaataaaatacatccttttcagccabgraaattctccttaccttttaaaactaagttacatatttatatcttttaattaatttaggccagatttggtggctcrcacctgcaatcctagcattgtggaaggcagaggaaggcagatttgttgactccagaagttcaagatcagcctgggcaacatggrgaaacccccatctctacaaaaaabtagaaaattagccaggcahrgtggttcatgattgtactcccagctactcaagaggctgaggtcagagggtcccttgagcccaggaggtctacactgcagtgcatggtgatcatgccactgcactccagcctgggtgacagagtgagaccctgtctcaaaaataataataatgatgatgataaatttagagcaaatgcaaattaayatgtaataatacatcctstcttgtgaaaatgtattagttatttactattgcataacaaattatgtaaaatgtaccatttcaaaabaacaaatattgatcatctcccacagtttccarttgtcaggaatccaggagaagtttccctgagtgcttcttgctaagggcmtctcacaaggttgcagtccagttgtcagtctaggcctgcatcatctgagggcttcactgsggctgaggattcacatgaaacatggatcagtcacatggctgttggaaaaggcctagttcrttgtaattgrgtcccagaaggcctcagttcttagccagatggaccttcctgcagggctgctcatggcacagcagctgactttccccagagctcatgatcccagagacagagagagagaaggtggaagckrcagkgagttttaggttctacacccagagtcacaagctgttabgtcggcattgytcmatcagttagaagttgtattagtctgttctcacactgctataaagaaatacctgagactgggtaatttataaaggaaagaggtttaactgactcccagttctgcatggctgaggaggccrccccaggaaacttacaatcatggcagaagtggaagaaaaccygtccttcttcacatggtggcaggagagagaaatgcagagsgaagcggggaaaagccccttrtaaaaccatcagatctcatgagaattcactcactatcattagaacagcatgatccaatcacctcccatgaggtycctccttcaatactggggattacaattcgcatgacaattgragatgwgatttgggtgggaacacagaaccaggccatatcagaagtgcatcattaagtccaagccacactcaagagagggaattmrgctgcacctctggaagggagcagtattaaaggatttgcatatatgttaaaagcaaaattcaaactattrtttcaggatttttaagttaaaggcttttaatctaaytatttttccttaacattttaatcttgtcctttaatttaatttagtttaatkttaagttccagggtacatatgcaggatgtgcaggtttgttacacaggtaaacgggttccacggcagtttgctgcaccaatcaacccataacctaggtattaacccctgcatgcattagccatttttcctaatgctccccccaccaccgccctcccccaacaggccccagtgtgtgttgttcctctccctgtgtccatgtgttctcattgttcagctcacaattataagtgagaacatgcggtgtttggttttctgttcctgtgttagtttgctgaggataatggcttccagcttcatccatatccctgcaaaggatttgatctcattcctttttatggctgcataatattccatggcayatatgtaycatattttctttatctagtccctcattggtgggcatttgggttgattccatgtctttgctgttgtgaattgtgctgcaatgaacaaacayatgcacatatctttatartagaatgatttatattcctttgggtatataccctgcaatgggattgctgggtcaaatggtatttctggttctaaatctttgaggaatcaccacactgccttcctcattggttgaaccaatttacatttccaccaacagtgtaaaagcattcctatttctttacaacctcgccagaatctgttgtttcttaactttttaataattgccattctgactggcatgagatggtatcttattgtggttttgatttgcatttctctaacgatcrgtgatattgagctttttaaaatatgttttttggccacctgtatgtcttcttttgagaagtgtctgttcatgtgctttgtccacttcttaatgaagttgtttttttcatgtaaatttgcttaagttctttttagrttatgaatattagacctttgtcagatcratagattgcataaattttctcccattctgtaggttgtctccttttcgctctgatgatagtttcttttcctgtgcagaagctcttttgtttaattagatcccatttgtcaatttttgcttctgtggcagttgcttttggcaatttcatcataaaatctttgcccatgcctatgtcctgaatggtattgcctagattttctttcagggtttttctagttttgggttttacatttaagtctttaatccatcttgagttaatttttgtgtaaggtgtaaagaaggggtccagtttcaattttctgcatatggctagccagttttcccagcaccatttattaaatagcgtttcctttccccattgcttgtttttgtcaggtttgttgaagatcacatggttgtagatgtgaggtcttatttctgagttttctattctgttctgttggtctatatgcttgtttttctaycagtaccatgctgttttggttactttagccttatagtatagttttaagtaggatagcctgatgcytccagctttattctttttgcttagcattctcctggctacacaacctcttttttggatccatatgaattttcaaatttttttttctaattctgtgataagcttctctttttaaattaatgattaaatgtttgagacatgacagagccttgggtgctgcagrgaaaacagtttgagacagagaaaggagaaacaacagtatctctgmgtttytcttgtaaatacctttaataacaatgttyttcaataagttaacacagttgagaacatagagtaactagatcaaatagttccaagacttcagtgccataaraatsatgccttgaaaataagtctttgttttgtctaagatgtctcaaatttagtggaagtatgccccaagygccaattttcttattgacatatcatcttcagaaaacatttgcctacacttaaaaaaaaaatacacacacactgctctgtctatggagtagccattcttttstttctttacttctctaataaacttgctttcacttagaaaaaattgcataatcagattgcttctcatttayaaaaatgggaatctcatacttcagtcaacacatctagcttagcataatgccagtaactttggtttgatgcagtagcccaaaatgcttaactcgaattgagaatcaaattttttccaaaaayggctcaggggcattctattgtaaacttaacatttttkggtgtggtattgcatgagatgtgrtagaagtgatttggacactactacagttctaaatagcactgctrttatgtgcttctgaagytttctttttyttttttttttagctgtctkattttgctttccattcatatttgctattccatcactggttgttcctttctactcttttcttgtttcatttattttgatcagtgatgtgtatttccawttctgtgaaagtttaattcagttgtatgtgtggtaaaatgtaacaccaaatcctttgcaagaaggaattaccttgcacatcagattgaacattgtatacttgaaaatccagaragaygccagtgagctaaggatcaaatgamctattattaaccaagrccattttcatcacatcctggtcctctctgtcacatggctgcttacatttctctgtggttttctttcaatgtaagtagttcttgttaaggatccttgcaatgaactttggtattcttttctctttcatttttataaataccaggtatattttaatttgaaaactctgtttaacaaattayaatcatgtaactaaaaagatgcccagcactggtgtaaaacacaaacctgtaaagctcccctgggctgctgcccagtcacatcccccagagagagactccatcctgagtcttgtgatccttattcctttgtatttctttaaagatttgcacaatgagtatatatatatatatatatatatatatatatatatatatgtgtgtgtgtgtgtgtgtgtgtgtgtgtgtgtgtgtgtgtgtatatatatatatatatacacacatatatatccaaaaaaaattatttacttctgctggtttttaagcttcctgtacagcaaattcctactgcrtttattttcccatgatgcacattacgtacaggagttatctgtggtgtgggaggctgtcattcattcattttcactgctgaaggtttacattttatgccacaatttcctattgatrtatatttcctattgatgtatatgtggctgattccagtttttgccataaacatmagtgtgcctgtctcctgggcacataggcaagaaagcccgctagagtgtrtggttaggagtgggagggttggamgatatgttgtatggactttaaccatactagataatgataatatgatttccaaggtgattgtgtcaacttaaactcatgtgttctgaaaacacctagtygaaggaattgagttaaaagccactgtcttggctgcagaattatagcaggcatttttattcagactctrttaataacttcctgttgtttacttgtttctbatataccatggtattatacttttgacatatagattcagaaaatrcttactgatarcacaatcamgtaggggttatttaatatgttaggaaaatttcataataaaaaggaaaaaatggaggaagggagagaaagaaggaggaattgaggaaggagtgaaagaagaaaagaaggaaggggaaggggaagaaaaaggacggaaaggaggaagggagaaggagggbgagagatwgaatggaaktaaagagggaaggagggacagaaggaaagagaaaaagaaggaacaaaggagaaaagaaactaaaataaagaaaagaataggcgttgggaactggaaaccctctgtatggctaatattatcaaaataggaggaaataaaatagamgtagttaacctctatmgaataamggaaatgtaagaaggctdcattagttatctgttgctgtgtaaaamactacccccaaatttagtgacttacagcaacaaacattggtgaactcaaaaacataatacaaataccagcaaaatggagccaatgcargtagaagaagttgaataaacaaaaagattttacacgttggaataagtaagaggtcactggtgtgcagacgaaaatgattttgtagtccaaatgcthcaaaaagcaagtrccatcatrrgattaaagttacagcattttattaggggacacacctgtcagacgatatggkgagggaggtaggttaccctgggaaaggcaatagaataagatgcaagtgtgacccccagtgatggaaagaaggaaggaaggattacttaacatgtcctagaccacaggcaatctaaggagagttgagcaaggchatggaggagtcctccagccacagctggccatcagaggagtcccctgtcttccaggaatgtcctgccttagtgtcactggtgtgacccatcactggttgggaatagtccatgggaagcagggcctcagcaccaatgccactgaggatgtcagagcacaggrgcacrgchttggaggattacccaggagtgtgactcaaaccttctgccctgatgggtctgggcccttgraaatcaaatcctctcaggctgaattgctggataattctactcwcacttgcaatggggtgagggaaaacagaaggcccccaggtggatctctggtttccacacttctgcctttattgtgtgaaagtagccatgcctchtcctggggatgaggatctattacctgggcctggagaggaggagackcctcttctcaccaggtggtctctgggcatatactgtccacacttctctggtgacamacttaatgtgtagttcagtgggctgtcttttgtctscttttaagggtaccctcctttgcaaaccaggacctcrbaccctgcacagcccagtgttctgagataaaacatgtcaaataccccattasgtgaatctaarasattagacatggagccatacytgcttccaccgtttgatttctggacccacatgttcttcctcttgcraacacagaactgtagagacdactctgatttaaacaacgcaccatgtcctgaaagatggcaygcaaccctcagagtgyttcctccaggctggcacttagttgtgcctgtggaagatcacgggactccaagcaactatgtggttccaagtgcctgtgtgacccagaaagtcatagattgcacaggccaaacagcattcatcatraggtgaaaatgrtccacctgggttgagcttgaatcccatgttgacacccacagaaaacagccaagtctgaagtgtcattaaacaaygaaacagacmaatggaagytagccagccttcactatgggtcagcccatgcatgataggatgggcacatgaatggaacaaccacagtggcaggtgtgaggctacatatggggcattccttgtggctggcagcccctggggagagtagctggtgatagggttagtggaagsaacagccatggaaacactgaatctttcccttgccaagtggrtccttcaggcagataatgggctaggagcactgcctagcctgcagaccaggaatgtcaacagcabcyagagartggtactggctrtgtctgagagcaggacagaaaamcccccctagaataggtacctaaccctgtgaagatgaacctctggtccttccaggatggaagtaggtaaatgtagtcaacttcttagttaatgrctagtcacctaaagaaatagtgccccactagggcabatcatgggcctaaaatgctgatgagttggacattcagaggtggcagcagctggatctgccttggtagggggaagtcagtgctgctggcmctcatgcctgccactgtggttgctccattcatgcacycatcctaccaggcctgggctgacccatggtgaaggctggctaactkccatttgtctgtttggttgttcagtgccacwtcagacttgggtgttttctgtgggtgtaaacgtgggattcaagctcaayccaggtggaccattttcacttcatgatgaatgctgttgggcbtgtgcaatktatgatgttgtgggtcacaaaggcacttggaaccacatagttgcctggtgtcctgtggtcaagcwttctatcaaatcagkacaaggaacactaaaagttgcttctaacagggggcatatgtctctgctgtggatgayahgatcttactccagaatcccaggcccttcactgtgactctbccactggtgcttggttcwgctccatcctgcatctttccccacmactggcaccaccagccccagggggtctgagggacgctggctgctygcaccatggcctggatctgctgcagsgtcctttcctgtgtaggccctacttgaagctggcctcctcctatrtcacctagagtgtttgccaaagcacgtacctagatgtggaatgtggtgttgtcagaactcavagaggctcatcaggcagtgtgcttccttccttctggtgaggatgcaagatgaaacagtttgtcttttaccttggrgggaacacacctgcattcccctaaacacttggcacttgttaacccataaaacttcacttcagtggccactcttgaagctctgtaaggtttatcttcacatactggagtgcrtgtgttttgccaatgactccagtgcactttctacctgctgctcattcaccgcagtcaacatgaagttgtcagtgaaatgagctgatttaatatcctatagaatatccagtatgtctagtattgtctttagaccatactatataggghaggggagttacaatagccctgagaaaaaactataaataaatgtgttgtggatcccacatggatgtgaatcrctccatatcccctttctaattggagtggaragaaatgcactcaccaaatccatagctgcacgctgtgtgcccraggctttattattctgctctgcagtkatatccagacaacataaaagctgcaattataattcctgcttggccagrcctggagtaatctcattcattctttagtcctcatcaggsttcctcagggacaggttgctggattatgtagagacaatrgacaaccccaacaccatcccacatccttcagctctctaatggtggtgtgacbcccacattactttcagtgtcttcctcaagacacaccctgggacacactatgattttttttttttttttttttgccagratgtgggcagcgtcagaggtttccctttggctttcagcacaatgagadtcctgactccacagactagggacccagtgtgggggtgactccacttaacagtgcatcagtgtyaattatgbactcagggaattggaagataaccagggctgggtctatggawccagtagttccattgtgggcbgtaatgtgtccaggtttactccctgacctccgtaagccccactgtgatgggagacatgatagtgctgtgggcatctgggcatcaatgtcagctctcactcagtgtcaataatctgahcagttctgcatctttcctttcgccagtgtacaatctcctgagtaaatggctataggtwcctttgctgaaggactgagggamttgtgccagcatttacttccacggrgttgcagggtattcctcctagggatatggactcctcctctgtcactgggatctgaatctgaactttggctgaggtctaggcattgaggatgggatcatgactttgtattgggtcaaacaccttcaccctcctgcttctcaattcttgctttcttatcatagatatcaagcagcgcccttgttggcttcctgtcctaatcctgggacavcaccctctactatccttccccacattccctgcagcttgagtcctattggctactccttttagtttgccatagtaactctgccctctggctttttcaggtcactgccaccatttggtctttgtstcttcagggccacactctccccagggwtattaataaatgbaactctgggtcatctttactaccatcacvbccagcctgcagaggacaacaccccgacayttcttartgatgcaggtccctctcaccatcacgtttctgaggctctggtggaaggtgtttcctttggacbstcttgtggagcatggtactggtgggccttcaccatgcccacttccctcagccttgttattccatcctgtgcaagttccagggcaactaagthahgtctaccttgttgagagttrggcatcattttttctagtctatatggattcaccccagcrgtgggtttggccccccscttatcaaagtcctggggtgtttgataaacccatgccttgagaaagtgcctccaagccaaaggatttttattcttccagvttgaaattctggttccttgatcaaacaccctcaaattccaatcccagaagtgctcctcrgcctcctatggggacgtgccagctagttcctgcaaagctcttcagtgggattcctgctgtatcatgggggtgagacttctgtagcatcttccagcataggaagtgggaaccattactagagaagggtgagcctcctatgcatgcccagaggatcctggagggcacccatcggataaccctgttcctgtttgcagaatctcaggtttccccaccagggtcctgactttcctstaacaggcctgccttggctgagtggcaaacctctctggagcactgtggccctcatartgatgtcttcagctaccattccacggtatctgccctttcgctacaagagataaagacctstgcatgagacactgcagaggctgtcacatgtagccagtgacagctgttaacaatctgcagattctcatgatactttcabagggcatcattgcagctgagcagyaaccagccaactccactgtctttgtaggtttccccctaaccccgtcattattgtgcagggcattctatcaccccacctgccatagcttcccctaaccagggcatcctctcagctcagcackggtgagacccatagcagctcrgctgcatchtgtgctatggaatttctgtgtctcccacaaccctggtggcatcctcttggcctgccaggcagtgggcaagcttttttcaaattctcatttttgcctgttttcatggatcacccttcatactacttgtgttagttagggtcccctgaggagcrgaccccaatacagtattcaatgtgcaaggatttattrgaggaaatagttatgagagaaattcaggacacagacggaaaatgctgggartgtcatcagaccacaaagcaactctgarccccagtgaggtaaacagtgcaggaaggtcagctggaagcatcctagaccctgtgcaggctaacagaagttcagtaagcgtggcaggaagccctagagcttcagtcagccttcagagaagaaatgttcctgccttagtttctgccctgctttcctcagtcattggcaggaaaagacagggggcakgtgtggtctcagagcaaatgtggcaataggtttcaggattcaaaagttgaggccactatcaattctgcttactctagctgaggggctgggatgtgcattctcatgactgccacaatgatccagtggggagagaggaaaaaggttgatgataragagaaaaaaaggtattaattgatgaactgacacctttaagtagatgataagggatgayrtttkgggcaccagaagagggaytggctctratgggagcagaatggtttacccacaacagtccccracatggtaaaacacctgacatgtgttgcagctgcaaatgcatgagcagatggtgatggaatctgtcttctaatgtgttcagttttctcagtgaggtaggaaccaaggttgtcagctgagataagaatggggaaggagggttggatgtgtgagcacagagagaaggtgtgtaagggtcaccyaggccaggaggaggctgagggtragccatgcagggagagggtgattgctggccctggtgggggctccccatgtggtttgggtcatgaagttagagaagacaycaacgatgagggacagtgagtagatggyrgaatcactggattggtattcccagggtgggggtcgaaggattgttggaattgatgtgctaaagggtggacttcaagcctggaatgcaggcacataygcaatgagtagtcactgatattacctcacagcatatgataaartgatagagtctgtgtcctcagagcctgtggccaccttgcatgggatgagtggaaagatggccagagagtgggaagtgtgaaattgagagtatggaagggctggggtycttgggcatgatgaggcctaggggatgacaggggcaygagattcaggcagagagaggagaaggtcatggaggagaggagttccaggatctgagagtccagggagcaagggcatcttctctgctgtataggtgtctattgctgccataaraattaccacaaaccaagtggctttaaacagcacctaattatcatgttacagtcctgtaggttgcaagtccacacagtcttatggggctaagatcaaggtatgggcaggtctgtgttccctcctggrgactctggggaagaatccatttccaagctcattcaggttcttgtctgaattcacttccttgcacatagaacagaggtttccacttccttgttaagagccaygcttagctmctagaatcttctttcagctactcacacatggtgcctaagkcacatccaatcctcctgcttggaacgtctgacctcccctcttctatgtctcctctgccttcctcctctgcagaayctgactccagccagggcaggttctctgcttttagtggctcatttgatttgawtggggccacacagattgtccaggagaatctccctattttaaggtccttaatcrtcrttacatgagtaaagtcccttttrccatgtaatgcaacctgttcacaggttccaaggactaagactggacctctttcgggaccattactcarcccaccacatgttgaagtcaycaacagtcaaggagactgctggagagggtgacagtgaaccaagagctacaagagtcaggattgagaggaaaggccaggggcccacagggaatggctacaatgaggggaatgggggtctaatctgatgacagcytaggggttttagggaggagggaggcagaaagttctgagaaccacagtgaggagmaaggwccccacctcacctctgaacccaggggtacaagtccatgggggaaactcccctatgtgggaggacttyrgagggggtcatgtcctcagggagaccaggttgctgctggagctgkgaggtgcaggaacatcctgagrgagggtgtggaggttttgytgatcattgactgagattccagggggtgcactgggaagatttctgtggttyrggaggttggggagmcagaatagtggtgtkcagagccttgtggggatgtgagtgcagagtatgtgggggacccagtgtcactgacacaaacagggaaaggayatgatgagctgagtcctggtggactyrgcgcagacaatggtgctgaggctgtgggagatgagggaggaggagcaggggtggctctcacctgggctctgtccrtggaggtgaggacaatgaggtrgttgkgtctcagtgctgtgtggaacttkyttttgacctccttatgagtggatggtctgtctgagatagaacgggycttagaggatttactcattaccctgagagagggggcgtgttcattccaggtttcaggtctgccctgacacctttcttkgtggcttagacctccctactgtaaattattgggtgttagtccattytggagttcataacttaaagcagaaactcagakggttgaaatgtcattttcatgaaggatttttattagagtrtcatttagattgcctttgcaacctcccatgtgttttgttttttttctaaarggctgctaatcttgttttaaatttgcaatgtagttaatttatcttcactgttaattagttgtgggttgtttaaccttataccrtatagttttacatatctataacaacagtagtttgggcctcttgtattctaatagttaagtccttaagctgtgtacacaytgcaattcaagtatgagtcatgcataaccgtagcactaagagacaagagggaaatccctctctcctaaaattttgcaaaagttctgggttttttttyccactgagtgggaacwagtcagctaatcatgaacatgaggtctttggcctcatttaaaggtgcttcagaagcactgagccataggaaggcctctttgtctaggtccrggaccctacaccatggcagaagccatcttccmtcccagtgtgcagtgatgtcccagatagcgaattggttagccacttttcagtctcrggcagttttgttttycaaaacatgggtttttatctcaggaccttcttgtccccagatgatcaaaaccrgggccatccactcccttctgagccacytctgcctggggggccygyggctgtgtcctccagtcacaacagaacaytccttcagaacacyygcaggaagacaacatcttgtcattggctcacacatgcacggtgyrtgcacagagctttggttctagttcaggaggtgtgtggggaggaggctcactagtccaacagagcttggtaccagtgtcrtatgccaggagccaaggttacaaggatgcaaagttcccagacctaccagagaaggcaaacccytgcagcatgcagggctagacaggggcaagaaacaaggtcattccgggccagcaggaagagrgaaagggaaactacagacgtacmtcagagacactgcagatttggtttcagaccatggcaacaaacaagtcacacaaatttttgtttttccagtgcatagaaaagttatattcacactctactgtagcctattaagtgtatgatagcattatgtataaaagaactatgtatataccttaatttaaaattactctattgctcaaaaatgctaaggatcatctgaggcttcagctaatcttaatctttttgctggggcasggtcttgcctcaatgttgatgaytgctggctgatcaggagggtggttgctaaaggctcttatgrcaacttcttaaaataagacaatgaagtttgcggcatggattataaagggggaatcagtacttaagtaaggtcaatataagttttcaagtyaggtggacctgaatatgaaccctccaggcctttccaccagctagctatagagccttggacacatcttggccatagctggccctgacagacactykcccagtggktgagtgctcartgaacccctctgagccagttgcctcacccaaccagtgatataattccttccttgcagaagaataagtgaaaaaaggcacagtgccaagagaatcagacacacgacctgcggaagsctgygccagtgctctaaagcaagttctgcctaaagcggcagaaacatttttcacattaggaacaggagttgtttgggatcctgtctggggccagsttgagagcagagcrggagtgggggcctgggtagggccaggcactggagtgaagacaggcctggagagagcctcctgaaggctgctgagcggctcagacagctccttgcctcacctgcsacagtcctcccactcccctggctctctcggtgctgttttcttcacctcctcctgccctcctggtccctggcaccccagggctcataaacatgctgctcccaaaactccaaggcaagtatggaagggcagaacagcttctgggacagtgggaagatgaggccacccsctatgtggctccaagtgctcgggtggaggagatgaagggatcagtacagtagtcgggggaaattctctcaatcccaccctgcaytaccctcacctctgcagctttttgcctatttccaactctcagctccttccacccccaccccarcccagccctcagggctccctctctccagccctccctctgcccagagcagcacagtccagagtccttgaacaggaattccccctcatctaacagttaatcatttattagtggggacagacayctggtygtctctttccrgtgaccccatatcctcattcaaggcatccagatatagcccctgagccagggatctgtatctgccctccagaggcctatgcccaagacaggttgctccctgggattctcastacaggtggacttaagctaatgggctggaaaaagagaaaacrasgtcgaattcctcacttaccatgagatcttgcaacacaggttccaagggcctcaacccctctaccctggctgatgytccctcctcyactccctctgaccagggccctgagccccccacacagctgagctggcccaagctgaggagttgcttgcacagcagctggagctggaccaggccctcctggaagggaaggagtcggtgggggcccaggccctggtgctcaagatccaaaagctaaagaaacagatgaggaggcactgagagagcctgggaggagagagcctgggaggggacasccaagcttcccagcagtgcccacagcaccctccatgcctggaactaatgtgcaccacccccaggagccccaggatcagaaacaccccagcatctcccaggccagagaaagcagaaragaccccacaaagggctggcaattggcaggtagtgggggagccagggctctgcagtcttagtcccatccctctttgacctcacagcagggcaccaaggccttrcaggaatttaccctgggccatgccctaaaataacctcaccccaaataaaataaagggagagagcacccacacataatgcagakgcacttgtgtttcatttttagttatgttaaaaattctgacaatcaggaatggggrttcaggagtggtgctgargcagaggacrgaagccagggggtgggggaagaggatgtcaggggtggggtcagtagagtctccttcacccccaacctgcagtctcctcctgaagcgtggtcacatgccagaatgggctagtcccctactgtgtctgttcaactaaggggaaaatgtggcmtggtgagaataaggmatgaaaaggaaaaagtgaggcaggagcacacggcacacatgcagatgctggtgtactgtgtgggttcasaggacagacttgggagtgggggaagagatgtaatatgatgaaagaaaacagataccccacataacggtcagaaaaacatcccaacacggcatcaaagaccagggtgcatgaagcagccaagtgtccattatgcatcaggtgcccatgacaggattgaagacaaacatattaaggaactaggaagaactaaagggcttcatgacatcagcactcactgtggaggagatgtctgtctcatcaggcagctcactatcactgacctcaaagcgatgctgcccatactraggatcctggcattattgtcacctgacacaaatgtgatggtcaagycctgtgccacctggaaggggatagagggtaggataggactagaagacccaaagagggaagactcycagagggaaggatgaggatrtaaagtgtgaaaagatacagaaagtaaggaggtgggagagtgggtgtccctctgggtgtggggcttaactgctgcaggtaggtctcagaatcctcatgcatgtcrtaggtaaaggcaatgctcatctgctccatgtccatggctcagccaaataagttggtagtcaacaaattgatcttatcttttggggtcattctccagcaagtgcagaacagtaaaaaaatktagtcacctgaggtgcatatcttggcttcctggccagttttcccaaggcctccactgccaccmtgcaccctgggtgccctccacactctccaagtgtccwgatgtgtgtgaggagttaagggcaggaagaactatwggatcgwggatttaggtgcctttttccacctctgcaggtggcaaggtgtggattcataagctggcattgaagcgagttctgtcctttgtgaatagttgtttggtcacccacagtcatagctgagccctgagaataagagaaacttgtctagaaaaagaaattgtgttgactcttaaatagacatttctggtctgcgttttatttcaagtgtctgggaagagatagagtgtgaggttcaggagagaaggagaggtctgtcttgatgctttgacacagcaccaagaaatttcccctcctcccccacatcgccccgccagttstcagtgagggacagattcacagcagtactgaaagggctgggaagagatggggagacatctggggccaatgttcaggggttgaccctgtgggaggacacctgccttcagagttagagcccacatgtgatgaygtagagctgaagggtgatatcaggraggtgatgragagtgctttggggtttcctgattatgaagagcagaggtcagtctgcttcctgggtgaagtgactgctggggagattggattgaattaatgaagaataaataaacggggaatgaggataagcaagcatcagcatctcccaccatcagttcagactgaggggagwttggattgaattaatgaagaataaataaacrgggaatgagkataagcaagcatcagcatctcccrccatcagttcagactgaggggagtttggamtgaattaamgaagaataaataaacrgggaatgaggataagcaagcatcagcatctcccgccatcagttcagactgactggggaggtgggatagttattgactctgttrcgtggttcckcctaacttcctggtcttggggcacacagatgggtggtgctgttcktggtcarggcagcctcagctccacccaggtaaggcagtggtggcagagagagttagrggagcacctgtgaaaccgaccaaggcagrgatgggagccctctgtgcagcaggagtggatgcaggacctgcctggaagcaagaggabgagggaacctagttgggtcctgttccctgcctgcctgtgttcrcagggtaaccagtaagggagctggggtagggaattctttcataggttatctagccagagatatgtttatagacatrttctttcatgtttatattcaggtttgttgtcacatagacatttatccatgcgtgttttatgtttgttactttagaatggctcagtcacaaaakcttaatctcttcattcctgctgcctctctacacacacatacacacacattcacacacatgctatgcaaacatgtctacctgtatctacaaagagagatgttattttatttttaaatttttaaattcgtatatatthatggggcacaggtgcagttttgctacattgctatattgagttgtrgyaaagtcagggccttcagtgcatccascactggagacagatacattgaccccaacaagaaactcctctacgatacacccactgccaaccactcttacccttctgggtctctattgtctatcattccacacgctgctttcatgcatataaagagatattaatcagatatatcagagtgataacttgaattttactgcactattctttcagcttctttgcacatttgaaaatatrtacaattataagttggaagaatgagggaamaaaaagagygagagagagtgctgaatctgaataggctaggggttgggtctcactaggaacbataattgatctctgccattttgaaagtrtggccccctgagctgccttcagagagtcctggagggaaacctgttttcacagtaataccaagatgccatttgcctgtttcattatgbtgacttttccattaatgctgcaaatgccaaggtcggtarcacacccagcaccttagcagaaccaaggcagtggctccaaactgcagtcccatttaagaatgcctttgatggagcagtaaaatatttatgttcattaaattttgatccttgagtacatgtctttaatattctttgtgagaaaatgggagatatgcaaagagaagcaggatagtagtcttgagaaagggcacttgtgtagactcagttatgagttcaaccagcagatctccttcacccactgaaagacaattgcattatttccagtttatggaagtaattatgaataattacttccaggagtattatgaataaagctgcaagagtatttgtatacaggtttttcatgaacataaagttttcccttgtttgaaataartgcctaggagggcaattkctagtcatatggtaaattgcatgttcagtttgaagaaaactgcaatatccatttccagagtggctgtaccattttaaaatccattcctaccagcaatatgaatgatccagtttctctgtaaccttgccagcatctgttgctacctttattttgtatttcagccattctcatcactgcagttttratttgtattttcctactggatagtgatgttgagtgtcttttcatctgyttgttagcctggtgtttatcctcttcagtgaaacgtctgttcatgtcttgctcattgcctattgtttatttggatttcatttttactgttgagtttttacatttcttcatatattgtgaatgcaagtctttattgaatatgtgrtttgcaaatatcttctctcattctgtagcttgtctttttatgctcttcataggtctctcacagagcaacagttttaattttgawaagatccagtttagtaactttttcttttacrgatcatacttttggtgttatgtgtaagaactctttgtctagtcttagttctgatggctttttgttaaaagatttgtaattttaattttttaatgtatttgttatttatttwaaaaaaaatcttgcctaggctggccttgaactcctgggctcaagggatcctcccacctcagtctcctgagtaggtgagagtacaggcctgtgacaccacacctggctcaatgtttgtaattttaactgtgtgttttacattaaagcctgtgattcattttgagtttttttttttttgtataaagcrtgaggtttgggctcagcytattttttttccactgtggttgtccagttgctccagcaccrtttgttgggaaagctctccttccttcattgaattgtktttgtgcttttgtaaatgtcagttgagcatatttgtgtgttttgctcattttcagttgagttgctcatcttcttacacattgagtttaagaacttgccacattattctggaaacatgttyttcaacacaaatgtaatttgtgataaattgtgaaatattttctccctgtctatrgcttgtcttctcattctctcaatgtcttttggagcactcaagttttaaattttaactaagcccaatttctctctctcttttttttttatttgtagatcatgcttttggtattttatctaagaatchtttgcctaactacccaaagtaataaaavttttctcctgtgttttcttttagaaattttatagttttaactcataaattttagctgtttaggtbtctaatttgtytgagctgatattttatatggtgttaaatgtaacattgtgttacctatgcaacttcattgaaaatcaattgacaaagaaagtaagaatatctttctagattctcacttctgttcattgatctctatgtctctcagtttcacactgtctggattattgtagtttcatatgacattccattttttttttcaaatttgtgttggcccttctgcatcctctgcattttaatatacatttttaggattattttgycaattttcttttctttttttctttttttttttttttttgagacggagtctcrctctgtcacccaggctggagtgcagtggcatgatctccgctcactgcaacctccgcctaccgggttcatgccatttttctgcctcagcctcccgaggagcccgccaccacgcccggctagttttttgtatttttagtagagatggggtttcaccgtgttagccaggatggtctggatctcctgacctcatgatccgcctgcctcagcctcccaaagtgctgggattaccrgcatragccaccgcgcccggcctattttgtcaattttctataaaatccctgctgggattttgatagggattgtgttgaacctatagatctrctgggggagaattgccatcttaacagtattatcgagctttccaactcgcatctctccatttatttagacctttaatttctctgaggaatgtttttttattttcagtgaacaaacactgctgtcttcctaaatttattcctatttcgctcttctggtaactactgtgataggaaagttgagattttcattgcttctatagagaaatatgttaataattaatttttatattgatttgatatcctatgggcccttctggattcatttattagtgctagccagtttttatctgcttgtgaattctacagacagggtcatgttatctgtgaatagaattgtatrttttcctttttatctggatgcctttaatttttaattttctgccttattgcactggctacaatctccagtataatattaaataaaagtggtgggattggacatccttgcattgatccccatcttaggagaaaagcattcagtcttcagtctttcttcattaagtttgattttagctgtgggttttttatagaygcsctttatcagagtgaagaaggtctcctccattcctattttgttgaaacttatgaacatgagtgatgttaacatttttgtcaactgtttctyctgcatcttttgagataattatgtctttttttccatyaatacagtgcattccatgaaytgattttcaaatgttaatccaaccatatgttcctgggatgaatcccattggtcatggagtgtaatccktttttatgtggctttgtattatctgccaatgtttgttaaggatgttttcatttatgtttattggtgacactggtgtatggcactcttttcctgtgagtcttgctgtgactttgatatgagggtratgccagttctgtaaatgggctggaaagtcttccctcctctcttcttgtctgaaagagctttcaaaatatttgatagaattcaccagtgawgatatctgggctttggcatttctttttgagaaggyttttcaatttctgacttagttcacagttctcttcakgttttccagttaatttgggtcagttttggcaatttctatctctgcacgaattggtcctttttatcyaagtggtctaacttattggcttcaggtttttcagagtattcacttatartgttttttaacttcctaagggtcattagtgataatctcttttgttcacaattttggtaatttatcttatttctcataatctcttttttcactgttggtcaagaaaacagacagaggcagcagatggagatgtgacagattctctagtgggaaggctttgatcataatacctggcaagccagaatgatgccagcaaccccaaaggagctgccaatggatcttgacaggaaaatcactgactctggattgggctatgctcaaccaggggtagatgtcaawgcttcaagggctatacaagraccagaaaagaagagrttgcaccaatttggactgccgagtcacactwctttacacaagaaaacacacttdacagcctcaaayggccaacaatgcagagggacatgtcctcctcaggggaaaatttgatagaaaattgaaatggtcaattgaaacattgtttgtctaaaaactgccaatctaattgttgggcaatataaacatgaaggactggcttttatatcttcatgaatgtgctcgctgtcaacatgagtggggctgcaagaataactccactaggtagcatcctctcttttacctgatggatcaggacgatgctgttaygacgatacatacrattcttctgaagrggagaggatgytggaataaagactacacttcacctcaaatttattttttcatatgttatgccatagtaccaggaatagggatgtaaataaaagtgccagaaacaggaattatccctaagcsaaaaaccataactatatttttayacctttatgtaagaattctcaagtattcatttcatctgaaaagttaggattaacagtaagtagagttatatagcctggtggtctgatagcccccactagttccttacctatataacctaccctctatgatcaagactagactgagggaagacatgctagaatactattgctgcctgcagtctaggccagcccagcagacaaacctaatgtcactcccaaacctggaaacractgatataaarggacagagggaggaatagtggctgagggyaagtgaataaatcaaagggttatataatgagaaaaattcaatattagcttaactcctcaaaggtggtgtgagcaagagaagatattgtcacttaggtcaattatacdgratgcctaaaagagtgaagctgtatgtccctgagaccatycttgtttttggaacctgwtaagattgartgttgtcagcaaagctgagtgatttcattctgggagacatattcatacaagaggatgataaactggcctaattttgaatgaatggatgagactctgataatatgccaatacctctttactgttacaatcctttttchtgtaaaagatatgtggtcaaagaaaagtggrcaatctgagttatcacaaaaacatttagwctttgtccctggtttctcctaaaaaccttagactctcttgagtgataagagbgtctttagagtactgatgagaagactcttggctgagwggatcctggatatcttaagaacggtggctagctgccagagacacatacctgtgatgcgagkgttatctttttccattttgtgttgctataaagaaatgtctgagactgactaatttatataaacraggttcatgtggctcaagattctgatgtctggaaatgtttgcgcatttagtgagggcctcaggctgcttccactcatggcagaagacaaaggggagctggtatatgcagagatcacatggtaacagaggaacacagagagtaggaagttgccagggtctttttwacaactagctctcttggaaaataatagagcaacaattcattcattccygagagagggcagtatctctcgattcataaaagattggtcaccatgacccaaatggtggccattaggccccaagtcccacagtgggcgttagattttaacatgaggtatcaggggataaatgtttatatcattgcatcccctccctagccagccaaaggtcatgttcttctcacattgcaaaatataataatctactcccarttgtcccaaatgtgttaggttgttccagcatcaactcaaaattctagagtctcatctgagacdcaaggtaaattcttatagctttgagcctgtaaaattttttwaaaaaatgttatttgcatctaaaatattaataaaacagtggaagagacatttcttgtacatttccattccaaaaggtatataaatgggccaaaagaaatgaatgcagtttcctcataagattgaaactcatcatggcagacattaaaacttaaaggtctaaaagaatctcctttgactctatattttgaatccagagcacagtggctggtgcaactgctgggctcctaatgccatttgcagctccacatttatggctttgctgaacataacccatatagctgctgtcatgggagaaaattgaatgcctatggcttttccaggctgaggttgcacatagccagtggctctaccatttagtagtcctggcaggggtcctgttgctgcagctccgctaagaattttcctgggtattaaatttccccatttaaatatcagttycagtttyrggtcatttctttgctcamacatatgcacataggctattacaggcagccagaccaaatcctgaattctatgctactgagaaatttcttccatcagatacccttaatcatcactctcaagtttaaagttccacagatccctagggaggtggcacaatgcctccaagaactatcacaagaacagcatgaaagagatgattctaaaccattcatgaatsatccatcctcatgagccaatcacgtcccaccaagcaccacctccaacattagggattacaagtgagcatgagatttgggtggggacacagatccaaacartatcaggggtcatggtggacatgagggtgggctggtctctccacttctcacatgttaccagggacatagacacattcagatgccttggcagaaagagaaracagaggcccttgaagtctcaaagtggagccatgaacaaatcttgcatctcagtccctcacaaggcagtcttrgaaagaaaataktcrtgaacaaattcaagtcagtcatggtaagtggtgacactgaacagcccaccacacattgaaaaattccaaatcaaagactctctagagcctagttgtgtcccatctgccccaactcctccttcacttcaggccctctaaggtgycacttttacaagacdtgagagacacatcagagccctgggtactgttcctgtttggggtggaacaaaaacaaagtctggtcagagcccacaggtgatgtgactaaaggaggaattktggggtggtgacctcccccatgggctcctgtctacactrttccaaggatctcaggaatcactctcccacccctaccacacttacttgaagcctgagcatagctgactccttttccatatgaggaaagaaaacaaactgtgagasgccagggaagaggcagggccatgaratcctagaggagtttccagaactgtgactgcagacccaggtcaggatcagraaacccgagggaagaggatgtgttgaagctgaaccaaatgtccttttgacatctgtcctcagcaggaacattctcctgacttgtgactgctgggagtcaggttcccatgatcacaatcaaggtgataaatttgtccttcaatttcacaggtgctttacaaaagagtgagagttgacakggcatctgaacagggtaaatgtgtgtggagatrgtgtctcacaactaggcaggaaatgagccaacttccatctggagcttgaaatccacgaatggaagaagaaatcttggaactcacccctttcctacctggggtcttattcttccacatcacagcagtgaccacagcacctagaacaaccaggacrgtaacratgcccaygatgrggaatgtgggctgggaagatggccctaagaaaggaggggaacgtgaggggtcctgacccccaggcctcagccctgaccctgctgaaggcctccagaarggctcctghtttccctgagaagagacatggcccctcattcatctccttagcccatctcagtgtgaggggctctggcagtgcctcctgctgcacatggcatgtgtatctctacttgtctctagaagacagcaycacagctgcccacttctggaaggttctataccctgcaggtctggtccccacaagctctgcgtcctaaatttggtcctccccatcccacagttgggtcactgtgatttccacatggtagaagcccrggacccagcacctcagggcggcctcatggtchgagatggggtagtggatcacacatgbattctgggattctgaagggaagagtaagaaaattgaggcactttgcattcctcatgggacactccagcagcacccatgtgaccatcctgagaatggahaggacatctggggtggggaagggagcacagaacccagacacctcctggccacaggcacctgggataatctcctattccttggaaagttagtgtctgaggcgttgaataatttagagtctgcagagtgcctgggattgcaggmgcgcaccaccatgcctgactggttttcgtatttttttggtggagacggggtttcactgtgttggccaggctggtctccagctcctaactgggagtgatctgccagccttggcctcctgaggtgccgggattgcagacggagtctctctcactcagtgctcaatgttgcccaggctggagtgcagtggcgtgatctcggctcgctacaacctctgcctcccagctgcctgccttggcctcccaaagtgccaagatcgcagcctctgcccggccgccatccggtctaggaagtgaggagcgtctctgcccggcygcccatcatctgagatgtggggagcgcctctgccccgccgccctgtctgggatgtgaggagcccctccgcccagcagccaccccgtctgggaggtaaggagcgtctctccccggccgcccygtctgagaggtgaggagcccctccgcccagcagccaccccgtctgggaagtgaggagygtctctgcccggcagccrccccgtccaggagggaggtggggggcagcccccgcccggccagccacctcgtccaggaggtggggggcgcctctgcccggccaccccgtctgggaagtgaggagcccctctgcccggccgccaccccgtctgggaggtgtacccaacagctcattgagaaggggccatgatgacgatggcggttttgtcgaatagaaaggggggaaatgtggggaaaagacagagaaatcagattgttgctgtgtctgtgtagaaagaagcagacataggagactccattttgttctgtactaagaaaaattcttctgccttgggatgctgttaatctataaccttacccgcaaccccstgctctctgaaacatgtgctgtgtccactcagggttaaatggattaagggcggtgcaagatgtgctttgttaaacagatgcttgaaggcaaaaaaaaaaaaaaaaaaaaaaagaatgcccaaaatgacaattttctgactcaagcatctacaaaaatatttgcctaatcagggtgctttgcaattagaaaaatgtgagtctcacatctttgtctgtacaactggcttagcatcatgacaatgatttggtttgatgtggtaggtggaaatggttaamttcaatctaggaacaagatttttcagtaactggctattcagtgggcatcctgtgatcagtttaacatctttcactgtggbttttaattagatgtggtagaagtgatttggactccagtatgattctgaaaaacactgttattttgtgcttctaatgttgctttaaaagcagctctttcgtgtttthcattcttattgctatttcatcactagttattcatttatgtcttttcatttaatttattttgctcaacaatgctttttttctattctgtaaaagtttaattcacttgtatgtgtggtaaaatgtgagcaacatatcaaattctcaaattctttgcaagatactattgccttacctahcagattgaacactgtgtatcagaaaatgtagagagttgccaactagccaaggatcaaatgacctatttgtagccaaggctgtttttcatggcatcctggtcctctcacatggctccttaaaattggctgtggcttgttttttgtrgttgtytgtttgttygttttgagatggagtatggctctgtcacccaggctggagtgcgatggcaggatctcagctcactgcaacttctgccttccaggttcaarcgattctcctgcatcagccttctgagtagcttggattacagacacgcaccaacacgcccagctaatttttgtatttttagtaaagacraggtttcaccatgttggtcaggctsgtctcgaactcctgatctcgtgatccacaggyctcgacttcccaaagtgctaggatcacagaagtgagccaccgtgcccggccagctghggctttgttttactaygagtagttatcgcaaaggatgcttgtgatgaactttggcrttttcttttctctttcatttccaaahaatcaatcaggaatggcacacaaggtgcattttgaaaaataccactttaaagatttgtgggccaggagtggtggctcatgcctgtaatctcagcaatttggtaggctgaagtgggtggatcacctgaggtcaggagttccagaccaacctggtcaacatggtgaagcccgtctctactaaaaatacaaaaattagctgggagtggtggcatttgcctgcaatcccagctgctcaggaggctgaggcaggagaatcccttgaacctgggaggcggaggttgcagtgaactgagatcatgccactgtactccagcctgggcaacaagagcgagactcaaaatatataaataaataaataaataaagttttatgatcaagtaactaactacctggatatcccctcctggcataagaaacagaacctatgaagccaccctaggctgttgtccaatcctatcccctaaaaggaacctatgtcttgagtcttgtatttgctattccttggcattgtcactgaagatttttacaataatacccaaatcacagtttgacctgtatttttttaacttccccatacagagaactcacachghatgtatattatgtgttggggagttatctctgatgtgggagggtgcttatccttttaatttttttttctttttgagatggagtttcactcttgttgctcaggctggagtgtaggggcgggatctcagctcacttgatctcagctgcttggttcagctccatctagcatctttccccacrctgtcacccccagcaccaggggactgagagttgatgacctggtacaccaccgcctggatctgctgcagtgtcctttcctgtctagtccgcactcaaagctgacctcttcctatattatacccagacagtgggccaaacaatatacttagatgtggaatgtggtgttgccaggacccagagaagctcaccaaatagtgtgcttccttccttctgttgaggatgcaagatgcaagtttgtcttttactttggagrggacagccctgcatgcccctaaccactggacccataacacttcactgcagtggccactcttgaagctctgtaaggttaatcttcaccttctgtagtgcacaygttttgccraagaaytcagcrtactttcctcctcttrctcatccatcccaatctatgtgatattgccaatgaaahgaagagatttagtattctgtgagatgtctgatttgtccagatctcttaaggtgatatttatagaaggttgaggagttaaagtagccctgaggcaagctatcaataaatgtattataaatcccatgtgaatgtgaatcattccatatccattttctaaatggaatgggaaagaatgcactcaccaaatgcatggctgtttgccatgtgcctgaggccttattaatctccccaagcagtgatatccagccagcatggcagctgcaatcaggactcctacttggtcaagtctggagtaattccattcattctttatcaggcttcttcagggayagactgctgaattatatggagataataggcaatcccaacaccaccccccatccttcagctctctaatggcagtgccacccctacaatayctgcagtaccctcctgaagtcccacctggggcrcaatattgcttctggcttggytgggatgagggaagttttagatgattccctttgggcttcagcacaatgawagcccttactctccagactagggatgtagtrtgggggtgactccctttgccagtgcatcaaggccaattatgcatgtggagaatggggagataaccaggactgggtttatgaacccagtggtcccacagtgggccataatgtgtccaggtttayttcctggcctccttaagccccactgtrgattctgaatctgaagcttggctgaagtctaggaattgagactgggatcatgactttgtatttrrtcaaacrccctcagtctcctgctcctcaattcttgcattcccatcatagatatgaagcagtgccctcgctggctgcccatctgttctgacgctgggacaccaccttttactaacctttcccaaaactccatgaaggttgagcccctttggctgctactctgggttctcacagtaacygtgccctctatcttttgcaggtcrctgcaaaggagggttcctaaagcattcactcctgatcctgagggaggtgggtgcactcactccaggtctcaggtccgccacagaaaagcaaaaactcctcacattcaaaactgtcctgggccacattcagcctgcgagctacgggttagacaagctagcatctagaacatatgtaccacaacaccagaaatttttctgttttcaccttaatgatgctttctaaacgcaaaagcagtcatatccctagcagacaacaaatgtcagttgaatgaatgatcactgtagagcacttctctattctaaagccaatatctttgttaaggtagcctcagggcaaatgctgttttgtggcagctaaagaacaacatcatctcatgtggacatcgatrccgccagtgcttttctcaccaggastgcttgtgtgtcctccctccctccctmcctccycccacaccaaccctcctgcacactgcagcacacaaccatatttttctcttcaggaaagataaccctaggcttatgggtacaattttccaaccacgtatgaatctaaattagactctgctttgtaaatccatgagtttggattggagccagcactaggattactacaactcagggcaggaagaagagtaggagagcagaagaggagctccaacagaaagttcactatgatgagaaactatgggacccctcctctctgcaaatttcagaatctgcttcctttaaaaagattggagacaagatgaaaactacaatccaggaaagagycctgggaggagggcaagagctggacaggtctgaaaattagtctcttgataccacaatgagatttgtatgcagggaccaccstaggtgacatccaastccctgtgatcacaggtggtggtrggacaaggttctactgaagggccaaggagaatgaaggagcaaagatgacccagctgagcagtgaccacataaagtccatactggcctgagcacccactaggcacagccccatctattctcctcccctgcaacaaatcagcacaagaaacacatggactctggaaggttctcatgkgttccatttattttgtctctcaaattttaggaatcttctcctttaattaagtcatcaacctctcatggcaagaatttgaaaaagtaaatgtttactcagattctaattttaagagggaagtaagaagttacagctcagtgcacataaagttgagaaaaagatggagacatctcagcccckcctctctggaacaggaaagatgattggggagggaacacagatcagcgtggggaagagggtcatggtggacatgagggtgggttggtctcccctcctccacacattatgcctacaggaacacagacacattcaggtgcctttgcagaaagtcagggttcttcaagtcacaaagggaaggtgtgaacaamtcttgcctctcagtcccacacaaggcagctgtctcacactatagaaaaaatattcatgaacaaattcatatctgtcccagtaatggatgacactttggcagcccatcgcatgctcaaaacatcaaattcaaagaaccccatagcacagctgtgtccactgttcccccccaacaccccccacacatcaggccccccaaggtctcacctttcacgcygtgagagacacatcagagccctgggcactgttgccgcctggagtagaataaaaacaggacctggtcagatcccacagtagatgtggctagaggaagaattgtggggtgggtgagctcccccatgggctcccaaacacaatatccaaaggatttcagggatcagcctccttcatacttacttgcagcctgagagtagctccctccttttctatctgtgggaagaaaatgtcctgtgagatgccagaaagaagccagggccataaggtcctagaggaacctccaagtcttggaccccagagaagtttccagaaatgtgcaactgcagacccagggcgggatcaggaaacatgaggaaagcagatgtgggtcctggaccaaccgcccttctgaggtctgtcctcggggaccttcccctgtgacttgtgactgctgggatcaggtcccatcaccacagtcatcaaggtgataaatctgtccctcrttgtaacaggtgctttacaaaagagtaagtgctggcacacasggcccaggctgggtaggcccatgagtgtggatggtgcttcccagtaaccaggcagggcmcttctacctggggcttggaactctcagtgagacaagaaatctcagaccacactcctcaccccttccttacctgagctcttcttcctccacattacagcagygaccacagctccagtgaccacagctacaagtagaaccaggccagcaaygatgcccacgatggggaygktgggctgggaagatggctctgggaaaaggggggaaggtgagggaccctgaccctgctaaagctctccagagaggctcyggctttycctaagrgacatgacacccccatctccctccttaccccatctcagggtgaggggctckggcagaccctcatgctgcacatggcaggtgtatctctgctcctctccagaaggcaccaccacagccrcccacttctggaaggttccatcccctgcaggcctggtctccaygagctccgtgtgtgggtctggtcctccccatcccgctgccaggtcagtgtgatctccgcagggtagaarcccagggcccagcacctcagggtggcctcatggtcagagatggggtrgtgggtcatatgtgtcttgggggggtctgacrggaagagtcagaaaattcaggcattttgcatctgtcatgggacactccaccagcacgcatgtggccatcttgagaatggacaggacgcctggggtggggaagggagcacagaacccagacaacagcctggacacaggcacctgggataatctcctattccgtggaaaaytctagtccctgaggagggaacagcgacttctggtcctgacctgagtggaggctgagggactcagaagagctggactcagacccccasrcacattgagtgtgaagcagagaacaaggcctgagaggaaaagtcacggggcccaaggctgctgccagygtcaaagrgaaccactcatcagtattccagggattgtcttcccttcatttcctcagagatttcatcccttaattgtgtcaragagcacggcggaccctcagagtcactctctggaaacccaggaggattcttctccctcaggaccagagggagggcgatattatagtgttggtcccatttgtctccctttcttgtgggaggccagccccggagatctacaggcsatccgggaggcgccctgtggcccctggtacccgcgcgctgcagcgtctccttcccgttctccaggtatctgcggagccactccacgaactcgccctccaggtagrctctcmgctgctccgcchsacgggccgcctcccacttgcgcttggtgatctgagctgccatgtccgccgcggtccaggagcgcaggtcctcgttcagagcgatgtaatccttgcygtcgtaggcgtgctgttcatacccgcrgaggaagcgcccgtcgggccccacgtcgcagccatacatcacctgcatggtgtgrgaacctggccccgcccccgcggtcagcccggtcccccgagccccgccctgcccsgaccaacccgcggggattttggcctaaactgaaaatgaaaccgggtaaaggcgcctgggcctctcccaggtcaagggtctcggggtcccgcggtttcggggaggatctcggacccagagactcgaggcgacccggccctccgtgggggatggggaggggtcgtgacctgcgycccgggccggggtcactcaccgccctcgctctggttgtagtagcggagcgcgatccgcaggttctctcgttcagtcygtgcytgggccttgcagatctgtgtstyccggtcccaatactcyggcccctcccgctccatccacggcgcccgcggctccatcctctgrctcgcgkcgtcgctgtcgaaccgcacgaactgcgtatmgtccacgtagccgacggagatgaagcggggctccccgcggccgggccgggacatggtggtgtagaaatacctcatggagtgggagcctgggagcgaggaggagctgagacccgcccgaccctcctccctgcgcggctcccygggtcctgcgcccccgccgggcgggcccctcgctcctcccgaccatttccctgcagaccctgcactcacgcgcccaggtcwgggycagggccagggcccctgagagcagcaggaggagggttcggggcgccatgagcaccatcctcggcgtctggggagaatctgagtcccggtgggtgcgtggggactttagaaccgggaccgcggcggcaccgattggcttctctagaaacccgacacctagtgggaatgagaactgtgcccgcttcstgagtatcmaggaaraaggacccgtcgcaggttgtgagaagaagagaaactgcggaggtggcgaatccccaaggcggggcmtccccaatccatacaccgccttcggggcctgagaccctgagagccacgcctggggccctgggacttcgccctgaccccgctcctcctgtgccaagcgctctgtctcagtgtttccctgagtcttggcccaggagctgtctgagaaaccaggaagaaaccctcggcatgggccctgtccctctcccttcacttttcatccmggaatctccgtccctgaactggactccctgtccacctggactcttctagaagaaaashcacccacggagtttggtgacagagagtgagcttgcthtgggaatggaggtgtagaaactgttttttgttttcctttttttttttttttttattgggaaaagttgtghctgagtgcatgagacagaatagagaccagtttatttatttatttgtttattaaatacattggatagcagaaccttggtaacccctgaatgatcaggaatctaatmggtaaaaaatgtgactttggccccatgatgtataaatgtgcccaaaagcgttasaacaggactcacaaagcttctaagtttcacttttgcagtgtacctgtgactcccgcttgtcatattttaaatttgccatcattccatagctytgagtttctgtgtgagtccaggatatctcctcaatacaaagtagcacactgtgtactttgcaaccaggtacgttgcaaccaggagtcagtacaggctttattcacctcaaagttgcaactgttcartgtagtcrcaatgcccctcactagtgctcatgcactgcctgtttttaggaagtatccrctkctaagtgttrtgtatattttataggaacacttagtaatttttaaacctgattaacattaaaaaattagtttttaggcagacccacatrargtattaaagrccaactgccaaggacaccctgctaggctctgtagatggatgtattaaaatccataaaacaatgtatttaaacctaagaattctgctgctttcgaattctttcctctgctccttttcttcacctcctgcttctccagcccttcyctccgtccttytcatccttcaggccstcctgtccccttagtccccaccacactgtcacttgtgarttgtgacactagcactgtcccatgacctgttacgtractgttcttttcacagtggtcctgctcctgggagtcrgagtgtgtcatctctccacttaaaacactccagtgtctccacctcggtcttgagaaacttctggagtgtcaggcacgtgagcatatgaggggatatctggtttatcgtagggactaaattaatttttgtcgactgaatgaatgaaatatgagtgtattaaattgcattacagataattabaaagtgcaaaacacggaaraagttcagaaarwttttattttatgtaactagtgtgcatatcaattcatcaattcattcgtgcactaccaygcctggcgaaacaacacccatttatctgcttatagttccttgatcagaaatctgggcaaaattgtggatggaatctctcttctgggcttccaaaagctgtgttttcattttgaatvctccttcaggcttatacagaggtggcagaatgcagtttctggcagttgtaagactgaggtccctgttycttgctggctgtcaatgtagagaacagggagggctgtgctygattcctggtcctcaccagyattctttcctacacagccccttcatttttwattttatttatttattttttkgagatggagtctygctctgtagcccaggcttgggtgcagtggccggatctcggctcactgccagctatggctcccrggttcacgccattctcctgtctcagcctcccaagcagctgggactacaggcacccrccactacrcttggctaatttttttttttttttttgtattcttagtagagacagggtttcaccatgttagccaggatggtctcratctcctgacctcatgatccgcccgcctcagcctcccaaagtgctgggattacaggcgtgaggcaccgcaccyggcccacagccctttcattttcaaagcccatgctggaggaaacccctcatgctgagtccctctcacactgtgagtctctatgctcaggaagaacccagtcctttcaaggtctcacctgattaggacagtccaagcaggataaacccagcctaaagtcaactaattgagacccttaattatatccactaactcccttcacagcagcacctacattagagttgattgaataactggaggatggtgaatgaccaggagctggttgttgagggcataatagaatcagcctagcaagggttggatcttccttttgtgtttacttcggacacagttggaaattgaagttcaagtaaagtgatcattgtgaatggtcataaaatacatcctcttcagccatggaaattctccttaccttttaaaactaagttacrtgtttaatatcttataattaatttacgccaggtatggtggctcayrcctgccatcctagcactgtggaaggcagaggaaggcagatttgttgactccagaagdtcaagatcagcctgggcaaaacccccatctatacaaaaaattagaaaattagccaggcatagtagttcatgayggtagtcccagctactcaggaggctgagatcagtgggtcccttgamcccaggaggtcgacactgcagtrcatggtgatcatgccactgcactccagcctgggtgacagagcgagachrtgtctcaaaaataataatgatgabgatgatacatttaaagcaaatgcaatttaatgtgtaataatacatcctctcttgtgaaaatgtgttatttatttactattrcataacaaattatgtaaaacttagcttaaaacaacaaatattcctcatctgccacagtttccaatggtcaggagtccaggagaggtttccctgagtgcttcttgctcsgggcctctcacaaggttgcagtccaattgtcagccaagggctgcatcatctgagggcttcactggggctgaggattcacatgaaacatggatcagtcacatggctgttggaaaaggcctagttctttgttgtctggtcccggaaggcctcagttctcagccacatggaccttcctgcagggctgcttgtggcacagcagctggcttcccccagagctcatgatcccagagacagagagagagaaggtggaagccgcagtgagttttaggttctacacccagagttacaaaccattatgtcagcattattctataagttagaagttatattagtccattctcacactgcyatraagaartrcctgagactggstaatttataaaggaaagaggtttaatwgacycacagttctgcatggctgaggagcctgccccaggaaacttacagtcatgrcagaagtggaagcaaacacatccttcttcayatgatgacaggagagagaagtgcagaatgaagcagggaaaagccccttataaaaccatcagatctcatgagaattccctcagtatcacgagaacagcatgggggcaccrccyccattatccaatcacctcccatgtggtccctcccccwataggtagsgattacaattcgcataacaattcaagatgagatttgggtgggaacacagaaccaggccatatcagaagtgcctcattaagtccaagccacactcaggagagggaattaagatgcacctctggaagggaacagtatcaaatgttttgaatatatgttaaaagcaaaattataactattgtttcaggtttttgaaaatcaaagacttcttttatctaattatttttcattaactctttcagcttgtctttttctttaagcttgtcttttaatttaattttttttaagttccagggtacacgtgcaggatgtgcaggtttgttacataggtaaacatgtgccatgttggtttgctgcacctgtcaactcatcacctaggtattaaccctggcatgcattagctatttttgctaatgatcctcccaccaccaccctgccccaataggccccagtgtgtgttgttcctctccctgtgtccatgtgttctcattactcagttcccaattataaatgagaacatgtggtgtttggttttccrttcctgtgtgagtttgctgaggataatggcttccagcttcatccatatccctgcaaaggacttgatctcmttcctttttatggctgcataatattccatggtgtatatgtaccacattttctttatccagttcatcattgatgggcatttgggttgattccatgtgtttgctattgtgaatagtgctgccatgaatgtaaacatgcatrtatctttataatagaatgatttgtattcctttgggtatataccctgtaatgcgattgctggatcaaatggtatttctgattctaaatctctgaggaatcaccacactgtcactgtcttccacaatggattaaccatttacttttccaccaacagtgtaaaagcattcctatttctctgcaacctcgccagcatctgttgtttcttgactttttaataattgccattctgactgacatgagrtggtatctcatttgtggttttgatttgcatttctcyaatgatcagcgatgttgagctttttttcatatttttgttggccacatgtatgtcttctttagaagtgtctgttcaagttctttgtctactttttaatgaagtttttttttcatgtaaatttgcttaagttctttgtggattctgaatactagacttttgtcagatggatagactgcaaaatttttctcccattctgtaggatgtctgttcactgtgattgatgatagtttcttttgctgtgcagaaaaaaatgcctaatcaaattgcttttcatttacaaaaatgtgaatctcatacttcagtmaactttattttactttagtaaaaattattagcatgatgccaataattttggcttgatgctrtagcccgaaatggttagttctaattgagaaacaagtttttttcaaaaactggctatttgaygggcattctataataaacttaacatcttttgttgtggtattgaatgagatgtgatagaagtgatttggacaccactatgattctaaatagygctgctattacatgcttctgaatttttttttctttttagcagtcctattctgttttccattcatatttgctattccatcactgggtattcctycctactcttttcatgtttcatttattttgatcaatgatgtgcatttccaatctgtaaaagtttatttcagtttaatgtgtggtaaaatgtaacatcaaatctttgsaagatgaaattatcttgcacagcagattgaacattgtatcattgaaaatctagagagatgccagggagccaaggatcaaatgacctatttgtagccaakgccattttcatggcatcctggtcctctctgtcacatggctccttacaattctctgtggttttcttccaatgtaagtagttcttgttaagaatctttgcaatgaactttgaaattcttttctttttcatttctataaaaaacaggtatattttaatttggaaaactctgtttaaggaattataatcaagtatctacsagggtgcccagcrctggtgtaaaacacaarcctgtaaagctaccctgggctgctacccagtcaccccmtagaaggagaccgttgggagcaagtcccccaaaatctggccataaactggccccaagactggccataaacaaaatctctgcagcaccrtaacatgttcataatggccctaaygtccaagctggaaggttgcrggtttacragaatgagggmaaggaacacctggcctgcccagggcggaaaaccgcttaaaggcattcttaagccacaaacaatagcatgagcgatctgtgtcttaagrgtgtgttcctgctgcagttaactagcccaacctattcctttaattcrgcccatccctttgcttcctataagggatacttttagttaatttaatacctatagaaacaacactaatgaccggtttgctgttaataaatatgtgggtaaatatctgtttggggctctcagctctgaagactgtgagacccccgatttcccacttcacacctctatatttctgtgtgtgtgtctttaagtcctctagcaccactgggttagggtcttcctgaccgagctggtctcggcaggagactccatcctgagtcttctgatacgtattcctttgtattccttcaaagatttgtgcaataagtatatctatatctccccaaaacaaacctcagttagttttgctggtttttaagcttcctgtacagcaaattcctactgcatgtattttcccatgatacacattatgtgtaggagttatctgtggtgtgggaggctgtcattcattcatttttacgctgaaggcttacatatcgttttaccacaatttcaccrgtttcctattgatgtacatgtggcygattccagtttttgccataaatattagtgtgcatgtctcctgtgcacataggcaagaaagccccaaagcycccagagtggatgattaggaatgggttggttgcatgatacattgtatggactttaaccatactagataatgataatatgatttccaaagtrattgtggctacttaaacttttacaataaatgtgtaatacttgatgttgatgatgtgttctgaaaacactgagttgaaggaattgtgttaaaagtcacygtcttggtggtagaattatagcaagcatttttattctgttaataacttcctgttgtttacttgtttctcatataaaagacattatgcttttgacatatagattcagaaaatgcttacttacagcccaatcacatagggttattttatattttaggaaaattttataataaaaaggaaaaaatggaggaagggagggaaagaaggaggaatggaggaaaaagtgaaagaagaaaagaaggaaggggaaggggaaggaaagggagcaagaaggagggaaggtgataggttgaatggaaatagagaagaaagagagggagggagggttagaaggaargagaaasggaaggaagaggccaggtgtggtggctcatgcctgcaatcccagcactttgggaggctgaggcaggcagatcatgaggtcaggagayagagacyttcctggctaacatggtgaaaccccgtctctactraaaatacaaaaaaattagctgggcgtggtggcaggtgcctgtagtcccagctacttgggaagctgaatcaggagaatggcatgaacccaggaggcagagcttgcagtgagctgagattgagccactgcactttagcctgggcaagagagtgagactccatctcaaaaaaaaaaaaaaaaaaaagggaaggaataaaggagaaaagaaactaaaataaagaaaagaataggtgttgagaaactagaaaccctatgtgtggctaatattatcaaaataggagaaaataaaagagatgtagttaacttctatagaataatggaaatgtaagagggcttcattagttatccattgctgtgtaacaaactacccccaaatttagtgattaaacaataaacattgaggaactcaaaagcatamtacaaataccagcaaaatggagccaatgcaggtagaagttgaataaacaaaaagattttacacvttggaataagtaagagatcactagtgggcagatgaaaatgattttatagtccaaatgctccaaaaagcaagttccatcatgggabtaaagttatagcattttattaggggacacacctgtcaggtgatatggcaagggaggtaggttaccctgggaaaggcaacaagatgcaaaggtgatccccagtgatggacagaaggagacaaggtttactggatgtgccrtagaccacaggcaatctaaggagagttaagcaaggccatggaggagtccttgagctacagttggcyatcagaggagtccctggtctcccaggaatgtcctgctttcgtgtcactggtgtgatctgtcactggttgggaacagcccattggaagcaggrcctcagcaccaatgctactgaggatgtcagagcacaggwgcagggccttgggagattaccsagcattactcaaaccttctgccctgaygggtctgggtccttggaaatcaagctgtctcaggctgaattgctggatgattctgytcacacttacaatgaggtaagggaaaccagaaggcccccaggtggatctctggtttccacacacacttccgccctcattgtgtgaaagtagccatgccttctcctgaagatgaggatctrttacctgggcctggagaggaggagaatcctcttttcaccaggtggtctctgggcacaaactatcaaaacttctctcgtgacarccataatgtgtagttcagtgggctgtcttttgtmtccttttaagggtaccctccttggaaaccaggacctcgtaccctgcacagcccagtgttggaagataaaacgtgcaaaataccccattgrgtgaatctaagggattggacgtggagccaaacctgcttccatcttttgatycctggacacacatgttcttcctattgagaacacagcactctagagacatctctgattcaaacaatgcacsgtgtcctraaagayggcacccacctctcagagtgcttcctccaggctggcactgagttttgcctgtagaagacctgtccagcattccttgtggctggcagcctctggatggtgcagatggtgataggattagtggaacccacagccatggaaacactgaaactttcccagccaagtgggtccttcaggcagataatgggctaggagcacckcctagcctgcagatcaggaatgtcaacagcacccggagaggtgctggctgagtttctgagagcaggacatgaaaacacccatggaatagragcctatccctgtgaagatgaacctctggcccttccaggatggaagtagctaaatgtagtcaacttgttacttagtggctagttagtcacctaaagaaatagtgccccactggggcacatcatgggcctcaattgctratgagttggacattcagaggtgtcgrcagctggatctgccttggtaggggggagtcagtgctgttggccccataygtagcctcakgcctgccactgtggttgctccattcatgaactcatcctaccaaaccagggctgacccatggtgaaggctggctaacttccatttgtctgtttggttgttcagtgccacttcagacttgggtattttctstgggtgtaaacatgggattcaagctcaacccaggtggaccattttcacctcaygatggatrctgttgggcctgtctaatctatgactctgtgggtcacacaggcactcgaaccacatagttgcttggtgtcchgtggtbaarcattctrtctaatcaggacaagggacactaaaagttgcttctaataggtggcatatgtctctgctgtgaatgacatgaccttactccagaatcccaggcctttcactgtgactttcccactggtgcttggttcagctccatcctgcatctttcccyaccaatggcatcaccagcaccagggggtctgagagatggtggctgctygcaccatggcctggatctgctgcagggtccttttctgtgtgggcccyacttgaagctggcctcctcctatgtcacctagagtgtgggccaaagcaacatacctagatgtggaaagtggtgttgtcagaactgraagaggctcatcaggcagtgtgcttccttctttctggtgaggatgcaagatgaaacagtttgtctgttaccttggaggggacacacctgcattcccctaaacacttggccattgttcacccataaaactttacttcaatgcccrctatytttttctttttgagatggaattttgctcttgttgcccactctggagtgcaatggcacgatcttggctcactgcaatctctgcctcctgggttcaagtgattctcctgcctcagcctcccaagtagctgggattaccagcatgggccaccatgcctggataattttgtatttttagtagagacggggtttctcygtgttggtcaggctagtctccaactcccaacctcaggtgatccabccacctcagccttccaaagtgctgggattacaggcgtgagccactgcacctggccgagtggccactctkgaagctttgtaaggtttatcttyaccttctggagtgcccktgttttgccaagsactacagtgcactttctacctgctgctcatccasccagrtcaacaggaagttgtcaatgatatgagctgatttaatatcctattggatatccagtatgtytagtatagtcttaagactatactatagaggtcaggggagttacaatagccctgagacaaatgataaatcaatgttttgaggatcccacatgaatgtgaatcactccatatccactttctaattggagtggaaagaaatgcagtcaccaaatccacagctgcatgctctgtgtccaagggtttattaatctgctctaccagtgatatccagacagcacaaaagctgcaattataactcctacttggccagacctggagtaatctagttcattctttaggcttcatcaggcttcttcagggacagrttgctggattacgtagagacaayagacagccccaacaccatcccacatccttcagctctgtaatggtgatgtgayccccacaatacttgaagtrtcttmcacaagacccaccctgggacacactatgatttttgatttggccaggatgggggcagtgtcagaggtttccctttggctttcagcacaatgaaagtccttactccacagactagggacccagggtgggggtaactccacttagcagtgcatcagtgtcaattrtgcactcagggtataggaagataaccagggctgggtctatggatccagtagttccattgtgggccataatgtgtccaggtttactccctgagctccataagccccactgtgatgagagacatgatagtgctgtgggcatctgagcatcaatgtcagttcacacccagtgtcaataatchccccagttctgcctgtttcctttccccagtgtacaatctcctgagtaaatggctatatggtcctttgccgaaggactgagggaattgtcccagcatabacttccacggggttgcagagtattccgcctagagatatggactcttcctctgtcactgagatctgaatctgcatcttggctgaggtctaggcattgaggatgggatcatgattttgtattgagtcaaacaccttcaccctcctgcttctcaattcttgctttcttatcatagatatcaaccagctgcctgtcctaaccctgggacaccaccctctattatmcttccccacattccctgcagcttgagtcctcttggcttctcctchgaggttgccatagtaaccgtgccctctggcttttgcaagtcactgccaccacttggtctttgtctcttcagggccacactctccccagtratattagaaatgaaactctgggactatctttactaccatcacccccagcctacaaaggacaatacccygwcacttcttagtgatgcaggtccctctcaccatcaagttcctgaggctctggtggaakgtgtgtcctctgggccctcttgtrgagcatggttttggtaggccttcaccaagcccactcccctcagcttgttattccatyctctacatgttccagggcaactaagacatgtctaccttgttgagagttgggcatgtttttttctagactatgtggatacaycccagcagtgggtttaytccacttatcaaagtcctggagtgtttgataaatccatgccctgagaaagtgtcttcaagccaaaggattatattcatccagcctgaaattctggttccttgatcaaacaccctcaaattccaatcccagaagtagtccctgggctcctatggggacgtgctggctagttcctgcaaacctcctgagtgggattcbcgcggcatcataggggtgaggattgtgtagcatcttccagcagtgaaagtgggaaccattactagagaagggtgagcctcctctgcatgcccagaagatcctggagggcahgcatcgcataatcctgttccagtttgcagaatctcaggtttccccaccaaagccctgactttcctgtaacaggcctgccttggctgagtgtcaaacatctctggagcactgtggccctcatagtgatgtagagctaacattccttgctatctgcccttttgctacaggagatraagacctgtccatgagacactgccgagggtgtcaaatgtagccagtcatagctgtcaacaatccrcagattctcattatctttttacacagcatcgatgcagcygagmagtaacyagccaaagccactgtctttgtaggtttcttccaaccctgtccttattatgcagggcattctatcactgcatstgccatagcactccctaaccaaggcaacttctcagctcagcactggtgagacccccagctgctcagctgcaccttgtgccatggactttctgtgtctgccaccaacccgggtggcatcctctwggcctgccaggcagtgggaagcttatttcaaattcccatttttgcctgttttcatggatsacccttcatgccacttgtgttagttagggtcccctgagaagcggaccccaatacagtagtaaacatgtaaggatttattaggggaaatacttgtgagagaaattcatgagahagaaaatgctgggaaagccactggaccacaaagcaackctgagcctcagtgatgtagagagtgcaggaaggtcagctggaagcatcctagaccstgtgcaggctaagggaagttcagtaagggtggcagggagccctggagcttcagtcagccttcagaagagraatgtcctgccttagtttctgccctactttcctcaatcattggctggaaaaagccaggggtgggcatagtctcagagcaaatgtggcaatagatttcagacttcaagagctggrgccatcatcaattctgcttcttctagatgaggggctgggatgtgcattctcatgactgccacaatgatccagtggggagagaggaaaaaggttgacrataaagataaaaatggtattaattgatgaactgacacctttaagtagatgataagggrtggcaattggggcaccagaagagggtctggctctggctgggagcagaakggttaacccacaacagtccstcacatggtaaaacgcctgacatgtggtgcagytgcaaatgcatgagcagacagtggtggaatctgtgaagttgtcttctaatgtgttcagttttctcagtgaagtgggaagcaaggthatcagctgaagtaagaatggggaaggcaggttggatgtgtgagcacaaagaaaargtgtgtaagrgtcacccaggccaggaggaggctgagggtgagccatgcagggagagggtgattgctggccatggtagggacttcctatgtggtttggaatcctaaattttaagagaccagtcagcgtactgtgtgctkctctccagcctcctgcagctcatgggggcaggctcagcataggcmgaggtggaacccaccagctgtgtagttttgccaggtgagtgtgacaaytcaagggagagggaagggagggatggaaattatttaccatagaattcaaaatgggtgaggagggaggacaggacacccagggtgagggacagtgagtagatggcaggatcactggattgggaatcccaggagggtggaacgattgttggaattgatgtactacagggtagactccaagcrtggaaagcaagcacatatgcratgagtggtccactgatattacatcacagcatatgataaaatgatagtatctgtgtcctcagagcctgtggccaccttgcaaggggatgagtggaaagatggtcagagagtgggwagtgtgagatwgagagtatggaagggctggggttcttagccatgatgaggcctaggggataacaagggcatgagattcaggcagacaggagaagatcatggaggagaggagttccaggatctgagaggccaggaagcgagggcatcttctctgctgtgtgggtgtctattgctgccataaaaattaccacaaaccaaatggctttaaamagcacctatgtatcatggcacagtcgtgtggattgcaagtccacccagtctcatggggctaagatcaacatacgggaaggtctgcattcctttccatagactctggggaagaatccacttccaagctcattcaggttcttgcctgaattcacttccttgcagatagaaaagaggtttccacttccttgttaagagccayccttagctcctagagccttctctcagatactcacacayggtgcctaaggcacattcaatcctcctgcttggaacttctgacctcycctctccagcttctcctctgccttcctcctctgcagaatctgactccaaccagggcaggctctctgcttttaatrgctcttgtgatttgattgggcccacacagagaktccagcagaatctccctattttaaggtccttaatcttcattacatgagtaatrtcccttttgccaygcaatgcaacctgttcacaggttccaacgattaagactggacatcthtggggaccattactcagcccacsacatctgcgtatgttgaagtcaccaagagtcaaggagacagcaatgctggagagggtgacagtgaaccaggagctacaagactcaggattgagaagaacagcctggggcccacagggaatggttacagtgaggcaaatggggctctaatctgatgacagcctaggggttttagggaggagggaggcagaaagttctgagaaccacaatgaggagcaaggaccccacctcacctctgaacccaggggtacaagtccctggggaaactcccccatgtgggaggacttcggagggggtcatgtcctcagggaracccaggttgctgctggagctgygagatgcaggaacatcctgagagaggmtgaggaggttttgctgatgtggactgagaaatccagggggtgcactgggaagatttctgtggctggggaggtcggggagacagaatagaggtgtgcagagccttgtggggatgcaagtgcagagtatgtgggggacccagtgtgactgacacaaacagggacagagcatgatgagctcagtccaggtgcactccaggccgacgatggtgctgagcctgtgrgrgatgcgggaggaggagcaggggtggctttcacctgggctctgtccatggaggtgaggacagtgaggtggttgggtcttagtgctgtggggaacttttcttgacctcctgatgactggatggagtgtctgagggaggargggtcttacaggattgactyatgaccctgagggatgtgctcactccaggtctcaggtctgtcctgacacctttatttgtggcttagagctccctactgtaaattattrggagttagttcattttggagtttataacttaaagcagaaattcagatggttgaaatgtcattttcatgaasgtttgttattagtgtatcatttagattgtyttgcaamagtctcattttttttctaaagggttgccaatcttgttttaaatttacaaaggttgttaatytatcttcactgttaattggttgtgggttgtttaaacttatactgtgtagttttacatatctgtaacagcagtagtttgggcctcttatattctaataattaagactttcagctgwgtacacactgtaattcaagcacgagtcatgcataaccctagcactaagagacaagaggggaatccctctctctgaaaattttgcaaaattctgggttctttttccactgagtgggcacaagtyggctaatcatgaacatgaggtatttgtcctcatttaaaggtgcttcagaagcactgacccctaggaaggcctccttgtctgggtcaggcaccctacaccatggcagaggccatcttccctcccagtgtacagtgatatcccagatagcttactggttagctgctgtccactcttgggcagttttgtcttctaaaacatgggtttttatctgagaatcttcctgttcccagatgatcaaaactggggccatccattccattctgagccacttctgcccaggggcccatkgctatttcctccagtcacaacagaacaccccttcagaacagcctgcaggaaggcmccgtctcctcacaggctcacacatgcacggtgtgtgcacagagcttttgctctagttcaggaggtgtgtrgggagcctcactagtccaacagagcytggtaccagtgtcatatgccaggaaccaaggttataagggatacmatgtccccagacctaccagagaargcaaactcatacagcttgcaggaccagacaaggacaagaaacaagttcaaaagagggaaagggaaaytacagacrtacctcagagatactgcagatttggtttcagaccatggyaacaaacaagyyacacaaatttttgtttttccagtacatataaaagttatattcacactctactgtagcctaktaagtrtacaatagcattatgtatgaaagaactatgtacataccttaatttaaaattactctattgctaaaaaatgctaacggtcgtctgaggcttcagctaattttaatctttttgctggrsagggtcttgcctcaatgttgatgactrccrgctgttcaagagggtggttgctaaaggctgctgtggcaatttcttaaaataagacaatgaagtttatggcatggattataaagggggaatcagtacttaagtaaggtcaatatgagttttcaagtcaggtggacttgaatatgaaccctccaggcctttccaccaactagctatarakccttgggcacatctggcccagagctggccccgacrgacacttkcccagtgggtgagtgctcaatgaacccatctgagccaattgtctcatccaaccagtgatataattccttccttgcagaagaataagtgagaaaagacacagtgccaagaaattcagacacaagacctgcggaagtctgygccagtgctctaaagcaagttctgcctaaagcggcagaaacatttttcacattaggaacaggagttgtttgggatcctgtctggggccaggttgagagcagagtgggagtgggggcctgggcaggaccaggcactggagtgaagacaggcctggagagagctgactcctggaggctgctgagcggctcagacagctccttgcctcacctgccacagtcctccctctcccctggcctccaagtacccgggagtgcgagcctgggccccgggaaccggcaccttgagrgcdggagagggaccccgcccgctccctgtctccctgacgcgctctctccgcctccccgcgggdacccagcctcccgggctccctcctgcctaccgcccggccctggagccgcttacctgggagcttcttacggtgtagggggagctggggaggggacagagggacagggaccacgggagggtggcgtggggcggcgtacttggagatatgacctgaggagtctgcagacccbagaccggggcagaagmgccgtgggaggagctgctgagctctccaggccgccctttacctcctgcctccccagcccagttcatcttgatcctctcctcactagcccagktctccccaaggtcagggctcatagagcagcaggagttgggttccgggacgcgggatccggcttctctgggaatcttggattccaggaaggatcctggagatctcccactttatgaagcccaatctccastcactstgatggcgtctttagaccccactggaaaccagatacgacgccctcatcggccctggggaaaaaacaagagcaaagtatgagaggtggccatgaggtcagggaaactcctgcagaattctcaggaaaggaaactcttccgagctgggcccttgscttagtttgtcttccctgcccagccacctgtcccagagctggagaygcccaggtttaagccagagahtttggatactttccttgatggtgacataatttttgtcttcttctctcctggaagagaagccccagaaccatcagagtgatccagtctgcccactcttcttattattctgtctctccaatcactctccctgagctggactctccacccaccctcacattytggatagtgcagagatgtgagcatggccctggggcaggattgtctgcgtgcaagcccagctccaccacgacttgtaggcgaccttctttcctattgtatcacctgaaaacggaaaattagcaggcacaccccatagwtgtatmgtgacaattaaatgaattcatattttgaaagtgctaaggacacrgattaacacatagcaccatgacagtgtatgatattatcgctgttggttttttttttttttttttttagatggagttttgctctcgttrcccatgctggagtgcagtggcaccatctcggctcactgcaacctccacctcctgagttcaagcgattctcctgcctcagcctccagagtagctgagattacaggcgcccgctactacgcccagctaattttttgtatttttagtagaaacggagtttccccatgttrggcagtctggtcttgaactcctgacctcaggtgatccaccctctycggcctcccaaagtgctgggattacaggtgtgagccaccatgccccgccgttgttgctatttctttcatcctttttgcttgagcctcttctcttctttctaggttcccagggaaattctctgttggaagattatgbctgcaagaggcctccacctgggaaatgctggcccatggggsgatctcccttttattaaatggaahgattgttggtgaagtgacagctagtgagccagtgacagtacggttcatgtaaaaaagaccacatacctaggattacctccattttaataaagacacatcccacacattataagtccaatgtgatttgtgaggagattgctttgatttgctcacgaaaaatattactctactttctttgagagagttttgcaacacatttcaaatctctgcttctcatttcacactatctggctcatgagtgaaggtgataagtgtcgtactatgctctcaggtttgtctgtcagagtcatagtcahgtattacacataaagattattttcttgttatcatttatttatatatattatactcatgggatatagatagatattattacagtgcttaaatggctactactgatatctatacattttctctcttggtatatgatattaacacatagaattgtatactgttactttggtttccagcaattgctgattaggtcatttggaccacttctcccattgastacaactrgaaaaatgggaggaaaatacatatttgaaaagtctggttgaatttatagatgggctagcaaagcagtgaagatttgcttggccaggaaccaggaagaggcagaaatccagaagagcatcttgagctatggggctgcttttttggatcagatgcagtgacacctgcctcccaggcaagaagccaacttctgggattcagaactaaagtgtcccaatatttagaaggtctcttggtctctctagagttcagtgctcattggccagggctatgatactcacactcattccttggaggagccaagcttcgggtttggctgcctctgggacatttcatgctagaaaaaccccaabatgtgtagataaatggtatagaggacaccagccacccttygatkgagctctgcccagtrgtgtcccctcmcttccactcagagacaacatgcccatttcactaaattcatgaggacatggcbaacataagtaagagaacaccgggaggtacctkggacagagttccatgcagtcacagcttttgcgtctctgtgtcttttcccttcatctcaaccagagagcatttgcbgaggccgaagaacaaaaaacttcaaatattggagcggaatctaagaccactgatccattgtgatcaggaggctggagccatgtggtccaggaataatgaagtctgtgaggccttggtcaccccaaggctctctcccattaggagctgcctctcacdgctatcagggaggacccaggagctggacatggctttttttttttttttttttcatttctgatgagaacctggagaggtcccagagcatatagaccttgattgaaatggggccagagtggagtcaggcaaaaaactctaatgabtcagaggcacctaagtataaaataaaatctcaactcagagcttccatcagagcatcaggctcagtatctcctgtgtttgcactgtgagtactggagcttgatgagaagaaaaatagctacatgtgcagaaaaacatatgtagttagaaagctgggtcatggttcaaggtaagagggacccttgtcttttccrtggtagatagtggggctttctgccatcttrgttctgatggaccaagtgcagaagataaactttcctgctttcagcttagtgactggtaatagaagctggagttaagagaatcagtggcagcctctstctccatgccccagcccagtaaatctaagccaggacttggggctchggcactttcttctcactgtgcgtcctccttctctggctcaaaagagaaccacatgtaacagaaaccaagggctabaattctcayagaacccagaaaactggactaggggcctagagagtcahgtgcctgccattgttccaccgcttacgtgctgtgtgacctcaggagaagctctctgctctttgaatcatctgtgaatcatggacaaacacctccatgctagcaacattactgaaatgcagggaggaacmagtgattcaattgggaggaaaaaaarcaaagtgatgacatttactcctagacaaaachttttaggaaaatgtatcttaaaagtaggagaaaaacatataatacctgcaatcccctgcaaaagaagcctctttagcttactacttgttcatcgtctttctgtgaaatttgggcaaaactagctccctcattatctcaaataaattaatgcagttggcgattctatgtcagtttaggtctacaacttttgctttgtgtgaaactgaaagggaatgggaacatcttcatttttctgtggtggccaggggacactcagaggcttggaaatgaccctatatcatctattttcaattgcctcactctatcttttgaaatctcaggtaattcatactcctaaaaaaatctcatgttcatacataggacaaggtagaaaaggtaatattbctgttttaatttgctagggctgccataacaaagtaccaaaggctgggtgacttaaataataaatatgtgttgtctcacagttccagaggccacargtgcaaggtcaaggtgctgcagggttgatctcttctgaggcctctttcctttgcttgtagatggccacttcttctgccttctcaacatagggcttcaacatgtggattttggtggcgtaggaacacaattcctcttgtaacagtctggatcgtctttgacaatggatrttctaaaaaataaaagagagtaatagacagtacawccctttggctgaaatctttctcttggttttctaaaattttggtcttgcaatagaaaaaacaagaaagagaaccaaagtttagttcttcccggaaggtgaggcctcctccctaagtctgtgtaatcccagacactaagacatggtgctgtgcagttvtccaaagtcctactcactccagtgattctgtttctgtctttttaactgagcagaagagtctctttcaggagagcaacttcttctgatgctttatgggctttattctccttaaacttatggaatgaaaaagatcttaataaaaaggaaaatatttgccaaatttttatcatgctcataatttttgtacctttttaaatgccccatattgtgtkgtttattttttaaattttttaaaattgrtacataatatttgtacatatttatrggatacatgtgacattttgatacatgcatagaatgtgtgtatcagtcaagatatttagggtatccatgacctcaagcatttatcatttctttctgttgagaacattttaaattcactcttttttgttttgttttgttttttgagatggagtctcacaccatcacccagactggagtgcagtggcacgatctcggctcactgcaagcttcgcctcccgggttcacaccattctcctgcctcagcctcccgagtagctgggactacaggcacccaccaccacgcccggctaatttttttttttttttttgtatttttagtagagacggggtttcaccatgttagccaggatggtctcgatctcctgacctcrtgatccaccctcctcggcctcccaaagtgctgggatcacaggcatgagccaccaygcccagccaaatccactcttatagctattttgaaatatacatttttgttaactttagtcagtctgctgtgctatcaaacattagaacttattttctbtatataattggacatttgcatccattaacctgcatctctatattttcccacccctacattcttcccagtttctgggaactgtcwttctactctctctacctccctaagattaacctttttggctcgcacatattagtgacaacatgtggtatttgtctttccttgcttggcttatttcacctaacgtaatgacctttggttacatccatgtttctgcaactgacaggatttcattcttttttatggctgaattgcattccattgtgtatatatataccaccatttattcattcacccattgatgaattcacccattgatttvataacttcgctactgtgaatagtgcttcaataaacctgggggtgcaggtagtcttttgatatattgatttcttttcctttatataaatacccatgagtggagttgttggatccaatagtagttctattttttgttttttgagaaatcattatactgatttccataattgctgtacttactttcccaagagtgtacaacagttcccatttctccacatgctcaccactatccattattttttatttcctattagtagccattctaaataggataagatgatatttcattatagttttgatttgcattttcctgatatttaataaggttgagtgtttttcgtatacctgttgaccatttgtatgtctccttttgagaaacatctattcagacactttrtccattttttaattggattatttgtrtttttactgctgagttttttaagttccttgtatattctagatgttagttccttgbtggatgaatacatagcaaatattttctctattcaacaggttgcctcttcattctgttgattgtttcatttgctgtgctgaagctatttagtttaatatagtcccacttgtctattttatttttgttgcctgtgcttttgaggtcttagccataaagtctttgccbagacccatgtctggagtgtttcctgtaagcattcttctagtagttttatagttttgggacttacatttaaatctttaatccattttgagttgatttctgtatatggtgrgagacggttctagtggtattcttctgcatctggtagcattttcccagctccatttattctccattgttgcttttgttctttctccattgtatattctcagttcctttaccaaaaatgagttggctatcaatgcatggatttattgtgagttctcttttgtattccattagtctatgbgtctgtttttatgckagcaccatgctgatttggttactataactttatattgtatmctgaattcagkaagtgtgatrcctctagctttgttcttcttgctcakgattgctttggctatttgggatattttacgattccatatgaatttcacgattttttctatttctgtgaataatgatattggtattttgatagggattgaattgaatctgtaaattgctttgggtagtatgaacattttaacaatattctcccaatttatgtgcatgaaatttatgtgthtcatttttwaaattaatatttaacaatattaattctcccaatttrtgtgttttattttttttcttagagacaaggtctcactatgtttcccaggctagtcttgaactcccaggctcaaacaattctcctgtctcatcatcccaaagtgccaggattacaggtatgtgccactgbgcctggctcttccagttttgtgtactcttcaatttccttcatcagtgccttatagtttttgttttacttcctggggtaaattgattcttagttattttatcctctttatgatttgtaaatagttttgctttcttgatttcttcttcagattatatggtgcttgtatatataaatgctctgaaagtttgcacattgattttgtatcctgtaattttactgaatttgcttattagttctcaccatttatttggtggaatatttagatttttctttctttctttttttttctttttttgagatggagtctcgctctgtcatccaggctggagtgcagtggcgcgatctcggctcactgcaagctccacctcctgggttcacgccattctcctgtctcagcctcctgagtagctgggactacaggcgcccgccaccacgaccagctaattttttttttttttttttttttttgtatttttagtagagacggggtttcacaattttagccaggatggtctcgatctcctgacctcgtgatccgcctgccttggcctcccaaagtgctgggattacaggcgtgagccaccgcacccggccaatatttagttttttctgagtaaaagattatgccatttgcgaataaggctaagttggctttctcctttccaatttggatgccctttatttcctcctcttggctgattgctcttgctaggacttctagtgctgtgtagaataaaagtgatgaaagtgggagtcttagccttcttccagatcttggaggagaggctataagcttgtccctattcagtataatgttagctctgtgtttgccatatatggacatatcatggtgtattattcttttggtatactgttggattttgttgctaatatttttaattattatttttatcagcaacattatgatttttattataagatttttaaacttataaaatgtacatataccaaaataatcagatcttcatcaaatttatcaatgaattttgacaaatgcagcatattactcttgccactatcaatgtacacaaagatccctttttctcccttcaactcagcttccatgcctccagcagccattgatctgacggctatcaggatagcacagttcttcctgttttaaaacttcatacaaatctactcatcccatatggcctcccttgtatctggctttttgcgcttgttgtaatacctatgtgatcaayccatgttggtgcacgtatcagtagttctttcattttcattgctgataatattccattgtatgaytgaatcatgatttttgtamattggcagttatttcttrttttttactattataaataaagaaactatgaacatttttatgcagggattatygacaaaatcttcatttctcttgagtatatacctaggagtggaaatggtagctgtagaggactagcttgtttaactttattagatgatatgaaattgattttcaaaatggatgttttatattcytataggcaatggaggagagtacagattgttccacwtccttgctagcatttatagttattaatcattttaattttagccattctaatggttgcttagtggtttctcactgtggttttactttgcatttttccctgaactggccattcatatatcttcttttgcaatgtttcagatttctctacagattgtggaaggtgctaaataaagatgagtcctctttctctagtgctggacctaaagcagaatgttcagagtccctccacatatcccaatccagccaaccacayaccatgtttgcctccagaagctsctactccttcatccgtctttcacggtctatcacttcattctggcttaagctcacactcctccaggaagtcagttactgtgaaggtcactaacatgctcagtattgtcatgtctccacctgtctttacttctytgyagctttcctcacactcaacgactcctttttattttgctcaatttctgtggattcacttcacaaattttattataaggtagttctagctagaagaaaaaatagagaattataagaaatctttgtgaagctgccayccaggtttgtcaatttgtgacattttaatattattggctgtatgtagtatacatagaaaataacagaaacacgtgtagatagccctgattttccacagttctgttatgcatgtgtttcagtcaatactgtactgagcaaagcaagaactgttggtgaatgtgtgtcttgaatttgctgtatgcccctatattcttactaagttttaaaaagtctcttgtttttgtttgtttgtttgtttgtttttaacatggtttcactttgtcacctggactgaaatgcagtggcacaaacacaactcacttcagcctctacctgccaggcttaagcaattcctcccttctaggcctcttgagtagctgggaytagaggttcrcgccaccatgcctggctaatttctgtawtttttgtagagaaagggatttatcatgtttcccagacttgtctggaacgyctggggtcaagcaatctgcccaccttggcctcccaagatgctaggattaygggtataggcccccttgcctggctttacttttagactttttataaattgtttcttgctgattttgttatgcatttgcttgctttttccgttaacatggtctatgagakggatcaatgttcacacaaatagttcatttgttttcattgctagatagtattccatgggaggaatatgctacaatttatctcttccccacttcattgacctctacatagtctttattaaagacactgctgcaatgaacatgctgggacattgytttctggttccaagaatatgtgagctcccctaggatatgcatgtaggagtggggtcactgcacccttcccatatgatgctacatgatgtcaaattgttctctgaaagaaataatccaaatgyctatcagtagggagctggttaaaaagcattgcattcaaaaagggtaatctctattttaaaaaatgcatgcctatacaatggattgccaagaaatttttgaacaaaaaaaagaaagacatagtgtagttcttgatatttcttcatgggatggtctccrtgatacaatggtaagggaaaacagcaaggtacagaaaagcatatrtagtttgctaaaatttgtgtgcaaagggagaaagaacatayacatatacatttatatttgcttgcacagtcacaaaatacctttgaaagaataagcactacctgatgagtttggagtgagagatggtcaggatgatttcccgcacagtcaggttgtttgaagggaggggaaaagagcaagcagcaagttttgtgtttctgcaaagacagagacagtgcaggagacactgagagcctggagtgtcygggaaacccgagtctttctgccatttccccacttctgtgtatctggcagggggtggtgatttctcatccttgaacctaattgcactgtcagttggcccctcaggcctgggcagatgggatggttmatcccctgccctgcagcaagagggccctgtccaggaggcacccacagcaggggcagtgcaggtctgtggtcgctcctgctctcacctgtggtgtctcctgaagagggattgtcagttctggttccccgtgggygggaacggttgccttgtaggttactggggcaytggccaggaaaggggtgwgaaagttatgtgctaatttctcaaaattcctgctttaaatgctgatgtccaataaagatgttcgtagtttcagctgggtcttaaaaggatttccaccaatactaatgttgtaaysyatatcaaatgaaacaggaactcaaatgtggagctccctctccaggacggtccatgtgggagacrgtggctgtggcagtggcaatccccaagtgcaaagggtgggcagaggcagcctcaggctgaggggtctcaagaaactttctactccacagggagaagaagatcccctatgggctgtgagggcagtggcttgggtggaatccctgctaggaatccctgctaggaacaggagagraaggcctttcagcctccccaagcagcagccctggggagaagctgtgcttccagggatgagtggaccaggctggagcaagcwtggcccaagtgcaggtcatgggcctgggggtcagggtaggcagggcctccttgagcaagggggttcccagggtcaggtcagctgcagaccccatagcagctacatgtttccatgctgggcctgccrtgctgatgggattcttaatgggcttcccagttaggagctgcctgctcagggctggaagtggaggagcactgagctgcaggtggagggcagaaccacagtgtttagggcctgccyttgtgtgcaggtgtctctacaggtgaggtgggactggggactgaggragagaaggactgtgmgtgtgacccagcccagtcctggaaggacatggagccagggccagagcctctctttggggagtcctcctgctgtcagagctggccaggcttgagaggaggggagggcactgggtttttcccaggtcttgtcctttggtcctggggctcttttcctccttkcatggtggctggtgggcacagggcaggggytgatgttgatggagtcacgggaggggactggcaggggctgggaaaagtgccatgggagggagaaaaaagtgcagacatcatcttccctcggagaaagggtgaatctgatttgggactgactgaggagggagaagtcgtcagggagtaaaaagcagcactgtgcacccaggggagcacttactattttytctcttttctccagagcacatgagcctgcaaggcccagatcaacacctgactcagacagaacaccagggcagtgcacagctgggatttcagtctctgctctcagctcccaggtccactggctctactgagggcacctacactctgcagccaggcggcctggattgaacgccctgcccaggtctcaccagcactttttctcttgctggctcagctttctcatctatgaaatrgggaatgtaacarcatttatttcttgtggttgggtggatgaaaaktgttagtatatatgaggtgtttgcagctgtgccatattatttttgttattttgttatgattttattatattttaatacattaatgtcatgtarttgtattatcacaggtgagctttatgagtgagtgtcctggtgacggctcctccaggggagccaaggaccaactttcctggcacgttgaggtcccctygccctgtcacactctcctgcattaccccattctactctgtcttcatattttatactatagatatttagcttytaaatagacatttctggtctgtgttttatttcaagtgtctgggaacrgatagagttgaggttcaagggagaatgagagytctgtctagatgcrttgacatagcacaaagaaatctcccctcctccctgatatctccccgccagttctcagggaaggacagattcagagcaacacagacaggtctggraagggatggggggacatctgaagcaaatgttcagggcctgaagctgtgagagtacacctgccctrcagagttggagccytcatgtgatgatgcagagctgaagtgttatattctggaggggataaaaagtgctctggggtttcctgattatgaagggtaggggtcagtctgcttctaggagatgtggactgaattagtgaaaaataaatgcacagkgaatgaggatgartaaagcaagcatcagcatctcccgccatcagttcagactgattcggaggtggggaggtgggatagttcctgaccctgttgcaaggtttcttttgactttctggttttggggcacatagatggstggygctcttcttggtcagggcggcctcagctccacccaggtaaggcagtggtggcagagagttaggggagcacctatgaaacagaccaaggcagggatgggagccctyggtgcagcaggagtgyatgcaggacttgcctggaagcaagagtattagggaccctagtcaggtcctggtcccctccctgcctaggctcacaggacaaccagtaaagatgctggagtggggaattcattcatgggctatctatccagagttgtttatagacatattctttcaagtttgtattcagggttgatgtcacatacacatttatacatgctgttttatgtytaagtgtttttatattttggttagccytttatcattgttaaacaaagttgtcattaggcataaacttgcatgttaactgaagcttttgtttttattttattcgaagttacaattgcacataatkgaaagagtaaatatttgygcaggacttyctgagaaaaaygagtcttctctgcctttctagggagagtcctctcttctctrtttctgcctttctagggagcaaccactttcaagtttcagctgattcttttgactttactttcacatatctaagcaccaaagcaccatttctttrttaacattgcttgatttttcagttgcagccattgactattgcactgcacgatggtggaatcaatagttaagattacttgttctctttctttttgtatttttttcttattttttaatttatttaaataaataaaaatattctacctccccaaaacccctcaggacccacacacaggcactgcagcagcgacaggaggagggggcgctgggaacaggaaggacaccaccgcttggcctccggcaccggagggacaacctggagggctccgggagcaccgcaaaggtccaagcggagccaatcctcacaagcccagggaagggcaacgtgacaggccggcgsgacagccccaccgccgcgaagaggggctgcccaaaaggcaacagccataggagatgagcaggggtgcctrctgcgtcggagaactcatctccccaaccccaccgaygccacaaggtagagggcgaggacagcgaggtcggccggattccgcacccctgcctccaaccaccgcccatgggcggggaggagagactaccgrccgcaagcagaacgcagaacgagaagagcsgtccygttagccatgaatgtgtccctcatctgtaccgcctccggccccgcccgggagaacgcgacgtcaccacatccatcacttgttctctttcactcttcccgttctttccttttcccagtatatttatatagtaattatgtttaattcagccactccttgtttttttccgtgactcatcttctcatatgtcaacttgactacttttcacttgcttcgtagtatttgttcttcctcaagttaatacttgcctttgtttttgtttatgttctagataactctcattaatttaactttgatatctgttccatttctgtgactctgttaagaaattagagactttgaactttctattaattttactttcttggaaatgtccctcytgggcccttctggctgctcccatctggactggaggcttctacctgtgggacagagtcaccttcctaggatctccctccaccaccatctggggcggtgctttacatgcagtggagccacctggggtcctgacaaatgcagactgatcaacctgtcaaggctgggcctgtgagcctttctgtccagtttcatgagatgctggttctgctggttcatggataatagctggggtagcaaggrtctctctttttgtctcacagttttctgcatctctttttcatagtaagcacatgctaatatattttcaataaattcatgtgctcttttcctaagttggtatcagagctaattatttttttcattgcgccaaaatcyatattatataaaatttggtatcgtaacaatttttaagtatagagtactataatatgaactgtagcacattgttatgcaacagatctctagaacttttcatcttgcaaaactgaaactctacgctgaaaatctcctcawgaatccccccagcctaaccactggcagccgccattctactttcaggttctaagagtttagacgccgcatataacgaattgcgcagtattggaatttccttgtgattggcttattacacttagcattgttctccaggttcatccatgttgcagcatgtaacagaatttccttctttttaaggttgaatcatattccattgcctacatagaccacatgttcttcatctattcatgtgttgatgggtgctttgtttgcttccttgtcttggctatggtgagtaatgttgctgtgaatacrggtatgcaatgtttttcttttttacagcctccctcatttcagtggaattaatgttttagtagctacttctgatagcacatatttaaagtatttttgcatgcatcaatgtgtccattgttgttttgattctctcctggaagaggatggaaatgtatgaaggtgctgtttggcacagtatttaatggtgaagaagagacggtgtaactgaccagtgctgggtctcagcatcctgcaatttcagaactactgtgaatgcaaaaataattaaaaaaaccagtgctgcccagaaagggggagtcatccctaaatatggcggccctgggacagctggcctccctgccaggcctcttccatgggggcccttttctgcagtgactgggatttcttyccatttcactctaccctgtgtcctgacccaagagacaaggcatgtctgcmgctgtgcccacacttggagtgtgtcagtacattataaacactggctcagtggtgttagtacattataaacattggcttatcatgggttrttttattatttattgtgtattttgatttcactttactggcaacacaataaacaatgacatgatgaccctagcartcacatcctctttcttgtgtcaaaaagcaccttccaggaacgtgagaaggagacagttttcgctacagttgattaagggagagcccgctaggctgggcaggaggatttttaccgggaacctgtgcgatgagctgtgacatccttctccccaccttcaatctcagccccagcaggcacctcctgggcgcagaagcagtkcagcggcgccacctggcggtctgcamtcttcctttcccagatcaagcacagccctgaaatccacctgtccctcctctgtgcctgtgatttcttcaggggacaccagcgtgggtcaactttcttgtaaagcagaacaagcgtgagattggaccatgttacaggaggaatggtgtcatctctacctgtggagagatccctgtcaccgtgttcaggggaaggaccgagcctcactcccacgcagagaggaggctctggttgtaactgctccagtggagagatgaggacctcctccctctrcactgatggccaaagcctgcagactgggccaggcttcccctcagctatgtcctgtcaggttcatccaggactcaagaaataaactgtggacattgtctccagcgacgtggagctgaatgcacactcagtaatgagacagccttgccaggggtcctggggctgccggttgttctgggtgctcagtgtccagagaggaggatggggaggaggctttgtgcagaacaggaaccgtggagctggatgcacactcagtaatgagacagccctgccaggggtcctggggctgccggttgttctgggtgctcagtgtccagagaggaggatggggaggaggctttgtgcagaacaggaaccgtgccccataactcattttattctgcgttcgcctttttgtcataaaacacaggtgacataaaagaaaaaaaatcttaaaatggtgacctttaatcaacagtaaacactctttaaccatcagaaagagagagaagtttgtcannnnnnnnnnnnnnnnnnnnaacaagcgtgagattggaccatgttacaggaggaatggtgtcatctctacctgtggagagatccctgtcaccgtgttcaggggaaggaccgagcctcactcccacgcagagaggaggctctggttgtaactgctccagtggagagatgaggacctcctccctctgcactgatggccaaagcctgcagactgggccaggcttcccctcagctatgtcctgtcaggttcatccaggactcaaaaaataaactgtggacattgtctccagcgacgtggagctgaatgcacactcagtaatgagacagccttgccaggggtcctggggctgccggttgttctgggtgctcagtgtccagagaggaggatggggaggaggctttgtgcagaacaggaaccgtggagctggatgcacactcagtaatgagacagccctgccaggggtcctggggctgccggttgttctgggtgctcagtgtccagagaggaggatggggaggaggctttgtgcagaacaggaaccgtggagctggatgcacactcagtaatgagacagccttgccaggggtcctggggctgccggttgttctgggtgctcagtgtccagagaggaggatggggaggaggctttgtgcagaacaggaaccgtggagctgratgcacactcagtaatgagacagccctgccaggggtcctggggctgccggttgttctgggtgctcagtgtccagagaggaggatggggaggaggctttgtgcagaacaggaaccgtggagctggatgcacactcagtaatgagacagccmtgccaggggtcctggggctgccggttgttctgggtgctcagtgtccagagaggaggatggggaggaggctttgtgcagaacaggaaccgtgccccataactcattttattctgcgttcgcctttttgtcataaaacacaggtgacataaaagaaaaaaaatcttaaaatggtgacctttaatcaacagtaaacactctttaaccatcagaaagagagagaagtttgtcagctgacctagaagccccatcaattgacccagttcaatagtaaatttttattttttcaaataaaaatcaatcacatcctgacttttgtggtcctcacttctttgttctattttatattttcatcatcccaaatgatagtttagttttacctttaaaaataagttttttgttcttatttgttctataggttatccctttgaaattaatattgtctggtagagtttcctgttgtttgtattttgtggattgcaccccaaactatggtttaatatgcatctctattacctgcattttctagaaatttgtagtttggtatagaggtttgcatctattcagatttttttccccgtgagttttggtggtactatatcatgtttttcaacaaggggaagagtttaatactggttatttccctttggtgatgaaaattgtcattgctgttcagtggctagatctgttcattcattacggatggcaaagagttgtagtctcagtcttccatttcttttcatgtattatttgaataatttgtaaaataagagacttacccccttctactatttacctattataggaaaatcacttttaattaattagatgtgaaaattctaagaaaaatattagtagactgtattaaccaatgtgttataaacagactgtcttgaccaaggtatatagcccaagaatgcaaggatatttaaactttaaaccttttaatgcattttgccacttaattaaagaataaaaaacagagatgatgttattttactagattaagaaattattctagatgaaattcagcactccatctgacccatatttctccagtcatctccaggttaaagaaatcatgcaatcagattggggccactcaaataatacaaaataatctccacatctaaaggtccatgctcttaatcatatcagcaaagtcccttttgctgtgtaaagtaacatatctaaatggtctgcgtcttagggcttggacatatgtgtgaggccattattttggattccacagtgtatatggtggttgaatgaggtttaatttaattcttctctaattaaattcctagaagaagagaagtgagtaaatggaaagaggcattccagaaagaggttatcttaaaatattaaggaaatgtattattgtaaataaagtctygatgccacaaagaaatagcactcaaatataaaattttctttttttcttctcagcaaggcaattacttctatacaagggtgtgccctcacagatggagcaatggtgagcrcacccctggacaaggaaggggaaggggttcttatccctgatgcaygtggcccctgctgctgtgttattcccctattggctagggttagaccgcacaggctaaactaattcagattggctaatttaaagagagtgaaacaggtgatcagaatgagtcagggtggwgcaggtaactggaatgagtcaggctgggrcaagtaatcaggatgartcagggtggagcaggtaatcagaatgagtcagggtggagcaggtgactggaatgagtcagggtggagcaggtaaccagaatgagtcaggctggagcaagtaatcaggatgagtcagggtggaacaggtgatcaaaaaaggttgctttatgaggaagttaagtttaaaagtagagggcaaagaattgaacatactgacatgttaattattttaagagaaatttagaactcatacctaacagtatcatagcactgtgaataaaaagagatccacatttactcatactgcactggaacagaagatgttaaagagaaacagatatcttaaaatttgccacaggagaaacacagatcctctaagaagcaactggttaaaatgtaactgactatyccctgtcagccacagcagccagaagcaacataatcatcaaagatctgagagaaaaccaatgtcaaactagaaatttgcagctgacaaatctctctttgatgaataaaggtaaaacaaaacattatcatataaatgaaacygttgcactgtctccataatacccaatytcaaaatatctacaagaacagagaaatatgtaagaacaaaagagagaaagaaagcakaaattttaatttgtaatctttggtatatgtaactcagtactgtcataaaatattaataatgtagctttcaaagaaaaaagtcatgtaaaatacataacatgctgtgytataatttctttatttatcttcccacccccacctttgacttctatgaagtccaaggaagtttgaktcttttatctgaggctcaactccatagagcacagtacccagaataaggtaggtgcttaatgatgtttaccatwtgaatgagtttcctggaagtacttagcagatcaggaattctgatgcataarcacaattcaaaggtggctgaggagtgacatcagagaacatagtggcataggaactccaagggccacctctgcacagagacaatgtgcttgtaaaacatcactataaaaaaaaatcccttggctgggcatggtggctcatgcctgtaatcccagcactttgggaggccgaggtggggggatcacctgaggtcaggagttcgagaccagactgatcaacatggagaatcccagtctctactaaatatacaaaattagctgggtgtggtggctcgcgcctgtagtcccagctactcgggargtgaggaaggagaatcgcttgaacccgggaggcagakgttgcagttagccgggatcatgccattgcactccaccctgggcaacaagagcaaaactccatcaaaaaaaaaaaaaaaaaaattccctcrgagagctgttaaagcaagaattcctggacctaccaccagatattctgattgggttgataaagaatcaactgcattggaaccctgaaaaatcatcaaaggtttattgcaacctagcaagtccagaaaaatcaactggaactcaggagcagagctttgtggcamcatatcttacccttggcccattcctccctgttcaagtcagtagtgatcttgaagacagcagcctggttccttagtgtgggctccaatgccagtgggagccgagtggaccatgttctcraagtgttgtggttgtctaccttttcctgttgggtgactccgtgaaggatgataagaaatggcttacattgggctgggcatggtgactcatgcctgtaatcacagcactttgggaagctcagctgggtgcatttcttgagttcaggagtttgagaccagcctagacaacatggtgaaactccatttctacaaaaaatacaaaaattaactgggcattatggcatgtgcctgtagtctcagctactcaagaggctgaggtgggaggattgcttaagcccaggaggttgaggctacagtgagccaggatcgtgcaactgcactccagcttgggcttcagagcaagaccttgtctaaaaaaagaaaaaaaagaaagaaaaagaaaataaatggtttgcatttattttccctactcagaactctcttaggtcacagaggcagagggcatctgctaaaaccatttaagtgccactgaaccagcagctgcccccttggggcaaaaatatattacatgagraaggtaatagacatacagaaaagcctggaggagaaactgggtgagtgagatgggaatatgggttttgaaaagcttccatatccctgggaatctgtatagcctcctbcatgaccagtatgtcgcacagactcacaaagcacctgagaatgccctgtgttcacacctcttgctaactttcaatatctgcacaagtaggaaatgaaggccaaagcagkattgtaaactgcccagcagagtgttgagggcatgccccaaaacacacagagagcccagataaaaagattgaattttyttttcttatttctttttggctgaagatgtttcaggaaatatctatcaaatcatgagttgaccactaagcttacagaatagagacttcagtgatgacacacaataaagaatacagtctatacaaaaatagtttagaaaacatgattttcaaagtcaccacatgttagtattcaaaataaaaatgaggtatgcaattaaactagacrgtaagacccattctcaagaaaaaagagsaattgacagaaactgttcctgagaaaggccattgaacatacttactggacaaacaactttgaattgactgcttaaatatgttcacagagctaaaggaaactatgggcaaaaaactaaaggaaatcagaagaactatcttaactcaaatagagaacatcaataaaaagayagaaagtttaaaaagaaaccaartagaaattttggagctgaaaagtgcaataactgaaatgaaaaatttactagagtaattttactattttttactatattttactagagtaaatttactatttacttttttacaaaagcaactttcactatgcagaatgaagaatcggcaagcttaaaggtaagacaattgaaattatccagtttgaggtgcagaartaaaaaaaaattatgaagaaaaatgaacagaacttawgaaaactgtgagacaacaccaagcatatgcattttgggaatcctcaaagaaaggagagagaaaaagaagaatggctatttggaggaataataacttcaaatctcctaaatttgatgaaaaatataattttactcatccaacaaacttgatacattttaagcagcaagaattttaraagtccacactgagagacgttataatcaaccagtctacaccaatgacaaacagaccatcttgaaagcaataacagagaaggaacttttcaggtacaatggatcctcaataagattaacatacaaattttcatcagaaaccatggggttcaggaggcrttgggatgacaaatttaaagctgagaaagtaaaaggactatcaaccaagaattgtatgtctgcaaaactctccttcagaaatgatggagaaatcahgacattcacaggttaaaaaaagctgactgagatdgtctcaaccctacaagacatatatatatacacacacacmtatatatatttgtaattcctctcttgtttttcctatttgatttaaaagaaaatgtccatcgaccaatgaatggagaaacaacatatagttttttcctacaatagaatattatttggtcataaaatgaataaagcactggyatatgctaaaacattgctgaatcttgaaaacaagacaagtgaaggaagccagtcacaggaggctamrtaacttatgagcccatttttgtgaaatattcataagaggcaagtcgatagagaaagaagtggatttgtgrcgacagggtctgctggcaggtggaaatggagggtgactgcttaatgggtgcagagttccccctgaggtgataaaaacactctggaactagagagtgatgatggttacataacattgtgaacatacraattgtcactgcattgtgcactttaaatggttacggtggtatcctttgtgtttatgtgtattttaccacaatgaaaamgaggctgaggaagrtattccaaaatcttttgtatagtaaactcctgagtttgcttgagaatctgcctatctgtcttttcttctcaggacatcatctcctacccagagcamacctttgttcttctgcaagtagaaagccctctttcagaacattgtccaagatcagccaggcccaaccctcaaaatgactttctgtctttgacccaaatgctcaaatrcaactctggggctaatttcagtgggagtaagagattatccaatcaggataattcatttggagagaaaatgttttgcttaagtcagcaaagtcctttgctttcctaaaaaggatcctgcttaccagtgagtacagastttttgtacatttgaggtggagttctcagcagartaattaaagatatctgtagaaacaccacacacattatgtgtagctgactgattcacccctctgccacccccaattgaaggaaggagctgtattcttatcttggcccatccatcaactgaatgccgctggacatggaacattrcaagtrtgaagcttccagggttctcagttgctcttcctgctgttgyggagactccaytggtgtggctcacatccaggcaggcctgcaggaagctgtttcctaattctcaaggccaacattttcagtgaacccataccaaamccctaggttctcagggactcagattttcatctgtggaagaaaagaatccatctcactctctcaggtgtgatggtaattatatatattataatataatrtatatatacataattataatttatatatctataaaagagataatcagtattccataaattgatgatattctyagtgttgacttcattgcccaggtgaacactgtaacagaaggatgagtcatggattgtagaggaacaatattttttttactctctggaggagccatcagtaggcatttctgccatatggacttcaaatgagaaatttgttttaggttgagattggaaggagatctgaacttctttttattattattattttaaatatgaggtctcactatgwtctccaggctggagagcagtgactattcacaggtgtgaccatagcctcaaattygtgagctcgagccattctcctatctcagcctcctgagtagctgggactacaggtgcccaccacagtgttcagccacttttcattgttattttacttcaaatgttttattttgaatgttaaaaatacatgtttctacaytagaaatatgaaaatgtatttgattacasaagaatttaaaatgcacayatcaacacstggttgaattttaaagaaaaaaaaatgcagagaagaaagaaatatcacccaggcttcccctccaaagaaccactgctatcrtattattgaaacttcctggactgcagtgtgaatggtcatccctggagctatcttctgcagtgrtgctgayttccattcttttgttttctatgtatatatttttatatatgctttcattgtagaaagttgcattcataagttttggggttttttttaagatggagtctcactctgtcccccaggggctggagtgcagtggcatgatctcggctcactgcaacctctgcatctcggatgmaagtgagtcttctgcctcagcccctcgagtagctgggattacagatgtgcactaccacgcctggctaattttgtgtttttaatatagatggggttacacttgttggccaggctggttttgaacacctgacctcaagtgatccacccaccttggcctcccagagtggttgtgggttattttgaagttgctttttgaatgtattattatgaaagtagttttccatgtcataaagtctgcataaaatttacacacttctagaagctgcatcccatctcaaacaaggagaagtcascagggttcttttagatccatgtgctttcatcttgtcttttggtaaagaatattttgacaagcatgtttgtacatgaagattcttctatggttgtgattttaaaaattcatagaacactcaggayggacatggtggctcatgcctgtacttccagcactttgggaggctcaggctggcagattgcttgagcccctgagtttgtgaccagcctaggcaacatagagaaaccctgtctctasaaaaaattcaaaagaattagcygggcttggtggcacatgcctgtagtcccagctacttgggtgtctgaggtgggagggttgcttaagcctggaagattcaggctgcagtgagccatgaacaacactgcactccagccagcaagcccartctcaaaaaaataaattatagactactcaaattgtaagtattaaaccagtgtctgtgagagtttttctggaagggatgtgagtgggtggactggtggggaagatsctctctcactgtgggcagccacagtccaatcacctagtggcccagatagaacagaaaggtagatagaagtaaaatttctctctgtctctgtctctctgtctctctctgtctctgwctctctctctggaactggggctgggacacccttcttctcctgccttggacatcaaaactccaggttcgatgatctttggactctgacttttgcaccagtgagcccctttatcctcctgttctgtattctgggtcctcagggctttgactttggactgagccacrctactggcttttctagttctccagcttccagacagtctatcatgggacttctcagcctccataattgtgtgagccaattagcccaataaatcacctatctatctatctgtctgtctatctatctatctatctatctatctatctatctatcatcatctawcmtctatctatcawctatcatctatctatctattatctatctatcatctatgtacctatgctattggttctttctttcttggtaaccttaataaatcaacagacaataaacaaataaaacctgtcayagtatcactgataattgccattaagaaaaatatgcttgggttagaagattggtggcrgtggtgggaatggcaggggatagatttcagaagaggtcactggacaagacatttctgaacacttgaccatgggacatttragcagggaccttaatggtgtgaggagtgagccatgtggatcactgggcagcacatgcatgtgggagtcacarcaggggcaggtggtrgagacagggtggagtagacaagaaactggtgtgagtggagaagartgagctaggctgagagtaatgggatgaggccaaagtggccagaggggaccctgtgataaggagtgcataggaaatggtgggaaactggggtttccttgtgcctaagaagggaaggagctggagcgttcataggatatgcyctaattcccattggaaaggcacgctctctctgttgtgtgggtgatggacagtgggcatgagagwcagcaggcagcccagctggaaggcccttccggttttctatcctagtgakgatggttctggggtggaggtggcagaggagtgaraagtgattggatttggtgttgatatatatttttwaaattgtggtaaaacacacatactatacgatttaccttctaamaatttttttcagtgtacaattcattggcattaagcacatttacaattgatggtggttacacaaacaccaacatgcattttcagaacattttcatcatcccaacagagactgtacccattaaatgacagctgcccattgttcctgccytcagcccctggtaacctgtattctactttctgtttttgtgaatttgcttattctaggtgcctcatataagwgaaatatcatatttgycttttttytggcttattttatttagcgtgttttcaaggttccatccaatccaaatattcttcacttttaaggctgattaatattccatgtgtatatgcaccacattttgtttttccaatcatcctctgatggacacttgggttgcgtccaccttttggctattgggaatagcactgctatgagcatgactgtacaattatctgtgtgcatacctgctttcaatttttggggggtatacacccaaaagtggaattgttgcttcatrtggaaattctatgtttaccttcttgagaaagcrtcatcctgtttccatgrtggctgcactgttgttcactctcagcagcagtgcacaagcattccattttctccacatcctcaccaacacctggactagtgaagctgagcatattttcatgtccttattggaattccttatttttatgtccttactgtgtatcttctctggagaattgtctattcatgtcttttacccatttttgaatgagattgttttgctattgttaagttgtagttctgtatgtagtctggatattaattctttatcagatatgtgattggcaaatattttatcttattctatgcagtttcttttattttyactttyttttktttttttttttttttttttgagacrgagtctctctctgatgccccrgctggagtgcaatggtgcaatctcagctcattgcaacctctgcctcccaggttcaagcgattctcctgcctcagcctcccgagtagctgggattacaggtgcccaccactgcgcccggctaatttttgtatttttagtagagacagggttttgccatgttggccaggctgatttcgaactcctgacctcaggtgatccacccactttggcctcccaaagtgctgggattacaggcgtgagccactgcgcctagcctcttttcacctcttaatagcgtcctttgatgcaaaaaagtttttacattttgatgaagtcttatttgtcattttccttttattgcttgtacttttggtcaccagccaagaaacsactaccaattctaatgaccataagactttccctcagtattttcttttaagagttttacaggtttaactcttaagattagttctttaaggcattctgacttaatttttgaaaagggtgtaatggaagggcataaattttgtccagcatcattcttttgcatgtggatatccaggtttccagcaccatttgttgatgcaccatctgttgcagtggggctgacacatttgtaagatgcaatgagcaygaatacatgggagcaccatgaatttatttacatgtctttacttcacagttgttttgaggaggctttcactgagaaacctaacagaaatgaatayatatgacttcytataaaatgaaatttaagtaaaattatactttttaaaatgttaagactggagcaagactggaacatcaccagacaaacagaaacataggctgaaatgaagggtttatgtttatcttgctacaaattctgttggcccacaatctcttatgcttattgcataagagagccacagaktggggygatagctcaaataaccagtccctggttttctgcttcagaaacaagtttaaattctctgcttagacaaagtaaagaaaataattgaaagatgttgaatgtgaagttggcatctacaaagtcaaagaagtgagtagtaaatgtaaacatcaggaatccaaggagattctatctttttacacagaaatggcctcactatgcactgctgaagggagaaggtccctccaggagamcttcatgatgaggaaaaacccaatatgatgtaggggttttctgctgcagccctaaattgaattgtccttcgctctaaatacaggtctcacaaagttttatgtcttcaatgatttcacctgggccgagattttgttttgtttttgrtgttgtttgttttgagctgctgcctggggcttagaaaagtgacttggatattttgccaaagttgtatttctttgatggaattcgaaatccatgaacactctgctttcctgctgtatycccagagcgggttgagtaccttgcacttcttttcagcacttccctagaagtggtagaagatttggagttagggcctccctcaatctctgccctttctttaattcagaggatcacaaactgttgggggaagagtggtatcttgggcccccagttgatcggatgaatattaatatccaatgtcctgtaatgaagtcatgtgtgcatgtaacatcacttctgcacgcagtgtcatgggaaagtgggttcgcggaccccaggttaaaagcctaagcactaaakgcacagagctagagctctaggaggggcgggatggctggggtggaacgtcatcttgtcctttagtcctggggcattttcactcctcacatggtgggtgctgggcatctggcaggtactgatgttkatggagtcgagggagggtactggccggaactgggaaaaacagggttggggagataattaaggtgaacattattttttctgagtgtaagtcatggcttgaaatctggagagcctgaaggagatcccgctacctaaacccgttttccttttccctcaagcctcatttggccayaggcccagtgtcaacaccagggggcgccacagaccatgaaggcaccgcgcagctgggattgtttgtggtgggctcctgggtccctgacttaaccagggaagccaagaccctgcagccaggtggcctggattcaaccttcagctctggtcctactgacacttttcttcctggtgcctcagtttcttaatctgtgaaatggtgaggacattacagcacttacctctcgggcgggtttctcaacagcagccctattaagaatttgrracagagaatcccttgtggtctgtcctgtgcattgtgggaggtttgccagcagcaccccactcaccccctcccaccaatccccacgtgacaaccgaaaatgtcccaggatttttaggtctcccttgggtctagagctgcatttagtcaagcattttcccacctgacatttgagctcatctctgctttggtccacataaggccactttaaaaagatgttgtttctttaaagattctaaccatcttttaaacaaatctattttcttcctttatttctgcattcagttaatccttccaaacccttggtttagtatatctcaaaatgtatcaactccagttctagtaattaacatatgtgacttgcatgatatctgctatgacccctagtagagttctgattcctttagcacagggaatgtgttctcgattctgctctggatgatgtaaatcaatttattttactttacttgtctgggatgttgctcctcacctgtaaaatgtaaatgtggatatggcttggattactaagtggttttatttcttcattcacctgacatttgttgtgtacctgctgcaagtcaaatacatggyatgrtattgtttccttgttcacaccacagcaaatgagaaaatgagacattatagccaggtgtggcggcacaggcttctcgtcctagctactcagaaggctgaggcaggagaattgcttcagcccaggagtttgaggttacagtaaggtctgatatcaccattgcatttcaacctgggcaacagaccctgtctctgaaaaaaaggaaaaagacactgtgagctgtctacatgtactctatgtctcaggagactcatgtgctgtaatttttctaaatggcatctccatgtggtctttcatgaatgtttgtctggtatttcttttctatctttttactttcaacttttctgtaccttctactgaaattatggcttttgtaaatagcctacggttatttatttatttacttatttatttttatccctctgcactatttgtcttgtaattggagtgtctgagtccattacgtttaatgtcattgttgacctcrttgggtttaagtctgtccattttcatttactgccttctaatattatctttcttgctcaactatttttcttctgttgccttctttagatgaataaaaavctttgcattattgtggtcttctcagtaagtgttctagttacaaattctcttrttatttctttaattatctgagaaagcacaataatctgtgacttattataaccaacagcagaccataacttccctgactttcacctacctgtgcagacagcacaggggagaatcaatgctctggctctgagacacaggggtggtggaagtaggatagtgattggatgatgaatctgtagctgcagaggcatctgggcccctcaccttcattcctygtagatgtcacctccactggatgcctgcaatgccctctcctctgtatgctcctgccagagtctccccatctccaytgacagcagctccacccttctgctcactcagtccaatactgtgggtgtccttgattcttctttctcacaccacagataaatccattagcaagtgctgtgaattcatccagaatcccatcacttcccactatttcccctgctcacaccccagtcaaggtaagcgacgtctccatcctggaatactgcactcctttcccaccgttttycccactgcctcactagtcccccacctctcaattctgttctcagcacagcagccagagagaagctttcaaaggataagtcctaccatgtcccactttccaaaactgtcctctaactccccatgtcattcagagcaaaggtcaacatccttcchacaccctccagggcaacctgctctgggcacacctctgacttcatttcagtttctctctgttcaacacttctggcctcttcctccttccaggaacacagacaatttcctgccctagtgcatctgcactgaaggtttccctgcctgaaaagaactttctgagacatccgtgtagacaactcctcacatccctcaaatctttactccaaggtcacatttgcaacaaggcccatgctgaccacccagcacaacagccacctccctgtacccacagcccaccctctsgatcacctgccacacagcacttgccaccttctaactcaagcattttctgttcctactctgcttatactatatcatctgcctgcagaggtgtccaatcttttggcttccctgggtcacataggaagaagaattgtcttgagccacacaaaaaatacactaatgacagctgatgagcagaaaaaaatagaaaaaagaaaaaaaatgcatggataattttcatgatatctgccactacagataagcaaaaaaatcrtcacattctaaagctgtcctgggccacatgcatcccgagakctgcaggttggacaagcttgcatctagaatgtayacacgacaaggccagaaatttttctgtttttactttaacgatgttttctaaatgcaaaaacagtcaaatacctagcagacaacaaatgccacttgaatggatgattactgtagtgcgcccccctattctaaaggcaatatctttattaatgtagactcaggccaaatgtcattttgtagccgctgtggaacaatattatctcatgtggatataaatgcaccagtgcttttctcaccagggctgcttttgtgtcctccctccctccctcctcccacaccaatcctcctgcacactgcagcacacaaccatatttgtctcttsaggaaagataacccaaggcttatggctccaattatccaaccacatatgaatctaaattagactctgctttacaaatccatgagtttggtttggagccagcaataggattactacaactcagggcaggaagaagagtaggagagagagcagaagaggagttccaacagaaagtaaactacaatgaaaaactctgggacctctcctctcgggaagtttcagaatctgcttcctttaagaaggttggggaagccaggcatggtggcttacacctgtaatcccagcactttgggaggcagaggcgggcagatcacaaggtcaggagatcaagaccatcctggctaacatggtgaaatcccgtctttactaaaaatacaaaaaattagctgggtattgtggcatgtgcctgtactcccagttactagggaggctgagacaggagaattgcttgaacccgggaggtggaggttgcaatgagttgagattgcaccactgcactccagcctgagtgagactccatctcaaaaaaaaaaaaaaaaaaaaaaaaaaaaaaaaaaaaaagatggaaaatacaattgaaagagacctggaaggaggggaagaggtgtaggggtctgaaaatttttcttctgataacacaggaacttctavgtgtagggaccaycctaggtgatatccaagtctatgtgatcacaggtcctggtgggacaaggttctactgaagggccaaggacaatggagcagcaaagatgacccagctgagcagtgaccacataaagttcatggtggcctgagcacccactgggcgcagccccatctactctcctctcctgcaacaaatcagcacaagaaacacgtgtactgtggaaagttctcatgtcttccatttattttgtctctcaaatttcaggaatcttctcctttaattaacchatcaatctctcttggaaataatttgaaaaastaaatttayactcagattctaattttaatacagaagtaagttatagctcagtgsaccacaaatttgagacagagacggagacatcccagccccttttctggaacaggaaaggtgattggggaaggaatgcagttcagcatgaggaagagggtcatggtgggcacaggggtgggctggtctctgcasaaagagragtcagggttcttgaagtcacaaagggacttgccactcagtcccacacagggcagctgtttcacactacagaaaaatattcatgaacaaattcatatcagtcacagtgaggggtgacactttaaacagcccatcacatgctcaatacattsaagtcaaagaaacctcatagcacagctatgtccvctgttbccctcaacaacccacacacatcaggccccccggggtgtcacatttacaagccgtgagagacacattagagccctgggcactgtcactgcctagagtagaacaaaaacagcacctggtcagagaccacaggagatgtggccagaggaggaattgtggggtgggtgagctcccccatgggctcccaaacacaagatcccaaggatctcagggatcagcctccttcatacttacttgcagcctgagagtagctccctccttttcaatctgtgggaagaaaaygtcctgtgagaggccagaaaggtggcagggccatgaggtcctagaggaacctcctartcttggaccctcgagaagtttccagaaatgtgtgactgcagacycagggcgggatcaggaaaaacaaggaaagcagatgtgggtcctcgaccaactgccctcctaaggtctgtccttagccagggaccttcycctgacctgtgattactrggatcaggtccccatcactacaatcatcaaggtrataaatctgtccttcattgtcacaggtgctttacaaaagagaaggtgctggcacacagggcccaggctgggtaggcccatgagtgtggatggtgcttcccagtaaccaggcagggcrcacttctacctggggcttgaaacccccagtgggacaagaaaactcagaccccacttgtcaccccttccttacctgagctcttcttyctccacagcacagcagcgaccgcagctccagtgactacagctgcaaggacaaccagrccagcaacgatacccatgatggggatggtgggcagggaagactgctctgggaaaggaggtgaaggtgagggtctctgacccccagscctcaccaccgaccctgttaaaggtcttcagagaggctcctgctttccctaacagacatgatgcctccatctccctccttactccatctcagcatgaggggctcyggcagcccctcatgctgcacatggcayrtgtatctctgctcctctccagaaggcaccaccacagctgcccacttctggaaggttccatcccctgcaggcctggtctccacgagctccacgtcctgggtctggtcctccccatcccgctgccaggtcagtatgatctccgcagggtagaagcccagggcccagcacctcagggtggcctcatagtcaaagacagggtggtgggtcacrtgtgtcttgggggggtctgaaaggaagagtcagaaaaytcaagcactttgcatctstcatgggacactccagcagcacctggatgtgaccatcctaagaatgaaccagatacctggggtggggaagggagcacagaacccagacaccagcctggacacgggcacctgggataatctcctattccttggaaagttctagtctctgagcgggggagcagggacctcyggttctgacctgagtggaggccaagggactcagaggagctggagtcagacycccacacacattgagtgtgaggcagagaacaaggcctgaggggaaaagtcctggtgccaaggctgctgtggggtcaaagggaacccctgatcagtcytccagggattgtcttcccctccactccctcagagacttcatcccttaattgtcccagagagcaggacggrccctcagaatcactctctggtacaggatctggaaacccaggaggattcctctccctcaggaccagagggagggcgatattctrgtgttggtcccattttcctcctctccttgtgctaggccaggctgrgaggtctacaggagatcagggaggcgccccactgcccctggtacccgcgcgctgcagcatctccttcccgttctccaggtatctgtggagccactccacgcacgtgccctccaggtaggctctcctttgttcagccacattggccgcytcacacttgcgcttggagatctgagccgcagtgtccgctgcggtccaggagcgcaggtcctcgttcagggcgaggtaatccttgccatcgtaggcatactgttcatacccgcggakgaggcgwccgtcggacmccaggtcgcarccaatcatccactggagggtrtgagaacctggccccaccccytcggtcagccccgcccaccgagcctcgccctcgcccggacmcacccgcrgggattttggtaaaggcgcctkggggttctcccaggtagagggtctgggcgggtcccgcggcctcggggtggatcccagacccggagactcgggagtacccgggscgtccgtggggcatggaggtggggggtcgtgatctgckccctgggccggrgttactcactggcctcgctctggttgtagtagccgcgcagggtctgcaggttcattctgtcagtctgtgcgtgggccttggtgttccgtgtctcctcttcccaatactcyggcccctcctgctccacccacggcgcccgcggctccatcctcggacacgccgagtcgctgtcgaaccgcacgaaytgcgwgtcgtccacgtagcccatggcgatgaagcggggctccccgcggccgggccgggacacggcggcgctgaaatacctcatggagtgggagcctgggggcgaggagrggttgagacccgcccgaccctcctcccggcgcggctgccgrgtcctgcgcccccgccrggcsggcccctccctcctccgcgcaggggcygtttccctcctgaccccgcactcacccgcccaggtctcggtcagggtcagggcccccgagagyagcaggaagagggttcggggygccatgaccaccatccttggcgtctggggagaatgagtccgggtgggtgagcgaggactttagaaccagraccgcggcgacgctgattggcttctctaaaaacctgtcacctaatgggagtgagaactggggccgcccggtgagtatccaggaagaaggacccgacacaggttaggagaaggaggagagaatccccaacgcggggcctccccaayccatacaccgcctgtggggcctgagaccctgagagccacgcttgaggccctgggacttcgccctgaccccgctactcttgtgccaagcgttctgtctcagtgtctccctgagtcttggcccaggagctgtctgagaaaccagggagaaaccctcggcaaggtccctggccctctcccttcacttttcatcccggaatccctgtccctgaactggactccctgcctcccactccttgcctgtcctcctgtactcttctagaagaaaaatcaccccasggagcttgktgccagagagtgagctcgccctgggattgtaggtgtaaagacagggttttttttcccccttaaatctggaaaagttgtgcctgagtgcatgagatagaatagagaccagtttgctttttgtttattaactatagtgggtagcataaycttggtaacccctgaatgatcaggaatctaatmggtaaaaaatgtgactttggccygttggtatataaatgcatctaaaagcmttacaacasgactcacaaagctcttaagtttcactttcccagacartgtatctgtgactcccgcttgttttattttaaatttaccttcattccgtagccctaagtttccgtgtgagtccaggacatctcctcaagacaaagtaccacactatgttactatatgttgcaaccaggagccagcacaaactttattcacctcacagttgtaagtgttcagtgcagtcacaatgcccctcactagtgctcacgcactgcctgtttttaggaagtatccacatgtgagtggagtgtatattttttaggaatacttagtattttttaaacctgattaacataaaaaacaattagtttctaggcagacccacataagatattaaaggccaactgcaaagaacacccagcgaggctctgtagatggatgtawtaaaatctataaaayaatgtgtttaaacctaagagttcygctgctttggaattctttcctctgctccttttcctcacctcctgctcctccagcccttccctccgtccctctcatccctcaggccctcttctccccttaatccccaccaccctctcactcctgaaytgtggctctagcactgttccatgacctgctacatgagtgttctctctatagtggtcctgctactatgagtcagagtgtgtcatttctccacctaaaacactccagtggctccacctcattcttgtgaagcttctagaatgtcaggcacttgagcatatgagggcatacctggttcattgtagggactaaattattttttcttggctgaatgaatgaattatgagtgtattaaattgcatcacagaaaattataaaatgtaaaacactraaaaagttaaaaaagattttattttatgtaactagtgtgcgtatcaattcatcagttcattccaggagtcttttgagtctgtgtatgaattttataagactgggtaacaaattgtcacaaacattggctttaaacagcacccatttattgtattcattgatttatttttagakacagagtctccctctgtcatccaggatgaagtgcagtcacatgatcatggctcactgcagcctcaaattcctgggctcaagggaccctcctacctcagtcttcagagtagctaggactgcaggcaagtgccaccatgcccagctaattaaaragaaatgtagagacgagtgtctcactatattatcctagctggtctcaaagtcctggctgcaagtgttcctcctgtgtcagctcctcaaatgttaggatacaggtgtgcactaccacgcctggccaaataacacycatttgttstttatagtttcttaatcagaaatctgggcatgatgtggatggaatctctgttccggtcttcctaaacctgtgttttcattttgaatcctccttcaggcttatacagaggtggcagaatgcagtttctggcagttgtaagactgaggtccctgttcctcactggctgtcactgtagagaacagggagggctgcactyaatgcatggtgcccaccagcgtyctttcctacacagccccttcattttcaaagcccacagtggaggaaacccctyatgctgaatccctctcacactgtgaatctctatgctcaggaagaacccagtcctttcaaggactctccttattaggacagtccaagcaggataaactcagcctaaagtcaactaattgaggcccttaattatatctgctaaatcccttcacagcagcacctacattagagttggttgaataactgggggaaggtgaatgaccaggagctggttgttgggagccatgatagaatcagcccaggaagggctggatcttccttttgtgtttaatttggacacagttggaaaytgaagttcaagtaaagtgatcattrtgaatagtaataaaatacatcctcttcagccgtggaaattctcctttccttttaaaactaagttacatgtttaatatcttatagttaatttagaccaggkgtggtggctcacgcctgcaatcctagcactgttgaaggcagaggaaggcagatttgactccagaagttcaagatcagcctgggcaacatggtgaaacccccatctctacaaaaaaattagaaaattagccaggcatgttaattcatgcctatagtcccagctactcaagaggctgagatcagaggatcccttgagcccaggagrtcgacactgcagtgcatggtgatcatgccactgcactccagcctgggtgacagagyragaccctgtctcaaaaatagtaatatgatgatgataaatttagagcaaatgcaaattaaygtgtaataatacatcctctcttgtgaaaatgtattagttatttactattgtgtaacaaattatgtaaaacttagcagctcaaaacarcaaatattcatcatctcccacagtttctaatggtcaggaatccaggagcggttttcctgagtgcttctggctcagggcctctcacaaggttgcagtccagttgtcagcctagggctgcatcgtctgagggcttcactggggctrrggattcayrtgaaacatggcttagtcacatggctgttggaaaagcctagttccttgctgtctggtcccaggggrcctcagttcttagccacatggaccttcctgcagggctgcttatggcacagcagctgggtccccaagagctcatgatcccagagacagagagagagaaggtggaagccatagtgagtttcacattctacacccagagtcacaaactgttatgtcarcattactctatcagttagaagttgtattagtctgttctcacactgctataaagaaatacctgagactgggtaatttataaaggcaagaggtttagttgactcrcarttgtgcatggctgaggaggctgccccaggaaacttacaatcatggcagaaggggaagcaaacrtgtcattcttcacatggtggcaggagagaaaaatgcagagtgaagtggggaaaatccccttatatggtacatatacaccatggaatattatgcagccataaaaaggaatgagatcaagtcctttgcagggatatggatgaagctggaagccattatcctcagcaagctaacacaggaacaggaaaccaaacaccacatgttctcacttgtaactgggagctgagcaatgagaacacatggacacagggagaggaacatcacacactggagcctattatgggagggcagtgctgaggggagcattaggaaaaataggttcaaccgctgacttccacagcttgggggaatcatccccatgattcgatcacctcccatgaagtcccdccgccaatatgtggggathagaattcgcatgacaattcaaaatgagatttgggtgggaacacagagabaggccatatcagaagtgcatcattaagtccaagccacacttaagagagggaattaagctgcacctctgaaagagagctgtactaaaggacttacgtatatgttaaaagcaaaattaaaactattgtttcaggattttgtaaatcaaagacttcttttatctaattatttttctttaatgctttaagcttatcttttaatttaatttaatttaatttaattttaagttccagggtacrtgtgcaggatgtgcaggtttgttacataggtaatcrtgtgccatggtggttggctgtacctatcaacccatcacctaggtgttaaccctggcattcattagctatttttcctaatgatccccccatcactgccctccccgaacaggccccattgtgtgtttttcctctccctggttccatgtattctcattgctcagttcccaattataagtgagaacatgcggtgtttggttttctgttcctgtgtgagtttgctgaggataatggcttccagcttcattcgtatctctgcaaaggacttgatctcattcctttttatggttgcataatattccgtggtgtatatgtacyatattttctttatccagttcctcaytkgtgggcatttgggttgattccatgtctttgctattgtgaatagtgctgcaatgaacatacacatgcatatacctttataatagaatgatttatattcctttgggtatataacctttaatgggattgctgggtcaaatggtatttctggttctaaatctttgaggaattgccacactgtcttccacaatggttgaaccaatttacatttccaccaacagtgtaaaagccttcctatttctctgcaaccttgccagcatctgttgtttcttgacttttaataattgccattctgactggcatgagatggtatctcattgtagtattgatttgcatttttctaatgatcagtgatgtttagctttttttcttatgtttattggccacatgtatgtcttcttttgagaagtgtctgtttaggtcctttgtccactttttaatgaagctttttttttggtgtaaatttgcttaagttctttgtagcttctgaatatgagacctttgtcaggtggacagactgcaaaaattttctcccattctgtaggatgtctgttcactctgataatagtttctttcactctacagaagctcttttgtttaattagatcccatttgtcaatttttgcttttgtggcagttgcttttggcattttcatcataaaatctttgcccatccctatgtcctgattggtattgcctagattttcttccagggtttttatagttttgggatttacatttaagtctttaatccatcttaagttaatttttgggcaaggtgtaaggaaggagtccagtttcaattttctgcagattgctagccagttctcccagcaccatttgttaaatagggaatcctttgcccattgcttatttttgtcrggctcattgaagatcacagggttttagatgtgtggtcttatttctgagttctctattctrttccattggyctatgtgcctgtttttgtaccagtaccttgctgtttcagttactgtagccttgtagtatagttttaagtcaggtagcctcatgcctccagctttgttctttttgcttaggattcttctggctataggagctcttttttggatccatatgaattttaaaatagtttttttctaattctatgataagcttcactttttaaattaatgactaaaagtttgagacatcacagagccttaggtgttgaggggaaaacagtttgaggcagagaaaggagatacaacagtatctctgagtttttcttgccaatatctttaataacagcaatgttctcttcaatgagttaacacagttgagaacatagaataactagatcaaatagttccaagactttagtgctataaaaatartgccttgaaaataagtctttgttttgtctaaaatgtctcaaatttaggggaagtatgcccctagtgccagttttcttattgaaatatcgtcttccaaaaaacatttgcctacacttaaaaaaagaagtactgctctgtctctggagtagccatcctttgtttctttctctaattaacttgctttcacttagaaaaatattgcttaatcagattgcttttcatttacaaagatgtgaatctcatacttcagtcaacacatctagcatgccaataacttcggtttgatgcagtatcacgaaattgttagctcgaattgagaaactagttttttcrataactggctattcgatcrgcattctataatacacttaacatcttttgttgtgatattgaatgatatgtgatagaagtgatttggacaccactatgattctaaatagcatgccatcaggtgcttctgaagtggttttgtttgtttctttgttttcgcagtcctattgtgttttctattcatattgctattcyrtcactggttrttcctttctactcttttcttgtttcatttattttgatcaawgatgtgcatttccaattctgtaaaagtttaattcagtggtatgtgtggtagaatgtaacatcaaatcctttgcaagatggaattaccttgcacatcagattgaagattgtatacatgaaaatctacagagatgccagtgagccaaggatcaaatgacctatttgtagccaaagccrttttcatggcmtsgtggtcctctctgtcacatggctccttacaattctgtgtggttttgttccaatgtaagtagttctygbtaaggatgcttgcaatgaactttggtattcttttctctttcatttttataaaaaccaagcatattttactttgaaaaaatctrtttaaggaattaggaatttaagtcaattctttcaacwcaatgttttcagaacacatcatcaacatcaartattacacatttattttaaaagttccattttaaaagggaatggatgatatgttgtttggactttagccagcactgttgtaaaacacagaacctgtaaactaccctgggctgctkcccattcacatcccccaaaaggagactccahcctgagtcttgtgattattattcctttatttagatgtgtggtcttatttctgagttctctgttctgttccattggtctatgtgcctgtttttgtaccagtaccttgctgttttcataatatctataaagaaattatagagtttctttaaggatttgtgtaataagtatagatatatccccaatccaaatattagttagttttgatggtttttaagcttccagtacmgcaaattcctactgcatttattttcccatgatgcacattacatataggagttatctgtggtgtgggaggctgtcattcattcgtttttactgctgaaggtttacattttatggttataccataattgcactagttttctattgatatatatgtagctgattccagttcttgccataaacattagtgtgcmtgtctcctgggcacataggcaagaaagcccgcagagtgtatgattaggagtgggatgattggatgatatgttrtatggcctttaaccatactagataataataatatgatttccaaagtgattgtgccaacttaaacttatttatttatttatttatttatttatttatttatttttgagacgaagtcttgctctgttgcccaggctgaactgcagtggtgctatcttggctgattgcaacttccacctcccagttcaagcaattctcctgcctcagcctcccgagtagttgggattacaggcatgcaccaccacgcccagctaatttttgtatttttagtagagtcggggtattggaggccgaaagaatgagggtcgtgatcaactcagtataccactggaggctatatgagcaaacagcaaactgttctcatgaaagcaggatgttggcaaactgacaaactgagtttgctgccagaaggaatcactagaagcaagaagcccccgaccccttcttttagaacagatctttttgtctttgtctttatttctgtgttcatcccccttcattatatcccatagtaaccgattgcgacaayggggttttaccatgttagccagactggtcttgaactcctgacctcaggtggtccacccacctcagcctmccaaagtgctgggattacaggcgtgaaccaccacgcctggcytaaacttttgaaataagtgyrtaatacttgatgttgatgatgtgttctgaaaacaytgagttgaaggaattgagttgaaagccrctgtcttggctgcagaattatagcaggcatttttatttagattctgtcaataactttctgttgtttacttgtttctcatataccgtggcattgtacttttgrcatacagattcagaaaatgcttacttatagcacaatcacatagggttattttatatgttaggaaattttcataataaaaaggaaaaaatggaggaagggagggaaagaaggaggaagagaagaaggagtgaaagaagaaaagaaggaaggggaaggggaagaaaagggaaggaaagcagagtaaaaaggagggaaggcgagaggttgaatggaaatagagaagaaagagagggagggagggacagaaggaaggagaaagggaaggaacaaaaaagaaaagaaactaaaataaagaaaagaatacacgttgagaaactagaaaccctacgtatggccartrttatgaaaatggaaggaaataaagcagatgtacgtaacctgtatagaataatggaaatgtaagagggcttcattagttatccattgccgcataacaaactacccccaaatttagtgattaaatcaacaaacattgacgaactcaaaaacataatacaaataccagcaaaatggagccaacgcaagtagaagaagttgaataaacaaaaggattttacaaattggaataagaggacactggtgtgyagatgaaaatgattttgtagtccaaatcctccaaaaagcaagtgccatcatgggrttaaagttacarcattttattaggggacatacctgtcagacgatattgtgagggagtcaggttaccctgggaaaggcaacaggccgagatgcaagtgtgacccccagtgatggacagaaggagagaaggtttactggatgtttcctagaccacaggcaatctaaggagagttgagcaaggccatggagragacccggagccaccattggccrtcagaggagtcccctgtctcccaggaatgtcctgccttagtgtcactggtgtgagccatcactgactgggaacagcccatgggaagcagggcctccataccaatgctactgaggatgtcagagcacaggagcagggccttgggagattacccaggagtgtgactcaaacctgctgcccagatgggtctgggttcttggaaatcaaatcctctcargctaaattkctggatgattctgctcacacttacaatggggcaaggggacccagaaggttcccaggtggatgtctggtttccacacacacttctgccctcattgtgtgaaagyagccatgcctcctcctggggatgagggcctattacctgggcctggagagaaggacactcctcttctcacgatgtggtctctgggaacatgctctccaaacttctctggtgactaaartaatgtgtagttcaatgggctctcttttgtctacttttaagggtaccctcctttggaaaccaggacctcctaacccgcacagcccattgttgggasataaaaaaggcaaaataccttagtggrtgaatctaagagattggacatggagccatacctgcttccaccttttgatttctggaccyacatgttcttccattgagaacacagcaccatagagacatctctgattcaaacaatrtaccatgttctgaaagatggcactytcagagtgcttcctccaggctggcactgagttgtgcctatagaagacctgtccagcattccttgtggctggtagctcctgggtggtgcagatggtgataggattagtggaacccacagccatggaaacwttaaaactttccaggccaaatgggtccttcaggcagagaatgggctaggagcaccgcctagcctgcagatcaggaatgtcaacagcacccggagagtggtgctggctgagtgtcagagcaagacaggaaaacccacccatggaatatgrgcctatttctgtgaagatgaacctctggcccttccaggatggaagtagctaaatgtagtcacttgttacttagtggctggtcgcckaaagaaatagygccccactagggcacatcatgggctccaaatgctgacgagttgacattcaggagtggcagtagctggatctaccttggtagggctgggagagtcastgctgctggccycatacatagcctcatgcctgccactgtggttgctccattcatgcacccatcctaccaggcctgggctgacccatggtgaaggctggctaactgccatttgtctgtttggtwgttcagtgccacwtcacacttgggtgttttctgtgggtgtmarcrwgggattcaagctcaayccaggtggaccattttcacctgttgatgaatgctgttgggcctgtgcaatttatgactttgtgggtcacacagccacttggaaccacattgttgtttggtgtcycwtggtcaagcattctatcaaatcagkacaagtaacactaaatgttgcttctaacagggggcatatgtctctgctgtggatgayatgatcttactccagaatcccaggccctycattgtgactctcccactggtgcttggttcagctccatcctgcatctttccccaccactggcaccaccagccccaaggggtctgagggatgctggctgcttgtaccatggcctggatctgctrcarggtcctttcctgtgtgggccccacatgaaggtggcctcctcctatgtcacctagagtgtgggccaaagcaacacacctaaatgtggaatgtggtgtcatcagaactcaaagaggctcatcaggcagtgtgcttccttccttctggtgaggatgcaagatgaaacagtttgtcttttaccttggaggggacacacctrcattcccctaaacacttggcacttgttcacccataaaacttcacttcagtggccactcttgaagctctgtaaggtttaccttcaccttctggagtgtgcttgttttgccaaggactccagtgcastttctacctgctgctcatccaccccagtaaacatgaaattgtcaatgaaatgagctgatttaatatcctataggatatccagtatgtctagtgtagtcttaagactatatactatagcgggcagaggagttacaatagccctgaggcaaatgataaataaatgtgttgtggatcccacatgaatgtgaatcattccatatcccctttctaattggagtggaaaggaatgcactcaccaagtctgcagctgcacactgtgggcccaaggatttattaatctgctctaccagtgatatccagacaacataaaagctgcaattataactcctacttggccatacctagagtaatctcattcattctttaggcmtcatcaggctccctcagggacagtttgctggattacgtagagacgatagacagccccaacaccaccccacatccttcagctctctcatggtgatgtgacccccacagtactttcagtgccttccacaagacacatgaggttgcctggttgctgtggtgcccrctttccaccccaccctcccgtacccccatgtcactttcattgtgtcctgaataacagtttcaagtttgtctatggcttctgcgaggagccaggacatccagatagaatgggccacatgaatcaattggtaygtgtttctcctttcaggcagagtctcactcacttcacrcaagcacagagatccccatataggcaactagattatgagaaacaaacgcacccatccaaacccaaagaatggactctgagacccagagaacagcaaaagtgagagtgtyagtgacggttttgcaatattgggtgtctggaatgcaggcacaccagggagagtttcaacaatttattccctagtgckcaactccctcccccagttgctcattagctgagtaccaaggacttacgatcttcccggatgtcacctattggtagtttaagacttcwagtatgttccttagggttttktttttttttgctgcattttgttgcagcccataatgcattgtgattgtctcaggactctttaaacatttgacttatgtccctaatggctgcacttagttgataagaaagggtacaattatctatgttgcaagytagcctaaactacattttttggtgaggtggggaaggggtcgttgagggggccccaaccgataggtgcctggccagtgcatgaaagggaaagcaagaagtaggggggatggtggcttagtacattttccttctttatctctttatgaccatgtggcctgcttaaacctatactaaggcacatagaattgaaaatgarccatcacatgtaggttattttttacacccttaagtcctgcccaagccagggctgrgccaaggccctcgaacatccagctgtrgcctcctcctgctgcaggtgaggagtgggcagcagggagggccgtggtgcctgctttgtccccatcccggtctctgtctctcaggcttaccaggtygcatccaggtgggtgagttgggaattgcgtgctgattgctgagggcctggatgatcrctatctcagagggagcaaatagtaaaggcagatgtgatctagggagggctagaaactggagaggaatccaaggagaggtggtgcctctagtcccttcctytctgcatccccctcccctgtttctccagccatcaggaggacatcaagaaaaagacccacgagrcccagaatgagggcccccatgtgtacagcccctttgaggtccccttgtaacagggagagtcctgagtgcacatggccatcctctgtccactttgcagctccccatatgcctcatctgggagctgtctcaggggtgtcacgtcctctgggtccctcgagaccgtgctttttctgggttcccaccatatggcccctgtctccctgtgtttccttgcagataatatggaccagttgataagcagatgtccctgggctatttggggagtggggaccagccctctgtcagggcagctgtggtccctgttttcatcccatgtccaggtgttactttttccagcccccgagggtcatagtacccagtgggctgttttttgggctttgttctgtgctctgtggcctcaccttgcctttcctgagccaatktttttgttcttagtgtagtcrctgcctggtaagtttavaataagagacagtcagaatcatdtcccccacagtcaggttgtttgaggggagaggaaaagagcaagcagaaagttttgagtttctgcaaagacagaggcagtgcaggggacagtgagagtctgrggtgtccaggaaacccgagtctttctgccatttctccacttccgtgtgtctggccagtgaggtggtggtgactcatccttgaacctaattgcacagttagttggccactcaggcctgggcagatgggacggttcatcccctgccctgcagcaagagggccccgtccaggaggcaaccacagcrcgggcagtgcaggtctgtggttgctcctgctctcacctgcggtgtctcctatagagggattgtcagttctggttccctgtaggcaggaawggttttctcgtaggtcactgggacattggcbagaaaaaggcatgaaaattacatgttagtttctcaaaattcctgctttaagtattggtgtvcatcaacataatttcagctggataatcttaataggatttccbccaahactgatgttgtaaaggatgttgaatagaacaggaagtcaaatttggggcttcgtttctcagagggtccatgtgggagacagtgcctgtggcagtggcaatccccaggtgcagagggtgcgtagaggcagcctcaggatgaggggtctgaagaaaccccctactccacaggcgaagaagatcccctgtgagctgcgatggcagtggcctgggtggaatccctgttaggaatgggacaggaagggcttgcagcctcaccaagcagcagccctggggtggagctgcatttccagggttgagtggacaggcaggagcaagcacagcccaaatgcaggttatggggagggcaggctgggcctccttgagcaagggggtccccagcatcaggtcaggtgcagactccatggcagccacatatttccatgcvgggcctgtgagccccagggcttcctgatrgkatctctwgttaggagctgtctgctcagagctgggaggggaggaacagtgagctgctggtggagggcagaacccacagygtgcagggcctgccctggtatgcaggtgcctctgcaggtgaagagggcctggggtctcaggaagagaaggactgtgtgtgacttggcccagacctggaaggacatggagacagggccagggcctctctttggggaggcctctcactgtgtcagggctggtcaggcttgagaggaggaggaaagggcactgagtttcctcbtgggtcttgttccttagtcctgggtcctttcactcactgcamaatggatggtggacacagggcaggtgctgatgttgatggagtcacgggaggggactggcaggggctggaaaagtgcsatgggagggagaaaaaagtggggacgtcatcttccgtcagagaaagggtaaatctgatttgggagtgactgaggagggagaactcctcaggraataaaaagcagcactctgcacccaggggagcatttattggtttctctcttttttccagagcgcgtgagcctgcaaggcctgggtcaacacctggttgggacaggagaccaccagggcagtgcacagctgagatctcagtctctggtgtcagctcctgggttcgctggctccactgagggcaactagactctgcagycaggcgrtctggattcaactccttgcctaggcctcaccagcatgttctctctttgtgcctcattttcctcatctatgacatggggaaactacgagcatttatttcttgtggttggatgaatgaaaagggttagtatatatggggtatttgcagctgtgccatattatttttgttattttgttattttattatattttgatatattacatatgcagtaattgtattattataggtgagcwttatgagtgagtgtcctgctgatggctccttggtcctggcccagcaccagctttcctggcaccttgaggtcctgtcatctctgtcatgctctcctgcattaccccattctactctgtcttcatattttatactatagatatttaactcttaaatagacatttctggtctgcgttttatttcaagtgtctgggaagggatagtgtgaggttcaggagagaaggagaggtctgtctccatgctttgacacagcataaagaaabcthccctcctcccccacatctccccrccagttctcagtgagggacagattcacagcaacaccgaaagggctgggaagggatggggggacatttgcagccagtgttcaggggctgaccctgtggggcaacatcttccctgcagagttagagcccacatatgatgatgtagagctgaagggtgatatcagggaggggacggagagtgctttgtggtttcctgattacgaagagtagaggtcagtcagcttctggggtgaagtgactgctggggagattggattgaattaatgaagaataagtgagctgggattgaggatgagtaaagcaagcatcagcatctcccgccatcagttcagactgaytggggaggtgggatagttcctgaccttgttgtgtggttcctcctaacttcctggtcttggggacacagatgggtggtgctgttcttggtcagggcagcctcagctccatccagataaagcagtggtggcagagagagttaggggagcacctgtgaaacagaccaaggcagggatgggagccttctgtgcagccagagtggatgcaggacctgcctggatgcaagagaaggatgagggaccctagctgggtcctgttccctgactccbtgtgttcacagggcaaccagtaagggagctggggtagggaattcattcataagctatctatctagagatgtgtttatagacatattatttcatgtttgtattcaggtttgttgtcacagacacatttatccatgtgtgttttatgtttaagttactttggaatagctcagtcacaaaatcttaatctcttaatttgtgctgcctctctacacggamacacacacacagghggacacacacacmggcacacacacacattcacacacatgctatacaaacatgtctacctgtatctataaagaracatgttatgttattttattttttatttcttarattcatatatattcatgaggcacaagtgcaattttgctacattgctatattggttgtggtaaagtcagggccttcagagcatccagcactggagacaagcacattgtaccmatcaagaaacccctctattatacaccaactgccaacccccttacccttctgggtctccatggtccatcatttcacactctccttttatgtatataaagagatattaaccaaatacggcagagtggtarcttgaattttacygcaccrttctttcagcttctttgcacatttgaaaatttatacagttataagttggaagaatgagggaaaatagagagcaagacagtgctgaataggaataggctaggggttgtgtcccactaggaaccataattgatctttgccattttgaaagtgtgtcccctgagcagccttcagagagtcctggaggcagrcttgttttcacagtaataccaagatgccatctgcctgtttcattgtgttgacttttccattagtgctgcaaatgccaaggtcggtarcacacccagcacctmagcagaaccaggcagtggctccaaactgcagtcccrtttaagagtgtctttgatggagcagtaaaaaatttatgtggrttaaagtttgatccttgagtatacgtctttaatattctttgtgagaaaatgggaaatatgcataaracmcttactgcacagagaagcaggatggtagccttgagaaagggcacttgtgtgactcagttatkatttcaaccagcagatctcactcacctacggaaagacagttgtattaattcctgtttgggggtatcatgaataaagctgcaagagtatttgtgcacaggattttcgtgaacataaagtattccctygtttgaaataagtgcctaggagggcaattgctagtcataaggtaaattgcatgttcggtttgaagaaaactrcaatactcatttccagagyggctgtaccattttaaaatacatccctaccagcaatataagagtgtcccagttcctctgcgtccttgccagcatctgttgctacctttattttgtatttcagccattctcatcactgtggttttaatttgtattttcctactggataatgatgttgagcacctattcatctgcttattagcccagtatttatcctcttcagtgaaatgtctgttcrtgtcttgctcattgcctgttttgtatttggatttcatttttattgttgtttaaaatttcttcatatattctgaatacagtctttacakaatatgttgcctgcaaatatcttctctcattctgtagcttgtctttttatgctcttcataggtctctcacagaacaacagtttttagtgttgataagatccaatttattaacttttatggatcatacttttggtgttatgtytaagaactctttgtccagtcttagctctgatgactttttcttaaaaggyttgtaatttaaaaatttaaatttattatttattttagaaaaaaaattcttgcctaggctggccttgaactcctgggctcaagggatcctcccacctcagcttcctgagtagctgagagtacaggcctgtgataccacacctggctcaatgtttgccattttaactctgtgctttacatgaaagcttgtgactcaytttgagttatttttgtatgaagcatgargttttggctcaggttattttttttccactgtggttgtccagttgttccatcaccatttgatggraaagctctccttccttcattgaattgcttttgtgcttttgtaaaagtcagttgagcatgttttgctcatttttagttgagttgctcatcttcttacattgagtttaagaacttttcacatattctggatacatgttcttcatcacagatgtaatttgtgataaattgtgaaatattttctctcaatctacggcttgtcttctcattttctcaatattgtcttttggagyacttaagttttaaattttaactaagcccaatttgtctctcacttttttttcatctgtagatcatgttttttgtattttatgtaagaatcttttgcctaactactcaatgtcacaaaaattttctcctatattttcttttagaaattttatggttttaacttayaaattttagctgtttaggtctctaatttgtttgagcttatattttatatggcgataagtgtcacatcatattacctatgcaacttcattgaagatcaattgacaaaaaaatgtaagaatgtctttctagattctcacttctgttcattaatctctgtgtctctcgctttcacactgtctggattattgtagttttatatgacattccattttttttcaaatttgcgttggcttttctgcatcctctgcattttcacatacatttttaggattaaattgtcaattttccataaaatgcctgctggggttttgatagagattgtacwgaacctatagatctcttggtggagaattgycatcttaacaatattattgagctttccaaccgcatctmtccatgaatttagacctttaatttctctcagtaatgttttgtagttttcaacaaactctgctgtcttcctaaatttattcctatttctctctttttgtaactactgtgataggaaagtttagattttaattgcttgtatagagaaatatgttaataatttttaatttgaktttatatcctatgggagcttctggattcattttttagtgctagcaggcttttatctgcttgtgaattctacagacaaggtcatgttatctgtgaatagagttttatgttttcctttttatctggatgcctttaacttttaattatttgccttattgcaccagctgcaatctccagtacaatgttaartagaagtgttggatkggacatccttgcattgatctccatcttaggagaaaagcattcagtmtttcttcagcaagcatgattttagttgtgggttttttatagatgccctttatcagggtgaggaaggtcccctccattcctattttgttgaaacttatgaacatgagtggtgttaacatttttgtcaactgtttcttctgtatcttttgagataattatgtcttttattcccttactacagtgcattccattaattgatttctaattgttaatccagccatatattcctgggatgaatcccaytggtcatggaatgtaatccttttttacgtggctttctattgtctgccaatgtttgttaaggatgttttcatttatgtttattggtgacactggtctatggtattcttttcttgtcagtcttgctctgactttgatattagggtaatgtcagttctgtaaatgagctagaaagtcttgcctcctctcttcttgtctgaaagagcttttgaaatatttgatagaattcaccagtgaagatatctgggctttggcatttctttgtgagaaggttttaaaattactgtcttagtgtacagttctcttcagattttctatytatttttgagtcagtttcagcaatttctatctttgtataaatctgtccattttatctaagtggtctaactgattggcttcaggtttttcagagtattaacttataatgwtttttaacttctaaagggtcattagtgatactctctcttgtgttcacaattttggtaatttatctcatttctcatactgtctgttttgacttttggtcaagaaaacagacagaggcagctctgtgacagattctgtagtgggaagctttgatcattcatagctggcaagccagactaatgccagcaaccccaaaggagctgccaatggatcttgacagggaagtcactgactctggattgggctatgwtcaaccaggggtagatgtcaatgcttcaaaggctatacaagaaccagaaaaatggagattacaccaatttggactgttgagtcacatttctttacacaagaaaacacactttacagccttaaaaagccaacartgcacagggaaatgtactattcaggggaaactttgatagaatattgaaatggctgaccaggcgcggtggctcatgcctgtaatcccagcacttttggtggccgaggcgggcggatcacctgagtttaggagtttgagactatcctggccaatatggtgaaacccygtctctactgaaaatacaaaaattagctgcgtgtggtggtgggcgcctgtattaccagctactygggaggytgagacagtagaattgcttgaacctgggaggcagaggttgcatgagccgagatcatactactgcactccagcctgggcgacagagtgagactccatctcaaaaaaaaaaaaaaaaagaaatagtcagttgaaacattggttgtctaattgtctaaaaactgccaatataattgttgggcaatataaacatgaaggactggcttttatatcttcatgaatgtgcttactgtcaacatgggtggagctgcgaaactgactccactaggtagcttcctctctttttcctgatggatcagggtgatgctgttatgactgtacatacaattcttcttaaggggaggatgctggaataatgactacacttcatttcttatttctttttttacacagggtgcagtggtaccaggaacagggatgcaaatcgaactgccagaaacaggaattatccctaaggaaaaaaccataactatatttttatacctttatgtaagaattcccaagcaaatcaaggattgcgctgtgccttcatttcatctggcaaagtcgggattaactgtaagtagagctacgtagactggtggtcagatagcctgcactagttcctaacctatgtaacctacygtctatgatcaagagtagattaagagaagacatggtagaatactrttgctgcatgcagtctaggccagcacagcagccaaacctaatgtcacttctagaactggaaaagactgatataaagggacagaaggaggaatagtggctgagggtaggtgaataaatcaaagggttatgtaatgaggaaaattcaatattagcttatctcctcaaaagtggtgtgagcaagagatgttgtctcttaggtcaactatactggatgcctaaaagggtgaagctgtrtgtccctgagaccattcttgtttttggaacctgwtaagattgartggtgtctgcaaagctgagtgatgtcattctgggagacatattcatacaagaggatgataaactggcctaattttgaatgaccgaatgagacttggataatatgccaatgcttctttactgttataatccttttcgtatgaaaaatatgtggtcaaagaaaaggggrtaatatgagttatcacaaaaacatttagtyttgtccctsgtttctcctawaaaccttagaatctcttgagtgattagagtgtctttagaatactgaggaaaggactcttggctgagwggatcctggataccttgagaatgggggctgrctgccacagacacatasctatgatgagagggttgtcttattccrttttgtgttgctataaagaaatgtctgagactgactaatttatataaacaaggttcatttggctcaggattctgatgtctggaaatgtttgagcatttagcgagggcctcaggctgcttccactcatggcagaaggcaaaggggagctggtatgtgcaraagtcacgtggtmagagaggaacagagggagtaggaaggtgcgagactcttttaacaactagctcttttggaaactaatagggcaacaattcattgactcccgagagagggcagtatctctctgttcataaaagattggcccccaagacccaaacgccacccattaggccctaagtccaacattggggatcagattttaacatgaggtatctggggataaatatttatatcattgcatcctgtccctagccagccaaagctcacattcttctcacattgcaaaagacaataatcttctcccaattgtccaaaatgtgttgggttgatccagcatcaactctaaattccaaagtctcatctgagactcaaggtaagttcttatagctgtgcacctgtaaaattaaaaaaagttatttacttctaaaatattaatacaacagtggtagagacatttcctatacatttccattccaaaagaaataaatggrccaaaagaaatgaatgcagtgtcctcacaaggttgaaactcatcatggcagacattaaaacttaaagctctaaaataatctcctttgactctatatcttgaaccctgagcacactggctgstgcaagcaatggactcacaatgccatcttcagcctcatatccgtggctttggtgaacataatccatatagctgctctcatgggtgaacattgaatgcttatggcttttccaggctgagcttgcatattgccagtggctctatgatttagtagtcttggcaggggtcctgttcctgcagctccactaggaattgtcctggatattaaatttcccctttaaatatcagttccagtttcaggtcatgtctttgctcacacatatgtgcataggctattacaagcaggcaggccaaatctggaatgctwtgctgcttagaaatttcttccaccagatacccttatacatcactctcaagttcaaagttctacagatccctagggagggggaacaatgcctccaagttmtttgccaatgcataacaaaagtgacctttcctctaggtcccaataarttcctcatctccatgtgagaccttatcagcctggactchattgtccatatcactatcagcattttggtcacaacagcttaacaaatctctaggaagttgcaaattttcccccattttcttgtcttctgaactctccaaactcttccaacctctgcctgttacccagttccaaagchgtttccacattttcaasaatttttatagtaatacccaactcchggtaccgattttctgaattagttcattctcacacttttataaagaaatacctgagactgggtaatttataaasaaaataggtttctttctttctcctcccaccatccaagatgccaaaaggaaagaaggccaaggagaagaaggtggctccagcccctgctgtcgtgaagaagcaggaggccaagaaagtggtaaatcccttgtttgagaaaaggcctaagaathttggcactggacaggatatccagcccaaaagasacctcacccactttgtgaaatggccctgctatatcaggttgcagcagcagagaaccatcctctataagtggctgaaagtgcctcctgagattaaccagttcacccaggcaccagacagccaaacagctactctgctgcttaagctggcccacaatacagaccagagacaaaccaagagaagaagcagaggctgttggccbgggccaagaagaaagctgctggcaaaggggacattccccactaagagtccacctgtccttcgagcaggagttaacaccatcrccaccttggtggagaacaagaaagctcagctggtggtgatwgcacatgatgtagatcccatcaagctggttgtcttcttgcctgtcctgtgtcataaaatggggtcccttactgcattatcaaagggaaggcaagactgggacatctagtccataggaagacctgcaccactgtcaccttcacacaggttaactcggaagacaaaggtgctttggctaagctggtggragttctcaggaccaattacaatgacagatabgatgagatccgccrtcactggggagacagtgtcctgggtctcaagtatgtggtttgcattgccaagctcaaaaaggcaaagggtaaagaacatgccactraattgggtgaaatgtatgctgttgagttttctgtatgtaaaaataattaaaataatataaattttccttcaaaaaacaaaaacaaaacaaaaacagaaaagaggtttaaattgggtcatggttctgcaggctatacagaaagtatgattctggcatctgctcatcttatgagagggcctcagggaactttcgattatgctggaaggctaaggggaagcagayattacttacatgcctggagcaggagggagagagagcagggaggtgacacagatttttaaacaccagatcttatgagaattatcacaagaatagcaccaaagagatggttctaaaccgttcatgaaggatccatcctcatgagccgatcacctgccaccagacaccacctccaaaattagggattacaattgaacatgagatttgkgtggggacacagatccaaacaatatcaggggtcatggtggacatgaggatgggctggtctcccatttcttacctgttactgtagacatagacacattcagabgctttggcagaaagagaagccagaggchcttaatgtcacaaagaggaggcatgaacaaatcttgcatctcagtccctcacaaggcaatcttagaaaaaacatagtcataaactaatccaggtcagtcayagtaagttgtgacactgaacagcccaccacaccttgaaaaattccaaatcaaagaatctccagagcytagttgtgtcccctctgcccaactcctctttcacttcaggccctctaaggtgtcacttttacaagccdtgagagacacatcagagccctgggtactsttcctgtttggggtggaacaaaaacaaaatctggtcagagcccacaggtgatgtgactaaaggaggaattttggggtggctgagctcccccatgggctcctgtctacactatcccaaggatctcagggatcactcttcccaccmctaccacacttacatgaagcctgagcataactgcctccttttccatctgtggaaagaaaacaaactgtgagaggccagggaggaggcagggcatgagatcctaragragtttccagaactgtgactacagacccaggtcaggatcagaaaacccragggaagaggatgtgttgaggctggaccarttgtcctcctgaggtctgtcctcagcagggaccttcccctgacctgtgaytgctgggagtcaggttcccatgaccacaatcaaggtgataaatttgtccttcattttcacargtgctttacaaaagagtaagbgttgatagacagggcctctgaacagggtaaatgtgtgtggagatggtgcctcacaactaggcaagatatgagccwactcctacctggggcttgaaatccaccaatggaagaaggaaactcagagctcacccctttcctrcctgggatcttattcctccacatcacagcagcgacyacagctacagtgawtacagcaacdagaagaaccaggccagcaatgatgcccacaacggggatgatgggctgggaagacagctctaagaaaggaggtgaacgtgaggggccctgacccccaggcctcagcccygaccctgcttaaaggctccagaaggacttctgctttgcctgagaagagacatgaccbctcattcgtctccttaccccatcttagtgtgaggggctcaggcaacccctcrtgctgcacatggcatgtgtacctctgcttctctccagaagacaccactgcagctgcccacttctggaaggttctgtaccctgcaagtctggtctccacaaactctgcatcctgaatttggtcctccccatccsgctyctgggtcagtgtgayctccagagggtagaagcccagggcccagcacctcagcgtggcctcatagttggagatggggtggwgggttacctgtgccttcaggggatctgagggcaagaggtagaaaattcaggcactttgcattcctcatgagacacagcacccatgtgaccatcctgagaatggahgggacahctggggtggggaagggagcacagaacccagacarcattctggacacaggcacctgggataatctcttattccttggaaagttctagtgtctgaggcggaaacagagatttctggtcctgacctgagtggaggccgagggactcagaagasctggaatcagacccccacacrcattgagtatgaggcagagaacaaggcctgagaggaaaattcctggtgcccaaggctgctggggggtcaaagggkaccgcgtatcagtattccagggattgtcttcccctcctttcccgcagagacttcatccgttaattgtcccagagtgcagggcgggccctcagtcactctctggtataggatttagaaacccaggaggactcttctgcctcaggacaagagggagagggatattttagcgttggtcccattttcctccccttcttttggaagrtggctcagggatatctgcaggagatcagggargcgmcccgtggcctctggtacctgcgcattgcagvctctccttctcattcttaaggcctttgctgagccactccgcccaccttccsggcaggtaggttttgagcagctctgcatgttcctcctccaraacatctgagccgccttdtccgctgcggtccaagagagcagttcctggtttaggacgaggtaactggcgccatcgtagggtatgttcatccccgcgcgaagaggctccggtccgggtccaggtcgcagctgtgtatccactggaggtgggagaccctgtccccaagcccgcggtcagcctcagccactgagctcctcctctgccccgatcaatcccccggggatttgggcctgaactgaaaatggaatcgggtataggcacctggggttcttgtgtcgagggtctccacgagtcycgcagcctcggsgtgggtctccgattgtgctacagtgggtagcacaatcttggtagcccctgaatggtcacgaatctaatttgtaaaagagatgatttttggccccaytatatataaatatgtctaaacgcattgcaattagactcacaaagtgaagttttactttccyagactgtgtatctgtgactctggtctgttgtatttttacagtatctttatttcatagctctgagtttgtgtgtgcgagtccaggacatctcaatacaaagcacaatgtattaccgtatattgcaaccaggagcctgtacagaatttaattacctcagaattgcaagtgcttaatgcagccaaagtgcccttcgccagtgctcatgcactccctttattattaatttttttattttttatttatttacagacaggkcgtcactctgttaccctggctaaagtgcagtggcacgctcatgactcactgaagcctckacctccttggctcatgtgatcaatgctcctccctcagcctcccaagtagctggcaccacaggcttgtgccaccactcctggctaatttttctaaaaataatatttgtagagatgaggtctccctaaattgctctggctggtcttgaactcctgggctcaagcaatcctcccgcctcagcctcccaaaatgctggtattacaggcatgagctataatggccggcccatgcacttgcctattattatgaattattcacatctaagctatgtgtatattttattgagacatttggtattcttttttaacctttttttttttttttgagacggagtctcgctctgtcgcccaggctggagtgcagtggtgcaatctcgctcactgcaagcaccgcctcccgggttcacgccgttctcctgcctcagcctcccaagtagctgggactacaggcgaccgccaccacgcccggctaatttttttgtaattttttattagagacggggtttcaccatgttagctaggatggtctcgatctcctgaccttgtgatccacgcgcctcggcctcccaaagtgctgggattacaggcgtgagccaccgygcccggccttttttaacctttttatcttagagaggcaattagsttttagacagccccacagaatgcattaaagaccaaggtgcaagtaacactgtgccaggctttgcggataaatgcattaaaaatctataaaacactgtatttaagtctgagaattccattgctttagaattctttctctctgttcctttacctcacctcctgcttctccagcccttctctctgtycctgtcatccttcaggccctcctctccccttagtctctactactctgtcactactgaattgtgkccctagctctgtccctygcctgctgcccatgactgttctccccacaaaggtcagcaatcctgctaatgtgagtcagattgtktcatttcttcacttaaaagcctctaatggctccatcttactctcaagaagcctctagaatggaaggcacaagcacaggggctttgggttgytttgatcaaagttgtatctacagaatataaaagtatatctgccacatagtaggcactaagttaatttttgttgaatgaatgaatgaaatataattgtgttcaaaattgtatcacacaaaaatcatgaaatggaaaatgcaaagcaagttaggaaatatttggttttatgcaactactatgcatatcagttcatgaattcattccggtggagaaaatgtcatatacttatcctttgaatctgtttatttatttcctggcagtacataaccaattaccacaaacttagtggctgaaaacagcacccatttatttgtctacatttccttcatcagaaatccaggcctaaygtgatagactctttgttcagagtttcgcaaagytgtatcctcatcttaagattggggttctcccccaagcttgtgyagagtttgttggcagaattcggtttctggcaattgtaggattaaggtccctgtttccttcgggctatcagagtagacagtggggagggcttctaattcctattggccaccagtgttctttccccatgatccctccattttcaaagcccaaagtggaggaagcccctcacgctgaatccctctcacactgtgagtctctattctcaggaaraacccagtccttttcagagcttacctgattaggaccgtctaagcaggataatcctcatcttaaagtcaactgactggggactttaaatatatctgcaaaacctcttcacagcagcacctgctttagtgtcaactgagtaactggggtaacctgagwaaccaagggtggttattggggtgtcatcatagaatcagcctagcatagcctggatcttcctttcatgtttaaatagaacatacaagttgaagatcaaaaaatagatcattgttaatgataataaaatatatcttatatagccatggaaatttttattaaatattaaaagcaaatgacatgtttaatatcttataatgaatttagagcaaatgaaaaagttcagtgattcatcctctcttgtgaagctgtattagttatctactgctgcataacaagtcacctacaacttagcagctcaaatcaacaaatatttatcatctcccacagttatccatggtcaggaatccaggagaagtttctctgaatgcttctggctcagggcctctcacaaygttgcagtctagttgtcttccagggctgaatcayctgagggctcaaatggggccagggattcacaagacacaagaatctctcacatggcttttggaagaggctttagcttcttattgtctggtcccaggaggactcacttcctagtcacatggaccacaggcctccttatgacacaacagccagcttcccccagggctcatgattccagagaaagaaagaaccaaagtagaaacttcrgtgagtcttatgttctacacccagaatcacaaactattawgtcagcattactctatcagttagaagtgagtcattaagtccaggcyacacgaacagggagggaatgaagctgcacttctggaaaggaggagtatcaaagaatttataaacatgttaaaagcaaaattaacattattgtttcagggttttgtaaatcaaatacttcttgtatctgactttttttaatactttaaaattctcttctgtaaagttgattaaatatttgagacagagaaagaagatacaacaatatctcagattttttttgtaaatgcctttaatattaatattctctttgataagttgcaacagagttgagaaaatacagtagctaaattaaagtgtcccaagactttggtgccatacaataatgcctttacaatcrtaactaygtttgtttctcttcagaagtttctaattcggtttaagaatgcccaaaatgccaattttcttactcaagcatctacaaaaatatttgcctaatcagggtgctttgcagytagaaaaatgtgaatctcacacctctgtctatacactagcttagcatcatgacaataatttgtttggctagggtargcagaaattgtttactccaatctaggaacaagatttttcaataactggctattcagtgggcatcctatgaaagtttaacatctttcactgtgttttttaattagatgtggtagaagtgatttggactccagtatgattctgaaaaacactgttcttttgtgctgctatcattgctgtacaagcatctctttcatgttttccattcttattgctatttcatcactagttattcctttatgtcttttcatttaatttattttgctcaacaatgctttttttttttactgtgtaaaagtttaatccacttgtatgtgtggtaaaatgtgagcaacatatcamattctcaaattctttgcaagatacaattgccttgcacatcagattgaacactgtatgccagacaatgtagagagttgccaattagcccagggtcaaatgacctctttctagccaaggctatttttcatgagatyctggtcctctctgtcacatgactctttacaattggctgtggctttgttttaacgtgtgtagttattgctaaggatccttgagatgaactttggtattttcttttctctttcatttccaaataatcagtcaggaatggcrcacaaggtgcattttgaaaaatgacactttaaagatttgtgggccrggaatggtggctcatgtctgtaatcccagcactttggaaggccgaagttggyggatcacctgaggtcaggagtttgagaccaacctggacaatatggtgaaacccygtctctactaaaaatacaaaaattacctgggtgtcgtggtggatgcctataattccagctactcaggaggctgaggtaggagaattgcttgaacctgggaggcggaggttgcagtgaactgagatcacgccactgcactccagcctgggcaacaagagggagactccatctcgaaaataaataaataaataaataaataaagatttatgatcaagtaacttaactacctggacatcccctcctggcataaaaaacaaaacctatgaagccaccctcggctgttgtccaattctattccccaaaaggaacttctatcttgagtcttgtatttactattccttttcattgtctctaaagatttttacaataagtatatatatatccaaatcacagtttgacctgcttttttaaacttccccgtacagagaactcacacaatgtgcattcttctgtgatgctgatgcatgttatgtgtaggagagttatctctgatgtgggagggtgctgttcattcactgttgctgctgaagttttactttttattattatacgacaattttgttaattcccattgatgtatatgtgattgtttcyagtttttgccataaacattggtgtacatgtctcctggacacatagccaagaatgtccccagggggtatgatcaggaggcagatggtgggattatatgatgtatggacattaatcatactagataaggctaatttgatttctcaagtgcttgtaccaagaatgggaaagagcttgtgttgctcatgtgttctgaaaacattcagttggaggcagaaattaaatgttaaaaggtactgtcttggctatagaatcaccctaggcattttttcatattccattaacaacttccttttctttacttttatattataaattacggcattatacttttagcataaagttcaaataatgcttccttttggcctaaacacttggagtttatgaaaaaaatggagggagggagaaagctctgagggaggaaaggaggaaagaaggaaggaaggacagagaaagacaaaatttaaaatgttcaaaaataggaggaaagagttggaaacagcaagtatagctaatgttattaaaatgcaagggattaaaagatatgtagataatatccatggaataatggaaacttaagaaagccttaatagttatcwagtgctgtgtcacaaactacctcaaaatttagtagcttaatagaacaaatatctgttaactcaaagagatactacacacacaagtaaaatagattctgtgggggtggcagaagttggataaagagaaggattttacaggttggaataagagttattgatatgcagatggaaataatttttagtccaagtccttcaaggagcagatgccaagatgagcttaaagtctgcgacatcttatraggggacacacccgtaagggaatatgggaagtgagccagaaatccctggaaaaggcggcagaccacgatgcaagtgtgaccccaagtgctggacagaaggagagaaagtttgtthgacgcatcctagagcacaggcaatctaaggagagttgagcaaggccgtggaggaghcttccagctacagttrgccatcagaggagtcccgtgtctcccaggaatggcttgccttaahgcctgctgtgaccagtcactggctgggaacagcccatgggaagcagggctttgcaccaatcctgctgaggatgtcagagcacaggagcacagccttgggacattacctrtgagtatcrctcaatccttccttcctgagggttctgggctcttgaatatgaaaccctctcaggctgggttgctggatgattctgctcacacttacaacaggacaaggggaaccataaggtctccaagtggatctcttatttccacacacacatctcctgccctccttgtgtgatagcagccctgcctcctcctcttctcacctkcttgtrtctggacacatactattcaaacatccctgggggcagccataargtrtarttccatggactctcatttaaatgtctccttgccagggtgccccctttgggaaaccaggacctcctcccctacagagcccagatattggagatgagaagtgcaaaatcaccctgaaggtgaatataagggtttagatatggagccacacctgcttctacttcttggtttttggacccacgtattcttccttctgtaaacacagcactatagagacatctttgattcaatacatgcaccacatcctgaaagatggcasccattcctcagagggtttcatccaagctggcactaagttgtgtctgtagagacctgtccatgactctgtgtggctggcagcccctgggaggtgcaggtggtgataagaccaggggrtkccatggtcatggmccacgcttcatccccttmcctctgaggtgtgtcccgcgggcagataatgtactgaaattctgagccagtggctcaggaatgccaatagtgatactggctgagggtctaagagtagagaggaaaaccacaccacatctaataggtgcctatccctgtgaggatgaacctccgccccccgggccgcctcccacttgagctgggtgatctgagccgccgtgtctgcggctgtcaaggagcacaggtcctcgttcaggacgatgdaatccttgccatcgtaagcaagctggtgatacccgcggagtaggcgcccgtccgaccccacgtcgcagacagacatcctctagatgggtgtgagaccctggccccgcccccgcggccagccccgcccaccgagccccgccchcgccaggaccaacctgcggggattttggctgaaaatgaaaccgggtaacggctcctgggcctctcccgggtvaagggtctccaggtbccgctgcctcggcgtggatctcggacccagagactcggggagacccgggcggtycgtgggggatgtrgasgggtagtgabctgcgcccccggccggtgtcactcacaggcctcactctggttgtagtrgccgctcagggtccgcaggttcactcggtaaaactgtgctttggccttggcggtccctgtctcctcttcccaatattccggcccctcckgctccatcctgggactcgtggcgtcgctgtcgagscgcacgcactgcgtgtcgtccacgtcgcccacggagaggaagcggggatccgcgcggccgggccgggacatggtggtgtggaaatacctcaaggagtggaagcctgggagcaaggagggggctgagacbctcccgaccctcctcccggcaccgcaaccgggttcctgmgcccccgccgggcaggmccctagctactccccacagasgccgtttccctcccgaccccgcactcacctgcccaggtctgggtcaggaccagggcccccgagagcagcagaagcagggttcggggcgccatgacaccatcctcggcgactgggragaatcggagtcccggtgggtgcgtgggaactttagaaccgggaccgcggctacattgattggcttctctagraacccgacactcaatgggagtgagaactggggcagcckggtgagtakccaggaagaaggacccgacacaggttgggagagggagaagagaaaccctgcrragatggggaatscccagcgctgggcctccccaatccatacaccgcctttggggcctgagatcctgagagccakgcctgaggccctgggacttcgccctgaccccgctacttctgtgccaagcgctctgtctcaamgtttccgagtcttggcccaggagctgtctgagaaaccagggagaaaccctcgraatgggccccgtbcctctctcttcactttgcatcacggaatccccgtcccagaactggactccctgcctcctactccttacctgtccccgtggactcttctagaagaaaaatcacbccagggagcttgttgccagagagtgagcttgccctgggaatggaggtgtagagacagggttttttgttgttrttgtttgtttgttttttaaatctggaaaagttgtgcctgagtgcatgagatagaatagagaccagtttgctttttgtttattaactacagtgggtagcagaatcttggtaactcctratgatcaggaatctaatbggccaaaaatgtgactttggtcccttgacatataaatgtgtctaaaagcattacaacaggaatcacaaagctcctaagtttcactttyccagacaatgtatctgtgactcccgcttgtagtattttaaatttaccttcattccatagccctgagtttctgtgtgagtccaggacatctcctaatacaaggtagccactgtgttactatatgttgtaaccaggagccagtacrgactttattcahctcacagtggcaagcactcaatgcagtcacaatgcccctcaccagtgctcatgcactgcctgtttttaggaagtatccacttctaagtgttgtgtatattttatatgaacacttagtattttttaaacctgattaacataaaaaaattagtttttaggcagacccacataaggtattaaaggccaactgcaaagatcaccctgcaaggctctgtagattgatgtattaaaatatataaaacaatgtgtttaaacctgagttctgctgctttcgaattctttccctctgctccatttcctcacctcctgcatctccagcccttccctccattcctctcatccctcaggccctcctctccccttagtccccaccaccttgtcactccttatttgtgacactagcactgtcccattacctgctacgtgactgttctctgcacagtggtcctgctcctgtgagtcagagtgtgtcatttctccacctaaaacattccactggctccaccttggtcttgtgaagcttctggaatgtcaggcacgtaagcatatgagggcacacctggttcattgtagggattaaattaatttttcttgactgaatgaatgaaatatgagtctattaaattgcatcacagaaaattataaaatgtaaaatactgaaaaagttaagaaatattttattttatgtaattagtgtgcatatcaattcatcaattcattcgtgcactaccacgactggcaaaacaacacccatttatctgcttatacttccttggtcagaaatctgggcaagatgtggatagaatccctgttctgggcttccaaaagctgtgttttcattttgaatcctccttcaggcttatacagaggtggcagaatgcagtttctggcagttgtaagactgaggtttctgttccttgctggctgtcaatacagagaataggcagggctgtgctcaattcctggtgcctaacagtgttctttcctacacagcctcttcattttcaaagcccacggtagaggaaacccctcatgctgaatccctctcacactgcaaatctctatgctcagaaagaacacagacctttcaaggactcacctwattaggacagtcaaagcaggataaacccagcctaaagtcaactaattgaggcccttagttatatctgctaaatcccttcacagcagcatctacactagagttgcttgaataactgggggaaagtgaatgaccgggaggtggctgttgggggccatcaaagaatcagcccagcaagggttggatcttccttttgtgtttaatttggacacagttggaaattgaagttcaagtaaagtgatcattgtgaatggtaataaaatgcatcctcttcagccatggacattctccttaccttttaaaactaagttacatgtgtaatgtcttataattaatttaggccaggtgtggtggctcacrcctgtgattctagcaccgtggaaggcagaggaaggcagatttgttgactccagatgttgaagatcagcctgggcaacatggagaaacccccatctctacaaaaaaatttagaaaattagccaggcgtggtgcttcatgcctgtagtcccagttactcaggacgctgagataagagggtcccttgagcccaggaagtcgacactgcagtgcatggtgatcatgccactgcactccagcctgggcgacagagcgagaccctgtctcaataacaataatattaataataatgataaatttagagcaaatgcaaattaatgtgtaatactacatcctcttttgtgaaaatgtgttagttatttactattgcataacaaattatgtaaaacttagcagctcaaaatggcaaatattcatcatctcccgcaggttccaatggtcaggaatccaggagaggtttccctgagtgcttcttgctcagggcctctcacaaggttgcagtccagttgtcagcctaggcctgcatcatctgagtgcttcactgggactgaggattcacatgaaacatggatgggtcacatggctgttggaaaagccctagttccttgttttctgttcccagaaggccccagttctcagccacatggaccttccttcagggctgcttatggcacagcaggtggcttcccccagagctcatgattccagagacattgagagagaagggggaggctgcagtgagttttatgttctacacccagagtcacaaactcttatgtcagcattaccagttagaagttgtattagtccgttctcacattgctataaagaaatacctgagactgggtaatttataaaggaaagaggtttaattgactcatagttctgcattgctgagaaggctgccccatgaaacttacaatcatggcagaagtggaggcaaacacgtccttcttcacatggtggcaggagagagaattgcagatcgaagtggggaaaaatacctcataaaaccatcagatctcatgagaattccctcagcatcataagagcagcatgggggtaccatacccgtgatccaatcacctcccaggaggtccctcccccgatacatagggattacaatttgcatgacaattcaagatgagaatttggtgggaactcagagccagaccatatcagaaatgcatcattaagtccaagccacactcaagagaggaaattaagcagcatctctggaagggaacagtattaaaggatttgaatatatattaaaagcaaatttaaaactcttgtttcaggattttgaaaatcaaaatttttttatctaattatttttcgttaacccttttagcttgtcttttaatttaatttaattttaagttccaggttatgtgtgcaggatgcgcaggtttgttacataggtaaatgtgtgccatggtggtttgctgcacctatcaaaccatcacctatgtattaaccctggcatgcattagctattttttcctaatactcctcccaccactgccctcccccagcaggcaccagtgtgtgatgttcctctccttgtgtccatgtgttctcattgctcatctcccaattataagtgagaacatgtggtgtttggctttctgttcctgtgttagtttgctgaggatggcttccagcttcatccatatccctgcaaaagactgaatctcattcctttttgtggctgcataatattccatggtgtatatgtaccatattttcttaatgcagtacatcattgatgggcatttgggctgattccatgtctttgctattgtggatagtgctgcaataagcatacacatgcatgtatctttataatagagtgatttattttcctttggatgtataccctgtaatgggattgctgggtcaaatggtatttctggttctaaatctttgaggaatcaccaaactgtcttccacaatggttcaaccaatttacatttccagcaacagtgtaaaagccttcctatttctccacaacctcgccagcatctggtgtttatgtagttttaaataattgccattctgactggcattagatggtatctcatttgtggttttgatttgcatttctgtaatcagtgatgttgagctttttttcatgtttttttggccacatgtacgtcttattttgtgaaatgtctcttcatgtcctttgttcactttttaatgaagtttttttcatgtaaatttgcttaagttctttatagattctgaatattagacctttgtaagatagatagattgcaaaaattttctcccattctgtagggtgtctgttcactctgatagtttctttttctgtgcagatgctcttttgtttaattagatcccatatgccaatttttgcttttgtggcagatgcttttggcgatttcatcataaaatctttgcccatgcctgtgtcctgaatggtattgcctagattttctttcagggtttttataattttgtgttttacatttaagtctttaatctatcttgagttaatttttgtgtaaggtgtaaggaaggggtctagtttcaattttctgcatatggctagccagttctcccatcaccatttattaaatagggaatcctttccccgttgcttgtttttgtcaggtttgttgaagatcaaatggttgtagatgtgcggactttttttgtgaattctctattctgttccattggtctatgtgcctgtttttgtaccagtatcatgctgttttgtttactgtagcctcacagtatacttttaagtggggtagtgtgctgcctccagctttgttctttttgcttagtattctctttgctatatgagctcttattggatccatatgaattttaaaatagtttttttttctaattccacgataagcttatcttttaaaattaatgattaactgtttcagacatcacagagccttgggtgcttaggagaaaacagtttgaaacagagaaaggatatgcaacagtaactctgaatttttcttgtgaatacctttaataacaatgttgttttcaattagttaacacagttgagaacatagagtaactagatcaaatagttccaagacttcagtctgataaaaataatgtcttgaaaataagactttgttttgtctaagatatctcaaatttagtggaagcacgtcccaagcaccaattttcttattgaaatatcatcttcactaaacatttgcctacacttaaaaaaaaaaacaaaaactccgctatatggagtagccattcttttgtttctttacttctctaataacttgctttcacttaggaaaacattgcctaatcaaattgcttttcatttacaaaagtgtgaatctcatacttcagtcaacacatctagcttagcatgatgccaataactttggtttgatgcagtagcctgaaatggttagctcaaattgagaaacaagtttttttcaaaagctagctatttggtgggcattacataataaacttaacatcttttgctctggtattgaatgagatgtgatagaagtcatttgcacaccactatgattctaaataacacggctattatgtgcttctgaagctttttttctttttagcagtcctattctgttttccattcatatttgatattccatcactggttattccttcctattcttttcttgtttgatttattttgatcaattatttgcatttccaattccgtaaaagtttaattcagttgtatgtgtggtagaatgtaacatcaaatcctttgcaagatggaattaccttgcacagcagattgaacattgtataactgaaaatctagagagatgccagtcagccaagggttaaatgacctatttttagccaagtccattttcatggcatcctggtcctctctgtcacatgactccttacaattctctgtggtttgcttccaatgtaagtagttcttattaaggatccttgcaattaactttggtattcttttctcttacatttttttaaaattatactttaagttctatggtacatgtgcataacgtgcaggtttgtcacatatgtatgcatgtgccctgttggtttgctgccctctttaactagtcatttacattaggtatttctcctaatgctatccttcccccatcccgccacctgacgacaggccccagtgtgtgatgttccccaccctgtgtccaagtgttctcattgttcaattcacctatgagtgagaacatgcgctgtttgattttctgtcttcgcgatagtttgctcagaatgatggtttcctgcttcatccatgtcactacaaaggacatgaactcatcctttttatggctgcatagtattccatggtgtatatgtgccacattttcttaatctagtctatcattgatggacatttgggttggttccaattctttgctattgtgaatagtgccacaataaacatacatgtgcatgtgtctttatagtagcgtgatttataatccgttgggcatatacccagtaatgggatggctgggtcaaatggtatttctagttctagatccttcaggaattgccacactgtcttccacaatggttgaactagtttacagtcccaccaacagtgtaaaagtgttcctgtttctccacatcctctccagcacctgttgtttcctgactttttaatgattgccattctaactggtgtgagatggtatctcattgtggttttgatttgcatttctctgatggccagtgatgatgagcattttttcatgtgtctgttggctgcataaatgtcttcttttgagaa

SEQ ID NO: 17591 - DNA, 15644 bp, Homo sapiens
  misc_feature (1)...(15644): n = A,T,C or G, or insertion/deletion polymorphism (see Tables 1-2)
aggtgtgaagtgggaaatcaggggtctcacagccttcagagctgagccccaaacagagatttacccacatatttattacagtcattagcattgtttctataaatattaaattagttaaaatatcccttatgggaaacgaagggatgggccgaattaaaggaataggttgggctagttaactgcagcaggaacatgcccttaagacacagatcactcatgctattgtttgtggcttaagaatgcctttaagtggttttccaccctgggcgggccaggtgtcccttgccctcattcccgtaaacccacaaccttccagcttgggtgctagggccattatgaacatgttatggtgctgcagaaattttgtttatggccagtctcggggccagtttatgaccagattttgggggacttgctcccaacagtctccttctggaggatgactgggtagcagcccagggtagttttacagttttgtgttttacaccagtgctgggccccctggtagttacttgattataattccttaaacagagttttccaaattaaaatatacctgttttttatagaaatgaaaaagaaaagaatttcaaagttcattgcaaagattcttaacaagaactacttacattggaagaaaaccacagagaattgtaaggagctatgtgacagagaggaccaggatgccatgaaaacggccttggctacatataggtcattcgatccttggctcactggcatctctctagattttcaataatacaatgttcaatatgctgtgcaaggtaatttcatcttgcaaagattctatgttacattttaccacacatacaactgaattaaacttttacagaattggaaatgcacatcactgatcaaaataaatgaaacatgaaaagagtaggaaggaatacccagtgatggaatagcaaatatgaatggaaacagaataggactgctaaaaagaaaaaaaattcagaagcacataatagcagtgctatttagaatcatagtggtgtccaaatcacttctatcacatctcattcaataccacaacaaaagatgttaagtgtgttatagaatgcccatcggatagccagtttttgaaaataacttgtctctcaattcgagctaaccatttcgggctacagcatcaagccaaaattattggcatcatgctaagctagatgtgttaactgaagtatgagattctcatttttgtaaatgaaaagcaatcagattaggcaatttttttctgcacagcaaaagaaactatcatcaatcagagtgaacagacatgctacagaatgggagaaaaattttgccatctgttcatctgacaaaagtctagtattcagaatccacaaagaacttaagcaaatttacatgaaaaaaaacttcattaaatagtggacaaagaacatgaacagacacttctaaagaagacatacatgtggccaacaaaaatatgaaaaagaaagctcccatcactgatcattagagaaatgcaaatcaaaacgacaaatgagataccattttatgccagtcagaatggcaattattaaatagtcaagaaacaacagatgctggcaaggttgcagagaaataggaatgcttttacactgttggtggaaaagtaaatggttaatccattgtggaagacagtgacagtgtggcgattcctcaaagatttagaaccagaaataccatttgacccagcaatcccattgcagggtatatacccaaaggaatataaatcattctattataaagacatatgcatgtttacattcatggcagcactattcacaatagcaaagacatggaatcaacccaaatgcccatcaatgatggtctggataaagaaaatatggtacatatacaccatggaatattatgcagccataaaaaggaaggagatcaagtcctttgcagggatatggatgaagctggaagccattatcctcagcaaactcacacaggaacagaaaaccaaacaccacatgttctcatatataactgggaactgagcaatgagaacacatggacacagggagaggaacaacacacactggggcctgttgggggagggtggtgatgggaggatcattagcaaaaatagctaatgcatgccagggttaatacctaggtgatgagttgacaggtgcagcaaaccaacatggcacacatttatgtaacaaacctgcacatcctacacacatgtaccctggaacttaaaaaaaaattaaattaaaagacaagcttaaagagttaatgaaaactaattagatacaagaagactttgattttcagaaacctgaaacaatagttataattttgcttttaacatatattcaaatcctttgatactgttcctttctagaggtgcagcttaattccctctcttgagtgtggcttggacttaatgaggcacttctgaaatggcctggttctgtgctcccacccaaatctcatcttgaattgttatgcaaattgtaatccctacctattgggggagggacctcatgggaggtgattggataatgggggcggtgcccccatgctgttctcctgatgctgagggaattctcatgagatctgatggttttataaggggcttttccctgcttcattgtgcatttctctctcctgtcaccacgtgaagaaggacgggtttgcttccacttctgccatgactgtaagtttcctggggcagccgcctcagtcatgcagaactgtgagtcaattaaacctctttcctttataaattacccagtctcaggtatttctttatggcagtgtgagaatggactaatacttctaacttatagaatagtgccaacataacagtttgtgactctgggtgtagaacataaaactaactgcggcttccaccttctctctctctctgaatctgggatcatgagctctgggggaagccagccactgtgccataagcagccctgcaggaaggtccacatgactgagaactgaggccttctgggaacagacaacaaggaaccaggccttttccaacagccatgtgactgatccatgtttcttgtgaattcccagccccagagaagccctcagatgctgcagcccctggctgacaactggagtgcaaccttgtgagcggccctgagcaggaagcactcagggaaacctctcctggattcctgacgattggaaactgtgggagatgagaaacatttgttgtttcgagctaagttttacgtaatttgttatgcaacagtaaataatatattttcacaagagaggatgtattattacacatcaaattgcatttgctctaaatgtgtcatcatcatcattattatttttgagacagggtcttgctctgtcacccaggctggaatgcagtggcatgatcaccatgcactgcagtgtcgaactcctggggtcaagggactctctgacctcagcctcctgagtagctgcgactaccatcatgaactaccatgcctggctaattttctaattttttgtatagatggaggttttgcccaggctgatcttgaacttctggagtcaacaaatctccattcctctgccttccacagtgctaggatgacagacgtgagccaccacacctggcctaaattaattataagatattaaacatgtaacttagttttaaaaagtaaggacaatttccatggctgaagaggatgtattttatgaccattcacaatgatcacgttacttgaacttcactttccaactgtgtcccaattaaacacaaaaggaagatccaacccttgctaggctgattctatgatggcctcaacaagcagctcctggtcagtcaccttcctccagttattcaaccaactctaatgtaggtgctgctgtgaagggatttagcagatataattaagggtctcaattagttgactttatgctgggtttatcctgcttggactgtcctaatcaggtgagcccttgaaaggactgggttcttcatgagcacagagacttacagtgtgagagggactcagcatgaggggtttcctccaccaggggctttgaaaaggaaggggctatgggccgggcgtggtggctcacgcctgtaatcccgacactttgggaggccgaggcgggcggatcatgaggtcaggaggtcgagacaatcctggctaacaaggtgaaaccctgtgtctactaagaaaaaaaaaaaaaaattggcagagcgtagtggtgggcgcctgtagtcccagctacttgggactgagacaggagaatggtgtgaacccaggaggcagagcttctagtgagcagagatcattgggccactgtaccccagcctgggctacagagccagactcggtctcaaaaaaaaaaaaaaaaaaaaaaaaaattaaggggctgtgtaggaaagaacgctggtgagcaccaggaattgagcccctcccagttctctacattgacagctagccagaaacaggaacctcagtcttacaactgcaagaaactgcgttctgccacctctgtataaacctgaaggaggattcaaaatgaaaacacagcttttggaagcccagaacagagattctatccacatcttgcccagatttctgaccaaggaattataagcagataaatgggtgttgttttgccaggcgtggtagtgtgcaaatgaactgatgaattgatatacacactagttgcataaaataaaatctttctgaactttttccgtgttttacagtttataattatctgtgatgcaatttaatacactcatatttcattcattaagtcaacaaaaattaacttagtccctacaatgaaccaggtatcccctcatatgctcaagtgcctgaaactccagaagcttcacaagaccgaggtggagacactggagtgttttaagtggagaaatgacactctgactcacaggagcaggaccactgtgaaaagaacagttacgtagcaggtcatgggacagtgctagtgtcacaattcacgagtgacagtgtggtggggactaaggggagaggagggcctgaaggatgagaaggatggagggaagggctggagaagcaggaggtgaggaaaaggagcagaggaaagaatttgaaagcagcagaattcttaggtttaaatacattgttttatggattttaatacatccatctacagagcctagcagggtgtccttggcagttgtcttttaatacctcatgtgggtctgcctaaaacctaattttttatgttaatcaggtttaaaaattactaagtgttcctataaaatatacacaacacttagaagtggatacttcctaaaaacaggcagtgcatgagcagtagtgaagggcattgtgactgcattgaacagttgcaaatttgaggtgaataaagcttgtaatggcttctggttgcaacatataggaacacagtcgctactttgtattgaggagatgtcctggactcacacagaaactcagagctatggaatgatggtaaatttaaaatactacaagcaggagtcacagatacattgtctgggaaaatgcaacttagtagctttgtgagtcctgttgtaaggcttttggacacatttatacatcaaggggccaaagtcacattttttacctattagattcctgatcattcaggggttaccaagattctgctacccactgtagttaataaacaaagagcaaattggtctctattctgtctcatgcactcaggcgcaactcttcccgattaaaaacaaaaacaacaacaacaaaaatctacacctccattcccagagcaagcttactctctggcaccaaactccatgggatgatttttcttctagaagagtccaggtggacaggtaaggagtgggagtcagggagtccagttcagggacagagattacgggatgaaaagtgaaaggagagggacggggcccatgccgagggtttctcccttgtttctcagacagctcttgggccaagactcagggagacattgagacagagmgcttggcacagragcagaggggtcagggcgaagtcccagggccccaggcgtggctctcagrgtctcaggccccgaaggcggtgtatggattggggagtcccagccttggggattccccaactccgcagtttcttttctccctctsccaacctatgtagggtccttcttcctggatactcacgacgcggacccagttctcactcccattgggtgtcgggtttccagagaagccaatcagtgtcgtcgcggtcgcggttctaaagyccgcacgcacccaccgggactcagattctccccagacgccgaggatggccrtcatgsckccccgaaccctcstcctgctactctygggggyyctggccctgacccagaccwgggcrggtgagtgcggggtcgkggggaaacsgcctctgyggggagaagcaasgggccckccyggcggggacgcaggaccsgggdagccgcgcckggasgagggtcgggtrggtctcagccactsctcgyccccaggctcycactccatgaggtatttcwhcacmtccrtgtcccggcccggcmgyggrgagccccgcttcatcgcmgtgggctacgtggacgacwcgcagttcgtgcrgttygacagcgacgccgcgagccagargatggagccgcgggcaccgtggatagagcaggagrrkcckgagtattgggacsrgvasacasggaawrtsaaggcccaskcacagaytsaccgaghgracctgsggaccctgcgcggctactacaaccagagcgaggmcggtgagtgaccccggcccggggcgcaggtcacgacctctcatcccccacggacgggccrggtcgcccacagtctccgggtccgagatccaccccgaagccgcgggaccccgagacccttgccccgggagaggcccaggcgcctttacccggtttcattttcagtttaggccaaaaatccccccgggttggtcggggccggacggggctcgggggactgggctgaccgtggggtcggggccaggttctcacaccrtccagakratgtwtggctgcgacgtggggycggackggcgcytcctccgcgggtaccrscagkacgcytacgacggcaaggattacatcgccytgaamgaggacctgcgctcttggaccgcggcggacatggcrgctcagaycaccmagcrcaagtgggagrcggyccrtshggcggagcagttgagagyctacctggakggcacgtgcgtggagtggctccgcagatacctggagaacgggaaggagacgctgcagcgcacgggtaccrggggccacggggcgcctccctgatcgcctgtagatctcccgggctggcctcccacaaggaggggagacaattgggaccaacactagaatatcrccctccctctggtcctgagggagaggaatcctcctgggtttccagatcctgtaccagagagtgactctgaggttccgccctgctctctgacacaattaagggataaaatctctgaaggartgacgggaagacgatccctcgaatactgatgagtggttccctttgacacacacmggcagcagccttgggcccgtgacttttcctctcaggccttgttctctgcttcacactcaatgtgtgtgggggtctgagtccagcacttctgagtcyytcagcctccactcaggtcaggaccagaagtcgctgttccctcttcagggactagaattttccacggaatagragattatcccaggtgcctgtgtccaggctggtgtctgggttctgtgctcycttccccatcccrggtgtcctgtccattctcaagatagccacatgtgtgctggaggagtgtcccatgacagatgcaaaatgcctgaatgwtctgactcttcctgacagacgcccccaaracrcatatgacycaccacscyrtctctgaccatgargccacyctgagrtgctgggccctgrgcttctaccctgcggagatcacactgacctggcagcgggatggggaggaccagacccaggacacggagctygtggagaccaggcctgcaggggatggraccttccagaagtgggygkctgtggtggtrccttctggavaggagmagagatacacctgccatgtgcagcatgagggtytgcccaagcccctcaccctgagatggggtaaggagggagacgggggtgtcatgtcttttagggaaagcaggagcctctctgacctttagcagggtcagggcccctcaccttcccctcttttcccagagcygtcttcccagcccaccrtccccatcgtgggcatcattgctggcctrgttctctttggagctrtgwtcrctggagctgtggtcgctgctgtgaggtggaggaggaagagctcaggtggggaagggatgaagggtgggtctgagatttcttgtctcactgagggttccaagacccaggtagaagtgtgccctgcctcgttactgggaagcaccayccacaattatgggcctacccagcctgggccctgtgtgccagcacttactcttttgtaaagcacctgttaaaatgaaggacagatttatcaccttgattacrgcggtgatgggacctgatcccagcagtcacaagtcacaggggaaggtccctgaggaccttcaggagggcggttggtccaggacccacacctgctttcttcatgtttcctgatcccgccctgggtctgcagtcacacatttctggaaacttctctgaggtccaagacttggaggttcctctaggaccttaaggccctgrctcctttctggtatctcacaggacattttcttcycacagatagaaaaggagggagctactctcaggctgcaagtaagtatgaaggaggctgatgcctgaggtccttgggatattgtgtttgggagcccrtgggggagcycacccaccycacaattcctcctctagccacatcttctgtgggatctgaccaggttctgtttttgtyctaccccaggcagtgacagtgcccagggctctgatrtgtcyctcacagcttgtaaaggtgagagcttggagggcctgatgtgtgttgggtgttgggcggaacagtggacacagctgtgctatggggtttctttgcattggatgtattgagcatgcgatgggctgtttaargtgtgacycctcactgtgayagataygaatttgttcatgaatatttttttctatagtgtgagacagctgccttgtgtgggactgagaggcaagakttgttcctgcccttccctttgtgrcttgaagwaccctgactttgtttctgcaaaggcacctgcatgtgtctgtgttcntgtaggcataatgtgaggaggtggggagascacccmaccccsatgtccaccatgaccctcttcccacgctgacctgtgctccctcyccaatcatctttcctgttscagagaggtggggctgaggtgtctccatctctgyctcaacttcatggtgcactgagctgtaacttyttccttccctattaaaattagaacctkagtataaatttmctttctcaaattcttgccatgagaggttgatgagttaattaaaggagaagattcctaaaatttgagagacaaaatwaatggaasrcatgagaaccttccagagtccacgtgttgcttatgctgatttgttgcaggggaggagagtagatggggctgtgcccagtttctgttccggccaccatgggctttatgtggtcactgcttggctgggtcatctttgctgctccattgtccttggcccttcagtagaaccttgtcccaccaagacctgtgatcacagggagttggatgtcacctagggtggtccctgcatacaaatctccttgtggtatcaagagacaaattttcagacctgtccaggtcttgccttcctcccagggctttttcctcaattgtattttcgatttttctccaatctttttaaaggaaccagattgtgacatttgcagagaggaggggtcccatagtttctcatcatgattaactttctgttggaactcctcttctgccctcctactcttcttcctgctctgagttgtagtaatcctagtgctggctccaatccaaactcatagatttataaagcagagtctaatttagattcatatgtggttggaaaattgtacccataaggctagggttattgttcctgaagagaaatatatggttttgtgctgaagtgtgcaggagggttggtgtgggaggagggaggacacacaagcagccctggtgagaaaagcactggcggcatggatgtccatgtgaacttatgttctttagctgccacaaaacagcatttgccctgtggctacattaataaaggtatgggctttagaatagggaggtgctctacagtgatcattcattcaactgacatttgttgtctgctagggatatgactgcttttgcatttagaaagcatccttaaagtaaaaacagaaaaatttctggggttatggtgcatacgttctagatgcaggcttgtccaacccgcggctcgtgggctgcatgtggcccaggacaattttgaatgtgaggacttttttgcttatctgtggtgaacctgagtcctggagtgagtgcacccacctccctcagggtcaggagtgaatgctttaggaaccctccttttcagtgacctgcaaaagataaagggcacatttactgtgataacccagagtatcagccaagggggcttgaccttcaaggagttgtggggaaggttaataaagggtggtgtcccagggtcagaaaagatgggcagacagcaagggcactgcttgatatctatgataagcatgtggaattgaggagcaagcttcagattcagaatccagtgactaaggacatatctatatccctaagagaaagaaccttgggacacgatgatggttacatgctgggacaattccatcagcccttctgcaaaggagcctatagccatttaatcaggagatgggataagtattaacattgggtgtgagctgacattgctgcccagattcccacagcaccattatgtcccccatcacactggggcttacagaggccagggaataaacctagacacattatgccccatggtggaatcaccagttccataaatcctgtcctggttatctccccattctctgagtgcataattggccttgatgcactggcaactggagtcaccccacactgtgtccctagtctggagagtaagggatctcattgtgctgaagcccaaagggaaacatccctcatccaagccaaaccagaagcaatattgtgccccagggtgggtcttgtggagggtactgcaggtattataggggtggcactgccattacagacctgaacgatgcggggtggtgttgggattgcctgttatctccatataactcagcaatctgtacctgcagaagcctgatatggctaaagaatgaatggaattactccagacttgaccaagtaggagtcctgattgcagctgccatgctggctggatatcactgcctggggagattaataaggcctcaggcacatggcaagcagctgtggatttggtgagtgcattccctcccatttcatttagaagatggatatggaatgattcacattcacatgggatttataatacatttattgatagcttgcatcagggctaccttaactcctcaaccttctataaatatcaccttaagagacctggacaaatcagacatcccacagaatactaaatctcttcatttcattggcaatatcacataaattgggaaggatgaacaacagcaggaaagtacgctgaattccctggcaaaacatgtgcactacagaaggtgaagataaaacttacagagcttcaagagtggccactgcagtgaagtgttatgggtccagtggttaggggcatgcagagctcccccccgccacacacacacacaaagtaaaagacaaacttgcatcttgcatcctcaccagaaggaaggaagcacactacttgatgagcctctctgggttctggcaacaccacattccacatctaagtttattgctttggctgacactctgggtgatataggaggaggccagctttgagtggggcctggactggaaaggacactgcagcagacccaggctgtggtgcagtcagtcaccatccctcagacccctggtgctggaggtggcggtctggggaaagaagcaggatggagctgaaccaagcatcagtgggaaagtcagaatgcagggcctgggatcaggagtaaggccatggagtccacagcagagaaacatgctccatgttagaagcaacttttagcatgttactggccctgataagatagaatgcttgagcataggacaccaagcaaccatgtgattccaagtgcccgtgtgtattggcttctatgtgacccatagagtcattcactggacaggcccagcggcatctatcatgagacgaaaacggtccatgtcggttgagcctcaattccatgttaacacccacagaaaacacccagtcctgatgtggccctgaataaccaaacaaattgaagacaaattgaagttagccagtctgcatcatggatcagcccaggcctgataggaaggacccgtgagtggagcaaccacagtggcagggatgaagctacaaatgagtccagcagcactgtctctccactaccaaggcccacccagctactgcttcctctgaatactctgctcgtgagcattgcagaccaatgataggcaccaatagggcaccatttcttaaagtaactgactagcccctaagtgacaagttgaatagcttgaacaccatccatcctggaaggggcagaagtttatcctcacagggataggctcacagggatgcgatgtggtgtggttttcctctctgctctcagaccctcagtcaacaacactattggcattcctgatccactggctcagaatttcagtacattatctgcctgggggacacacctgttggggaaggggatgaagtgtgggccctgaccatgggatcccctggtcgtatcaccacctgcgcctctcaagtgctgccaggcacacagagtcatggacaggactctacaggcacaactcagtaccagcttggatgaaaccctctgaggaatgggtgccatctttcaggatgtgatgcatgtattgaatcaaagacgtctctaaggcactgttttcagaaggaagaatacgcgggtccaaaaaccaagaagtcaaagcaggtgtgtctcattccttatattcacccccagggtgatttacttataagtaaataaataaatacataacatgaatacttaaataaatttatttatgcatgtatgtatgtatgtatgtattttattcattatattcacccccagggtgattttgctcttcttacttccaaaatctggactctgcagggtaggaggtcctggtttcccaaagagggcaccctggcaaggagacaaatgagagtccatggaactacacattgtggttgcacccagggatatttgaatagtatgtgcccagagacaagcaggtgagaagaggaggaggcagggctgctatcacacaatgagggcaggagaagtgtgtgtggaaaccaggaatccacttggggacgtcctggtttcccttgtccgttgtgtgagcagaatcatccagcaacccagcctgagagggtttgatattcaagagcccagaaccctcaggaaggaaggattgagtgatactcctaggtaatgtcccacgtctctgcttctgtgctctgacatcctcagcaggattagtgcagaagccctgcttccatgagttgttcccagccagtgaccggtcacagcaagcacactaaggcaggccattactgggagacatgggactcctctgatggccaaatgtggctccaggactcctccatgcccttcctcaactctccttagactgcctctgctctaggatgcgtcgaacagaccttgtctccttctgtccagcacttggggtcacacttgcatcattgtctgccgccttttccagggatttctggctcgcgtctcatattcccttacaggtgtgtcccctcataagatgccgtagactttaagctcatcttggcatctgctccttggaggacttggactaaaaagcattgccatgtgcacaccaataactcttacttattccaacctgtaaaatccatctctttatccaacttctgccacccccataaaatctattttgcgcgcgttcgtagtatctctttgaattaacagatatttgttgtattaagccactaaattttgaggtagtttgtgacacagcagttaataactattaaggctttcttaagtttctgttattccatggatgttatctacatcttttaatttcctgcattttaataatattagccacacttgctgtttctaatcctttcctcctattcttttttgaaaatgttcattttgtctttctctgtccttccatctttctttcctcctttcctccctcagagctttctccctccctccactttttcacaaactctatgtggttaggctaaaaagaagcattatttgaatcttatgcttaaagtataatgccataatttacaggataaaagtaaagaaaaggaaggtattaatggaatatgaaaaaatgcctagggtgattctgtagccaagacaatggttttttaacatgtaatctccaccttcaactgaatgttttcagaacacatgagcaacataagttctttcccattcttggtacaagcacttgggaaatcaaattagccttatcttgtatgattaatgtccatacactgtataatcccaccatctgctcctgatcatacactctggggatatctttggctatgtgtcccagagacgtgtacaccaatgtttatggcaaaaaaactggaaacaatcacatatgcatcaatgggaattaacaaaattctgatataattacgaaaagtaaaattttagcagtaaaaatgattgaacagcaccctcccacatcagagataactctcctacacataacatgcatcacagaagaatacatatagtgtgagttctctgtacagcgaagttaaaaaaacaggtcagactgtgatttgggtatatatatttattgtaaaaatctttagagacagtgcaaaggactagtaaatacaagactcaagatagaggttccttttggtggataggattgggcaacagtctagggtggcttcataggttctgtttcttatgccaggagaggatgtccaggtaattagttacttgatcataaatctttatttatttatttattcatttatttttgagatggagtctcactcttgttgcccaagcgggagtgcaatggtgtgatctcgtctcactgcaacctccgcctcccatgttcaagcgattctcctacctcagcctctgagtagctaggattacaggcacctgccatgatgcccggctaatttttgtatttttcgtacagactgtgcttcaccatgttggccaggctggtctccaactcctgatctcaggtgatccacccacttcggcctcccaaaatgctgggattagaagcatgag

SEQ ID NO: 17592 - DNA, 13886 bp, Homo sapiens
  misc_feature (1)...(13886): n = A,T,C or G, or insertion/deletion polymorphism (see Tables 1-2)
ttttaaaaggagagaaacagagactgatttgagctttagcaaaattatgttggatgctgtgtggtgggatagattaaaaagagacaaaactaggccaggcgtggtgactcactcctrtaatcaatcccagcactttgggaggccgaagcaggcagatcacttgaggccaggagttcaagaccagcctggccaacatggtgaaaccccatctccacgaaaaatacaaaaaaattagcagggcatggtggcacatgcctgtaatcacagctgctaggaaggctgaggcacaagaattgcttgagcctgggaggccaaggttgcggtgagccaagatcgagtcactgcactccagcctgggccacagaatgagaccttgtcttggaagaaaagaaagaaagaaagaaagaaagaaagaaagaaagaaagaaagaaagaaagaaagaaagaaagaaagaaagaaagaaagaaagaaagaaagaaagaaagaaagaaagaaagaaagaaagaaagaaagaaagaaagaaggaaggaaggaaggaaggaaggaaggaaggaaggaaggaaggaaggaaggaaggaaggaagggagagagagagaaagagagaaagaaaggaaagaaagaaagaaagaaagaaagaaaaagaaagaaagagagagaaaggaaggagggagggagggagggaaggagggagggaagggagttgctaagaccatcttctagttgtcatggtgagaaaccataagaacctgacctaagacagaggcagtgggaatggtgagagacagatgcacgtaaaattgaatgtagactagagttggtgattgaataggtataggaaatgatagagaaagaggagacaagggtgactctcaactttccggcttggaatattgataggaagaggcactttttattgcatagagaatatggaagaaggggcaagggaccgggagagggatcagatccagtaccaagacatacgccctgacctactgcacacatgcaagaaatggctagagaaaataacaaggactcaggacaggaaacaaagggctggctgcagaaagaaggggctgtgtcaatgagacattgtctgtctaagatactagacaggggactccaggctgctgcttctgcctgcatgaaaggtggggcccacacctgctgcaacctgaccacgcagaccacatatgaggaaaggaggccaaagctgggccaaagagggtgtcatcatcagtgaacgcatccctggggtgcctgctgccaaaggagatagcagagggtgacacttggggaagtggggcctcggggccagaatctgaaggaaagcaatgcgccgcactagagagcacgggcagcagcacgcagtggggaggcaagctgagcagtgcaaggcaaagacgccgcagaggacaaactgcccagccaggattccccgcactgcggactgggacgctctgctggactgaggtggggcctcgcagaggctgaaatgagccagaacgctgggacacaaatcaaatccctccatgctgaagggtccatggtgttgactgctggctactttctgtcaccaccacctaaggaatcttgggtggtcagtttcccaaagatcaagactgtgacaccatggtctttctttctctctttctttcttttttctttttctctctctttctttcttttgctttctttcttttttcttcctttctctctttcttctttctttctctctctttctttcttctttctttctctttctcctttctttctctttctttctttccttccttcctttctttttaaagcaaatcataaccttttagatcaagttactgaaaacttctttatataagtttacatttctctttctaattgcatctttatcacgacactcaattctattttttttttttttttttgaaacagagtctcgctctatcacccaggctggtcgcagtggtgcgatcttggctcactacaacctcccaggttctggtgattctcctgcctcagcctcccaagtacctgggactacaagcatgtgccaacacgcctggctaattttttgtatttttagtagagatgggtttcaccacgttggccaggctggtctcaaactcctggcctcaggtgatccacccacctcggcctccaaaagtgctgggattgcaggcgtgaaccaccatgccccacttcaattctcattttatttaaagattcttccttggctatggagacccatcacacttctgactctctctcctgattctgtgtgtgtgtgtgtgtgtatgtgtgtgtttgttttattttaagttcagggatgcacatgcaggtttgttacatacgtaaacttgtgtcatgggggtttggtgtacaagtgatttcatcacccaggtattaagtctagtacccattagttatttttcctgattctctccccgtttccactcaccatggcctttcttatcctacctttcccattagtatttcaactccatagtgagagttcaggcataacacatattgttagtcaaatcagtgatttatttattcatcaaatagctattatgcttcactatatgtcaagcattgtgattatcactggagatacactggtagctaacacagatagtggaatataaaactgaccaattccatccacatgaccatgggtacgtcatttcaactgggaacatcaatttaccacctaggaaatgtctaagaccctcccaactcaaccccgtcctacatctcccttatattattcattcaatgtatataaattaagcacatgctgtgcatgtaactatatttcaatccaagcaaaacacatggcaaagggatagttcctggtttggggattgatagagaaagtcttacaaatatataaamactgagatagaattatatattcaataaatcatctttattataaagaacacaataataagagatagagactaggtcacgaggctcatcatgttawaatcatcatgtgctaggatttggtttaaatcaaccaacaagacatggtctggagttggtttacaatctgagaagacactctaaaaaatctaccattataggagtgttgtgaggatcaaacataataagttgtggtacaggacgtgtagcgtgtggtacctagagtcagactacctggatttgaatccctgctctgctagtcatcagctttacggccttcggaaaattgcttaacctctatttactttggtttcttcacctattcaactgagaaagtatactggtaactaaatcatagggttgttttgaagacagttcaaacgtgaatccctattatggaaatcagcacatggtgatcactcaataaaaattacatattgtgaactaaaatttgtgtagttgctaatctatcattagcgcgaaataaaaatttgtttccaaactcccacattgcctttattaaactataaatttcttgagaaaaagaaactaaaataaaatcaacagggcatggtctagatttttgaagagcaaattacatagataactaattataacacacggtgctgtaatsacagagatagaagatgtcccttatcagaacactgactgattcagcagtttccatttccttttctcactctccacaactcacagaagccagctctcagaaatggaatcacgagtatggagggggttcccctaagaagtgagtgagggaatgcaattctgggtatcactgagagctgggaggcagagggtggggtgagaaggaggcattgcctgtgatgtaggtttctaatgatacaagtggcagagatacctttatttggaattggtagcaataggggaagatacatggatgccaaagctccggtgaaacctaccacggcccctgatcttgcttctgcttctcctccctcaagactggcactagccatcattggggtgggaaggaaacagagcccatgtgtattaaaagacctaagtctacagacacttagaaaggacagaattccaaaggcatggtcgcacttggcttctgtcctctgttattctccagcatcaaatgtatcaactctaacccctttggggggaatacaaggcctgtcctggtttggtcccaatttagctttatcatccatattcacccccactgctctgcagctccactgaagcaccccctctttcctctgaacccacaatgtcacactcaggactctgcctcagctgggcactcatctatagatgcctaaatcccgggcagttatccagacacaactaaagttccatcccttccatgaagccttccccaaccctctggtggaaggtcacttcttcccctcgtgggattctgagctttcatttctttttctactaggagtcctagcactttcggctaaatgctacaattacctgttcatacactctacctgcccccacgagatcaggggcatctcagaaacaaagatcattaaaaccaactaaatctatttctcattataaaatgaggtatgctgattgattgtgaaagaataaaataacaaagtatggaaaagaaaaaaaagcatataatctggctgagaaggtagagacccttccacaccactgaaattatgtattgaaaagaataagtaaaaaactgcttcaatttggcatgatttatgtaagtatagtataggatccttaaaatggttcaaagaaatgggaaatcaagacttcattttggccaaaaccattgaacagaaacttcagcatatttatcaataatttctttcagattaaacaactgacaacaacctatttttcaaccagtgatgttggaaatgtttttttaaaaattagtttataaatttgtgggctgaccaagaaggtaataaagtctaactaagtaaaatgagaaaaattcagaaaaagaaaaaaataagaaaataaatcacccagggacctatcacacaaatataagaactattcattctttaaggcatgtatttccaagcctttgtatttttttccatgcttagggttggcaaggaatatatatatatttgtacaaatatatatgtgtatatgtacaaatacatgtatatatagtacaaatatatatatatatttgtacaattcttcagactttgtagaatttgtataatgtcgtatcttgctttttttaaccactgatgttataagcatatttatgccacttcattcattttagagacttaataataaatgatctagtggataatttatcattccctgatggagaaaaatttagctttgtttattttagagttataaacgatgctgggtcaggtatctttatgtttgaagatggctccatatttgggttgtttccacagaactctttcctagaaatgctttttstaggttaatggctacagatatttctaggcacctgacatattgacacccacctctaaagtatttttatgatccacaactagcgtttaacacagcgccctagtcactacatgactaataaatagacaaatgactgaaacatgacctcatgctttctattcctccagctttcattcagttctttgcctctgggaggaggaagggttgtgcagccctccacagcatcagcccatcaaccctatccctgtggttatagcagctgaggaagcagaattgcagctctgtgggaaggaatggggctggagagttcatgcacagaccagttcttatgagaagggactgactaagaatagccttgggttgacatatacccctcttcacactcacaggagaaaccatttccctatgaaactataacaagtcatgagttgagagctgagagttagagaatagctcaaagatgctattcttggatatcctgagcccctgtggtcaccagggaccctgagttgtgcaacttagcatgacagcatcactacgcttaaaaatttccctcctcacccccagattccatttccccatccgccagggctgcctataaagaggagagctggtttcagacttcagaaggacacgggcagcagacagtggtcagtcctttcttggctctgctgacactcgagcccacattccgtcacctgctcagaatcatgcaggtctccactgctgcccttgcygtcctcctctgcaccatggctctctgcaaccagttctctgcatcacgtgagtctgagtttcgttgtgggtatcaccactctctggccatggttagaccacatcaatcttttcttgtggcctaaaagcccccaagagaaaagagaacttcttaaagggctgccaaacatcttggtctttctctttaagacttttatttttatctctagaaggggtcttagccccctagtctccaggtatgagaatctaggcaggggcaggggagttacagtcccttttacagatagaaaaacagggttcgaaacgaatcagttagcaagaggcagaatccagggctgcttacttcccagtggggtatgttsttcactctccagctcactctaggtctcccaggagctctgtcccttggatgtcttatgagagatgtccaaggyttctcttgggttggggtatgacttcttgaaccagacaaaattccctgaagagaactgagataagagaacagtccgttcaggtatctggatcacacagagaaacagagaacccactatgaagagtcaaggagaaagaaggatacagacagaaacaaagagacatttctcagcaaaaatgcccaaatgccttccagtcacttggtctgagcaagcctgccttcctcaactgctcggggatcagaagctgcctggccttttcttctgagctgtgactcgggctyattctcttcctttctccrcagttgctgctgacacgccgaccgcctgctgcttcagctacacctcccgrcagattccacagaatttcatagctgactactttgagacgagcagccagtgctccaagccyggtgtcatgtaagtgccagtcttcctgctcacctctatggaggtagggagggtcagggttggggcagagacaggccagaaggcyatcctggaaaggcccagccttcaggagcctatcggggatacaggacgcagggctccgaggtgtgacctgacttggagctggagtgaggcatgtgttacagagtcaggaagggctgccccagcccagaggaaagggacaggaagaaggaggcagcgggacactctgagggccacccctactgagtcactgagagaagctctctagacrgagataggcagggggcccctgaaagaggagcaagccctgagctgcccaggacagagagcagaatggtggggccatggtgggcccaggattcccckgctggattccccagtgcttaactcttcctcccttctccacagcttcctaaccaagmgaagccggcaggtctgtgctgaccccagtgaggagtgggtccagaaataygtcagygacctrgagctgagtgcctgaggggtccagaagcttcgaggcccagcgacctcggtgggcccagtggggaggagcaggagcctgagccttgggaacatgcgtgtgacctcyacagctacctcttctatggactggttrttgccaaacagccacactgtgggactcttcttaacttaaattttaatttatttatactatttagtttttrtaatttattttygatttcacagtgtgtttgtgattgtttgctctgagagttcccctgtcccctccmcsttccctcacasygygtctggtgacaaccgagtggctgtcatcrgcctgtgtaggcagtcatggcaccaaagccaccagactgacaaatgtgtatcngatgcttttgttcagggctgtgatcggcctggggaaataataaagatgytcttttaaaaggtaaaccagtattgagtttggttttgttttyctggcaaatcaaaatcactggttaagaggaatcataggcaaagattaggaagaggtgaaatggagggaaattgggagagatggggagggctaccacagagttatccactttacaacggagacacagttctggaacattgaaactacgaatatgttataactcaaatcataacatgcatgctctaggagaattcactactcgaatggccaccattaagcagagtattctgtagggcatattcatgatgaatcaagctcttaatagcaattatttacattgttgaggcttactcctcctactgagygctttttatacattgctcatttaatcttaccaatgcaatagtacagcttaggtactattaatacctccacttgacagaaaagtaacccagggctcagaaaggttagacaacttggctgaggttacacagcacgtaaacggtcaattgtgttccaaaactggacttttattgaactacagactatgctgttaaccattgaccaagttatttcccaaagtatgacccgcctatactcaaatcttaccccattctttaacagatgatactttatccattgcaaccacttcctgtcaggattctgagttgacatagagtgtttgagcagtgattgttgaagccamttamataggatctttaagtgtagacctgggaactgatatttttatcaagctcatgaggtgttccatagcatgttaatgactgagagccactgtcaatagaattcaccactgttttctaaatgtggtaagtctctgcatatggcaacaggtgtattatacattatttctctagaatctacactctacaaaataaatagctaatgttagagaaggaaaagacaatcagcttctgtgtggagcaggatgctgtctataggtttactgtgaaaggtaagttatttaatagatggattgtttgcattatctgtacaagaaatccatactaagctagggtcctttttgcagaagaaagagaaattcaaaatatttgtgtgaaaaccaaacgtgttaatttttacgagctatgcttatttcattttgtttcaaataatctattttttgtgtccaaacatgtttagaattgtagtgttccaactctttaaagcataaacactactacttagcaaatattaaaatgcatatactatgtgaactacatcccatttgacctgatcccatttctaggaatctgcttcatagaaacactgccaaaagataagatatgtagacatgaggatattctttgcagtgtggttggcaaacagcaaagaaatgcaaacagtcatcagtaggggattaatcagtagaggattaagatgtccatcagtggaatattctgaagtcagtaaaaaaaaagtagcacacatctataactgtggaaagtgtccataatattatatgtaaaaggcagacctaattacattcagtatatgcatatatattctctacatatgctatggaactatctgtaaagtatattattttgttttatttttaaatgccatatatacatatatatttacataggcaaatatttggaaagatacacatcaaatagctaactgatttctttgaggaaatgaggctttttttttttttaggaatgagggtttttcctttttatattctgcacttttaaaactttgagttattttctgattagcttgcatagcttacctctctggtctcatcttaccctattctttgatgggtgatattccatccatcacaaccactttctggtagggattctgagttgatgcagagaggatagagctcaacctggcttatactgttttgatgccatgatggctttcatataatgagggtacagcaacaaacacgtctttttgacaaggctgtttctctctctctctctctctctcacacacacacacgcacacacacacacacacacacacacacacacacaagcagcttttgtccccatagacgcagtgaaggtgtcatcattccttctttattggctttcaggaaaaaatataggggcatacaatatttgcctgcactgaattgtttctcaaggtctagaaacccaaagctaaacgaagtttaatcatgcccaacattccctaaatacaagtgttatgaaaaaacagtaagttgaacaaagacccctgatagggaactggagaatgggtactgcatttttaagcagttcagctgatctggcagtccctagctctcctccctgggagaatgtcctctatggacaatctgagatgtgcaatgtggaggatctgctttctggaggctgctgacttcctgtctgtgtgagttagcctgaggttgccttaggtattgtgcaatcagcaactttttggaaccagtcttatggtttctttggcaatgtgactcccttctaatgtctgtaggctactatttgcttctgatcaattccatgggccaggtagccagaagcagacaggttgtcagttacatagtttgcatttgcattttaactggggttggggatgtgcattttcttttttctttttttttttgagatggagtctcccactatcacccaggctagagtgcagtggcgtgatcgcggctcactgtaacctccgccttccgggttcaagcgattctcctgcctcagcctcccaagtagctgaattacaggtgcccgccaccacacccagctaagtttttatatttttagtagagatagggtttcaccatgttggccaggctggcctctaactcctgacctcatgatccgccagcattggcctcccaaagtgctgagcttacaggcgtgagccactgcgcccagctggggatgtgcactttctagcacagactgcactaccattgtcaccccgacctcccagcccctggtgagagacctctgcctgcatcttggcccatgtggaggtgatgaatatttgacgcttggcctcattatgtctctcatcttcctgtctctgctcatgctaactttatcttagagtagaaaatcctgcatttacagccctttcagtcttcagattactggattctcagtcaacaggctggaagggcctttttagcaagtcgcatttcttctttttcaatttcagatgagcccatttcaaagtagcctaaactctttcttaaaggaccttactgatataatacacagcaactaaattccaatattcagaatcttttctaacaaattccttaatgctgcagccttggtatttggcacaggcttttagcaccaaaataagacagaccatagttcaaccagcacgtgcaataccttgtaatgggtatggcaaaaggtagtgcccagacaggacagcatggtgaatatcacctgggaacttgggagaaakgcatattctgagccccacttcctttcttaatagactagggcccagcaacctgtgttttcacaaggctccaggtaattctgatgcatgtaaggtttaaaactcacttccatttcacaaggtcctcaccaaattacctcctactttctcatttcagccagttccacacttcagtcagggcctgtgacttttaacaaaccctgtgtctctgcacagatgcagatctcgtatctctcaggatgctggcagtttccaggcagaaagcaaacaagcaaaccaaactcaaagaggctttgagtaaatgcaccttgtggctccaagactatagggcatcgaggtggccctagctccaggcaaggctggactcagcggccctgtggtatctcatgagtcctctttgcttctctttctgatctccctttcctgtgagaggccctgggtggctgccagtacctgccagtgtacatgaatccttgttcattttctgcagggaagagtgagtctgtgttcccattggaaaaaacatcactaggcccttttggatttgactgacttaggaaccgaattcctaaccagtcgctgtggttatggggatgggtttcattgatttgcttaagttaatcaaggcacataacttgaatctttgggtttactgaattttacataaacttaaagcctgagaatggtggggaagggggtttgccctgaagaaatgtgagtttctggcatcagggaacatgcagaatagatgctggtcaggaaaaacaagttttcactataatgtgtttgtctttttcctgttatttttgtcttgatgatataaaaggcactaatactttgtgtgtggtaaacatttcttctcctatgctctctagattagaaactattagtcgtccactttcctgaatgactttatttttaatgagatgctgacttgtgttatttcctgttgcccaatgaatgactattgcccaaatctagggcaaaagagacataaactcttcatgatgtcaaggtaaccactagaaaatggggctacatacccaggccagaacatactgagaaaggtagaactggccctgccataagcactacccaccttccttcatagaagccaaagatcgggcactgaggatgcaggaggagatgagacaattcttagaacaatgagtcctcaatagaaattgtccatattaaggaacagaagggagtcctttcatagtggatggacaaaggggtagacaaggagactgcaagcgaaggagacacttcatacttgccgtttttattcctcttctttcctgggaactgcacccacaaaaatacattatgtgggattgaccacatcccaaatgctaggtggctcctgattaaaataagctgatttgcatcttgagttttttaagcttaccataacataagcatttctcatgtcactgcattgtttgtaaaggctgcctaatagccaattaagggaagagcccataattttcttagccatttccatatcataggcaatttaaattgggtccaattttaagttgctataaatatgctggggaccaaatacacttatgcattgttcattttttccatatttgaatttatttctatggagaatagattcctagacatggaccctcttggccaaaggctaagaacatttatttcaaggttccttatgcatattagcacccatattaaacacatctttaggtccttggcttagcgcatatctctcttgaatgaacagatgtctgaaagcctggctgtactctcatcgctcagtagctcaggctttgctaatacagctctgtccatctgtgtgtgattgaagttgggctgtgctgctcaggactcctggcatcrttgcataagtcaagtctacrccgttagaacagctgtgggataacagagaagtttctgctctgccagggaaaatatgactacagagctttagtgagaaggaagtagctaagtgtggtctggggtaacaccaatatctcacctcctgttgctgtggaaaccacttccccayaaacagccccaagacaagtgagcacttgaactgttcctgcaaataccctgagccctgtggttacccaagacccccktgcatgtgcaagtcaacaagacaccacggtgcttaaaaaacatcctgtctcatgagccccggtttccatcttcccatgactcagggcttacctctttagagaaggggacacagctcagaccccacagctggtgactgagtgcccaagtcctatcctcttctgctcacactcttgggccctcacgtcctcctctctcacgatgcccccctgttcctgggcctcctctcacgagtcagtctttgtcctgccttttgctgttgttccctgcactctctggctggggtcaaaccacatcgccaaagtccaaggacagaggtacccaagtgaaacagagaacttcctaagggattttcaaaatgccctgggctatctgttcaggaagattttcttccccaaagtgttttcactttctattctataaaccttaaaggcagggtacggtcttgtcctacttagtgaaggagaacattgagtaggtttcaataagggg

SEQ ID NO: 17593 - DNA, 58905 bp, Homo sapiens
tgtctcaacaataacaacaacaaaagccatctcggaacatggtatttgggatctctgtctgctctctttggatcacctcaagaagtgggttcagagcccacatctgtgacattcctgagtgtgtctcaggtctacaagctgctccttgtatgtcatcttctggtcctgccattgactcagctgcaaacaaccacaaatcttccacttgggacacctgcctctcccacccaaaagactttacttggaaacaggtgactgcagaggacaaaaattaatgagcattatctcctgacttaaatcagagtgtagtttgttaaaacacacttagactgatcctaatataattttcaattttttaaaaaaggcatcccccctccagacctaataccactttccccatgtggcaggaggggaaggcagaacttcgtgtaagttaatgagtccgtatagaacattcctgggaacttgggcactctgccttgtcaccttttgcatttgacaatcaagttcctgtccttgttattttatttattattatttttttttttgagacagagttttgttcttgttgcccaggctagagtgcaatggcacgatcttggctcactgcaccctccacctcctgggttcaagcgattctcctgcctcagcctctcaagtagctgggattacaagcgcccactaccaggctccgctaatttttgtatttttagtagagacggggtttcaccatattggccaggctggtctccaactcctgacctcaggtgatccgcccgcctcggcctcccaaattgctgggatcacagatgtaagccactgcgcccttccctgtccttgtcattttaaaataattataccagcaggaggacgtccagacacagcatgggctacctggccatgcccagctggttggacatttgagttctttgcttggcactgtcctctcatgcgttgggtccactcagtagatgcttattgaattcctgggcctggggctgtggcagctgcctcgtcccttcacctcctggcttattctctccctccatatcttagcaatttcttcatgggaatgtccccaattagaaatttctattataccattatattaccaacatatatatatatacctggccgggcgcggtggctcatgcctgtaatcccagcattttggtaggccaaggcgggtggatcacctgaggtcaggagttcgaggccagcctgatgaccatggtgaaaccccatctctactaaaaatacaaaattaatcgggcatggtggcacatgcctgtaatcccagctactcgggaggctgaggcaggagaatcgcttaaacccaggaagtggaggtttcagtgagctgagattgtgccattgcactccagcctgggtaacaagagcaaaactccatcaaaaaaaataatatatgtatatatatattacaattttatatatatatacacattatgtaattttttttaccattttatatatatacattacgtaatggtaaaatgttttctctgcccccccagtagattgttagctccagaagagaaaggatcatgtctttggtttatctagatatgtccatcggcctggtacagtctctggcccatgttataggcaacaactacttgtagaatcggtgaatgcatgaatagaagaatgagtgaatgaatgaatagacgaaaggcagaaatccagcctcaggccgggcgtgggtggctcacacctgtaatcccagcactttgggaggccgaggcgggtggatcacaagatcaagagatggagaccaacctggctaacacagtgaaaccccgtctctactaaaaatacaaaacattagccgggcatggcggtaggctcctgtagtccgagctactagggagcctgaggcaggagaatggcatgaacccaggggggcggassttgcagtgagccaagatcgcgccactgcactccagcctgggcgacagagcaagactcggtctcaaaaaaaaaaaaaaaagaaatccagcctcaaagagcttacagtctggtaagaggaataaaatgtctgcaaatagccacaggacaggtcaaaggaaggagaggctatttccagctgagggcaccccatcaggaaagcaccccagacttcctacaactactagacacatctcgatgcttttcacttctctatcaatggatcgtctccctggagaataatccccaatgtgaaattacttagcacgtcaagttaggtagatccttgtgtacttcttggttgttcagagatcatcaaccagtgcaaacaatccccccatcaatacacagcagtgtctgcccctctcctccccaagccttccgaggcccttcctccgtgcctgaaccccctggacatatcatgtggcaaactgaagggtccaacgagatacaggaagtgaaacacgatgtacactgaaacgtgcaatacaaatatgcagcatgaagtgcctcggttcactaacccgagctatgctgggtgcttcttttctaccactttccttaatgcctatggacacctcattctgtggctgaagttccttgtgttcaattccccccatcttcattgaacatcctctgtgcagggacttgacccctgtcctgctagctttgcactgaggcaagttttgtccatgcctagtagtgccaccatctttactagatgaggtttctaaagagcttggcatggaaggaaagcctggggggccttagaagccatcacttaggaactgggagagctccaggcaagccaccttatctctttgggcctcagtatcctcactcacatccccatggtcagtagagtgccaagcacatrgtggacacgcagaagtattgatcatcttcctcacctcccctaggagagcccttgggaatccccatataatattctctgaagacctcaatccaatgagccaagtaattgactcggtagcaaactcatggaaaggacattagaagccaaaaggaggtagagtatgtcccagtacaataaccagcctctgatctcaaggaagaaagaacagagctgcaggtgagaagtgtgcgcctcaaatcaccaaagtgagagtggaaggagcacccaccagtcccttggaggcgatccctaagaccggtgagaatggcttcgaaaaatgtgatcgtcctcaaccccacagtcttgaacctaacaggagatcttgaagcctgaaagacaccactttaggatcaacagcagatctgtgactttccacagcaggcacacagaaccctagagttagtcgaggttggacataggaagggcttccaaacacacagagaaattcatggatcctaaattataaagggaggttctttaaaagaaccaagatgattctgagatttatcctgagcttttttttttttttttttttggatgcagagtctcgctctgtcgcccaggctggagtgcagtggcgtgatctcggctaactgcaacctccacctcgcgggttcaagcaattccctgcctcggcctcctgaatagctgggattacaggcgcctgccaccacacctggctaatttttgtatttttagcagagacgggatttcaccatcttggccaggctggtcttgaactcctgatctcatgatccacccaccttggcctccctaagtggtgggattacaggcgtgtgcccaacttttcctgagccttttgaggctgacaccagaggtgagaagcccagcctctccccactggccatgtggggagaggctccagcctgcagcaaccagggatctggcctcaagtgatgccccaacagtgggcgacttcccagtactgttaggagaatcccaagtctaattcaaagttgattttttactagcaatgaatgatagacatggtctccattgctcaaggctctgggaagatctagactagagaaaacgatcaccgacttctacccacacctgtgggcctcagttcttccctctggtccatggttaccacagtaaccccttgtaaaggtgtttccccaggggtccctagagtcctctgagtcaccataattctgggtcaacagaaatggagaggtaagaggagacactcccctgccctggctggtcccacgtgttcatggcagtaacctgtctggggagcctcgccacccctgtgtccacctgcagagttatgcagtggtccccaactagggcccctgccaccctcattcctaagggaggctggagacttcttccatggccgaaaatccacatctaagtccccggcactagcaaaaaggccctgtcatgggggctccctgccccagttgagattggaggaacatggaagaagctaaaataactaattaactcagtagcatcacactacctgctctggagaaaaaaaaatttaatattattattttttgttttttgagatggagttctgctctgctgcacaggctggagtgcagtggcgcaatcttggctcacggcaacctctgcctcctgggttcaagtgattctcccgcctcagcctcccgagtagttgggattacaggctcatgccaccacgcccagctaatttttgtacttttagtagagatggagttttgccatgttggctagtctggccttgaactcctgacctcaagtgatccacccacctcaaagccacccaaagtttggggattacaagcgtgagccactgtgtccggcctggagaaaggactttaaatgacgcaatgtaggaagagcaaggttgtggagatctgctgccctggctgaggtagctcatgcaatcagtctctctgagccacagtctcttgatctgtgaaatcggaagaaaataatacctccttcacaagacaagtggcaggtcagatgtgagaatgcacaggcaggccctcggcaactggaaaagctctatacagatctgaaaaggaggaggagaaaaaagaggaggggcttccatggctggacagggcatctttctttttctttttctttttttttttttttttttttttgaggtggagtcttgctctgttgccaaggttggagtgcagcagcacgatctccgctcactgcaagctctgcctcccggattcacgccattctcctgcctcagcctcccgagtagctgggaatacaggcgcccgccactacgcccagctaacttttttgcatttttagtacagagtggatttcacctggttagccaagatggtcttgatctactgacctcgtgatccgcccgcctcggcctcccaaagtgctgggattacaggcatgagccaccgcgcccagcctgatagagcatctttcggcgtgatgtgttctgagttccaaagctgaggaagagactcaaatcttcaagagctcttctaactttgagattctctgatggtttcagggctatgggaggaagagcttgtggtccgtgtctgctcccgggatttctgtttcttggtttgtgtctctgctgcaagtccaaggagctggggcaataccttgagtctgggttcttcgtccccagggacctgggggagccccagcaatgctcagggaaaggggagagcaaagtgtggggttggttctctctagtggtcagtgttggaactgcatccagctgactcaggctgacccaggagtcctcagcagaagtggaattcaggactgaatcgtgctcacaacccccacaatctattggctgtgcttggccccttttcccaacacacacattctgtctggtgggtggaggttaaacatgcggggaggaggaaagggataggatagagaatgggatgtggtcggtagggggtctcaaggactggctatcctgacatccttcgccgcgtgcaggttggccaccatggcctgctgccagagggcacccacgtgacccttaaagagaggacaagttgggtggtatctctggctgacactctgtgcacaaccctcacaacactggtgacggtgggaagggaaagatgacaagccagggggcatgatsccagcatgtgtgggaggagcttctaaattatccaytagcacaagcccgtcagtggccccatgcataaatgtrcacagaaacaggtggggkcaacagtgggagagaaggggccagggtataaaaagggcccacaagagaccrgctchagsatcccaaggcccractccccgmaccactcagggtcctgtggacagctcacctagckgcaatggctrcaggtaagcgcccctaaaatccctttgggcacaatgtgtcctgaggggagaggcagcgacctgtagatgggacgggggcactaaccctcaggtttggggcttctgaatgtgagtatcgccatstaagcccagtatttgkccaatctcagaaagctcctggtccctggagggatggagagagaaaaacaaacagctcctggagcagggagagygctggcctcttgctctccggctccctctgttgccctctggtttctccccaggctcccggacgtccctgctcctggcttttggcctgctctgcctgccctggcttcaagagggcagtgccttccmaaccattcccttatccaggctttttgacaacgctatgctccgcgcccatcgtctgcaccagctggcmtwtgacacctaccaggagtttgtaagctcttggggaatgggtgcgcatcaggggtggcaggaaggggtgactttcccccgctgggaaataagaggaggagactaaggagctcagggtttttccygaagcgaaaatgcaggcagatgagcacacgctgagtgaggttcccagaaaagtaacaatgggagctggtctccagcgtagaccttggtgggcggtccttctcctaggaagaagcctatatcccaaaggaacagaagtattcattcctgcagaacccccagacctccctctgtttctcagagtctattccgacaccctccaacagggaggaaacacaacagaaatccgtgagtggatgccttctccccaggcggggatgggggagacctgtagtcagagcccccgggcagcacagccaatgcccgtccttcccctgcagaacctagagctgctcygcatctscctgctgctcatccagtcgtggctggagcycgtgcagttcctcaggagtgtcttcgccaacagcctggtgtacggcgcctctgacagcaacdtctatgrcctcctaaaggacctagaggaaggcatccaaacrctgatgggggtgagggtggcgccagggktccccaatcctggagccccactgactttgagagctgtrttagagaaacactgctgccctctttttagcagwcaggccctgacccaagagaactcaccttattcttcatttcccctcrtgaatcctccaggccwttctctacaccctgaaggggagggaggaaaatgaatgaatgagaaagggagggaacagtacccaagcgcttggcctctccttctcttccttcactttgcagaggctggaagatggcagcccccggactgggcagatcttcaagcagacctacagcaagttygacacaaamtcrcacaacgatgacgcactrctcaagaactacgggctgctctactgcttcaggaaggacatggacaaggtcgagacattcctgcgcatcgtgcagtgccgctctgtggagggcagctgtggcttctagctgcccgggtggcatccctgtgacccctccccagtgcctctcctggccctggaagttgccactccagtgcccaccagccttgtcctaataaaattaagttgcatcattttgtctgactaggtgtccttctataatattatggggtggaggggggtggtatggagcaaggggcaagttgggaagacaacctgtagggcctgcggggtctattgggaaccaagctggagtgcagtggcacaatcttggctcactgcaatctccgcctcctgggttcaagcgattctcctgcctcagcctcccgagttgttgggattccaggcatgcatgaccaggctcagctaatttttgtttttttggtagagacggggtttcaccatattggccaggctggtctccaactcctaatctcaggtgatctacccaccttggcctcccaaattgctgggattacaggcgtgaaccactgctcccttccctgtccttctgattttaaaataactataccagcaggaggacgtccagacacagcataggctacctggccatgcccaaccggtgggacatttgagttgyttgcttggcactgtcctctcatgcgttgggtccactcagtagatgcctgttgaattcctgggcctagggctgtgccagctgcctcgtcccgtcaccttctggcttcttctctccctccatatcttagctgttttcctcatgagaatgttccaaattcgaaatttctatttaaccattatatatttacttgtttgctattatctctgcccccagtagattgttagctccagaagagaaaggatcatgtcttttgcttatctagatatgcccatctgcctggtacaatctctggcacatgttacaggcaacaactacttgtggaattggtgaatgcatgaatagaagaatgagtgaatgaatgaatagacaaaaggcagaaatccagcctcaaagarcttacagtctggtaagaggaataaaatgtctgcaaatagccacaggacaggtcaaaggaaggaggggctatttccagctgagggcaccccatcaggaaagcaccccagacttcctacaactactagacacatctcgatgcttttcacttctctatcaatggatcgtctccctggagaataatccccaaagtgaaattacttagcacgtccagttaggtagatccttgtgtacttcttggttgttcagagatcatcaaccagtgcaaacaatccccccatcaatacacagcagtgcctgcccctctccccccgaggtcttccgaggcccttcctccgtgcctgaaccccctggacatatcatatggcaaactgaagtgtccaacgagatataggaagtgaaacacgatgtacactgaaacgtgcaatacaaatatgcagcatgaagtgcctcggttcactaacccgagctacgctgggtgcttcttttctaccactttccttaatgcctatggacacctcattctgtggctgaagttccttgtgttcaattccccccatcttcaytgaacatcctgtgtagggacctcacccctgtcctgctagctttgcactgaggcaagttctgtccatgcctagtagtgccaccacctttactagatgagacttctaaagagcttggcatggaaggaaagcccgggggccttggaagccatcacttagaaactgggagagctccaggcaagccacctcatctctttgagcctcagtatcctcactcacatccctatggtcagtagagtgccaagcacatggtggacacgcagaagtattgatcatcttcctcacctcccctaggagagcccttgggaatccccatataatattctctgaagacctcaatccaatgagccaagtaattgactcggtagcaaactcatggaaaggacattagaagccaaaaggaggtagagtatgtcccagtacaataaccagcctctgatctcaaggaagaaagaacagagctgcaggtgagaagtgtgcgcctcaaatcaccaaagtgagagtggaaggagcacccaccagtcccttggaggcgatccctaagaccggtgagaatggcttcgaaaaatgtgatcgtcctcaaccccacagtcttgaacctaacaggagatcttgaagcctgaaagacaccactttaggatcaacagcagatctgtgactttccacagcaggcacacagaaccctagagttagtcgaggttggacataggaagggcttccaaacacacagagaaattcatggatcctaaattataaaggcaggttctttaaaagaaccaagatgattgtgagattacgtagagtttttttttgtttttcttgatacagagtctcgctctgttgcccaggcaggagtgcagtggcatgatctcagctcgctacaacctccacctcccgggttcaagcaattccctgccacagccacctgagtagctgggattacaggcacctaccaccatgcgcagctaatttttctatttctagtagagacgggatttcaccatcttgaccaggttggtcttgaactcctgacctcatgatccacccaccctggcctcccaaagtggtgggattacaggcatgagccactgcgcccggcctattctgagccttttgaagctgacgccagaggcgcgaagcccagcctctccccactggccatgtggaggctctysctgagtagtctctcagcctgcaggagccaaggatctggacccaagtgatgccccaacagtgggcaacttcccagtactgttaggagaatcccaagtctaatgcaaagttgattttttaccagcaatgaatgatagacatggtctccattgctcaaggctctgggaagatctagactagagaaaacgatcatcgacttctacccacacctgagggcctcagttcttccctctggtccatggctgccatggtaaccccttataaaggtgtttccccaggggtccctagagtcctctgagtcaccataattctggggtcaacagaagtggagaggtgagaggagacactcccctgccctggctggtcccacgtgttcctggcagtaacctgtctggggagcctcgccacccctgtgcccacctgcggagttatgcagtggtccccaactagggcccctgccaccctcattcctaaaggaggctggagacttcttccatggccgaaaatccacatctaagtccccagcactggctaaaaggccctgtcatgggggctccctgtcccagctgacattggaggaaggatggtgggggaggcagggaccttcttctacttggagctcagggaccctcttccattcgcacctggctcctcctctttgctggtgctggaaggagcaggggaaagtggtgactccaccctcccttggccccatatttttcggagctggtatcatcgatgacacccctcttggatcctcacacaggcctgcctggagaacagctcacagcacagtgccctcccagcaggtgatgagtctggggtgctggtccggtaatgcttcaggagtgacggcagaaaaaggagctctgtcttcccctctgaaagtagggagatggcagggccccagcattcacatcctaggccacaggggtgtgggtgttcaatgttggttgccaacaccacagccaatcacttctagaagcatttgcttgtttgcttgcttgtgtttctacagtgtcaagtgctacatgctcttaaactcagggtgggggaagatttcaccactggagagggtggtctttcctgctcttatccctgggggcatctgatgcttgtgacttccagatggtatggaaatagccccaaccctgggcaccaggagacaggaggctcagtcctggccttctccgcctcagccttgtcctgctgtgaggtttccacaaggcaccccatgccactgggccattctcacctgggaattgagaaagaacaatctgccccttatggaaagacaaaatgaggcaaagggcccctgtgttgggggcaggatccctgcactcagagggatttagaagctgaaataactgggttgggggcggtgactcacgccagtaatctaagtacttagagaggccagggagggtggatcccctaaagtcaagagttcgagaccagcctggccaacatagtgaaaccccgtctctactaaaaaagtacaaaatttagcctggcgtggtggcgggcgactgtaatcccagctactaaacagggtgaggcaggagaatcacttgaacccaggaggtggaggttgctgtgaggcaacatcatgccactgcmctccagcctgggtgacagaatgagactccaactgaaaaaaaagaaagaaagagagagagagagacaaagaggaaggaaagaaagaaagaaagaaagagaaagaaagaaagaaaaggaaaggaggaaggaaagaaaaagaaaaagaaagaaagagaaagaaagaaagaaagaaagaaagaaagaaagaaagaaagaaagaaagaaagaaagaaagaaagaaagaaactaaaataactaaataactgagtaacaccacactacctgttctggagaaaggacttttttcttgttgttgtggttgttgaaatggagtcacactctgtcgcccaggctggagtgsagtggcgcgatcttggctcacagcaacctctgcctcctggattcaagtgattctaccacctcaccctccggagtaactgggattacaggcttgcgccaccacacacagctacttttgtatttctagagagttggtgttttgccatgttggctagtctggccttgaactcctgacctcaagtgatccacccacctcagcctcccaaagtgctgggattacaggcatgagccaccgtgcccggcctggagaaaggactttaaatgacacaaagtgggaagagcaaggctgtggagatctgctgccctggctgaggtagctcatgcaatcagtctctctgagcctcagtctcctgatatgtgaaatgggatgatamtcatacctcctacacaagacaagtggcaggtcagacgtgagaatgcacaggcaggcccttcgcaactggataggctctatacaggtgtggaaaggaggaggagaaaaaagaggacgggcttccatggatggatagggcatctttcggcgtgatgtgttttgagttccaaagctggggaagagattcaaatcttcaagagctcttccaactttgagattctctgatggtttcagggctatgggaggaagcgcttgtggtccgtgtctgttcccgggatttcggtttcttggtttgtgtctctgctgcaggtccagggagctggggcaataccttgagagtctgagttcttcgtccccagkgacctgggggagccccccacccaaccccccctccgccccgccccaaggctcagggaaaggggagatcaaagtgtggggttggttccctctagtggtcagtgttagcactgcatccagctgactcaggtgggcccaggagtcgtcagcagaagtggaattcaggactgaatcatgctcacaacccccacaatctattggctgtgcttggccccttttcccaacacacacattctgtctggtgggtggaggttaaacatgcggggaggaggaaaggaataggatagagagtgggatgtggtcgataggggtctcaaggactggctatcctgacatccttctcckcattcaggttggccaccatggcctgctgccagagggcacccacctgaaccttaaagagaggacaagttgggtggtgtctgtggttgacactctgtgcacaaccctcacaacgctggtgacggtgggaagggaaagatgacaagccaggggacatgatgccagcatgtgtgggaggagcttccaaattatccattagcacaagcccgtcagtggccccatgcataaatgtgcacagaaacaggtgggggcaacagcgagagagaaggggccagggtataaaaagggcccacaagagaccagctccagcatcccaaggcccgactccccgcaccactcagggtcctgtggacagctcacctagcggcaatggctgcaggtaagcgcccctaaaatccctttgggcacaacgtgtcctgaggggagaggcggcgccctgcagatgggacgggggcactaacctcaggtttggggcttctgaatgtgaatatcgccatctaaggccagatatttggccaatctctgaatgttcctggtccctggagggatggagagagagaaaaagaaaacagctcctggaacagggagagtgctggcctcttgctctgcggctcccttcttgccctccggtttctccccaggctcccggacgtccctgctcctggcttttgccctgctctgcctgccctggcttcaagaggctggtgccgtccaaaccgttcccttatccaggctttttaaagaggctatgctccaagcccatcgcgcacaccagctggccattgacacctaccaggagtttataagctcttggggaatgggtgcgggtcaggggtggcaagaaggggtgactttcycccactggggaagtaatgggaggasactaaggagctcagggttgttttctgaagygaaaatgcaggcagatgagcataggctgagccaggttcccagaagagtaacagtgggagctggtctccagcatagaaagcagtggtccttcttggtggggggtccttcccctaggaagaagcctatatcacaaaggaacagaagtattcattcctgcatgactcccagacctccttctgcttctcagactctattccgacatcctccaacatggaggaaacgcagcagaaatccgtgagtggatgctgtctcccctaggcggggatgggggagacctgtggtcagagcccccgggcagcacagccactgccggtccttcccctgcagaacttagagctgctccacatctccctgctgctcatcgagtcgcggctggagcccgtgcggttcctcaggagtaccttcaccaacaacctggtgtatgacacctcggacagygatgamtatcacctcctaaaggacctagaggaaggcatccaaatgctgatgggggtgagggtggcaccaggggtccccaatcctggaagcccactggcttcgagggctgggggagagaaacactgctgccctcttttcagcagtcaggcgctgacccaagagaactcaccwtattcttcatttcccctcgtgaatcctccaggcctttctctacaccctgraggggaaggaggaaaatggataaatgagagagggagggaacagtgcccaagcgcttggtctctccttctcttgcttcactttgcagaggctggaagacggcagccacctgactgggcagaccctcaagcagacctacagcaagtttgacacaaactcgcacaaccatgacgcactgctcaagaactacgggctgctccactgcttcaggaaggacatggacaaggtcgagacattcctgcgcatggtgcagtgccgctctgtggagggcagctgtggcttctaggggcccgcgtggcatcctgtgaccyctccccagtgcctctcctggccctgaaggtgccactccagtgcccaccagccttgtcytaataaaattaagttgtattgtttcatctgactaggtgtccttctataatattatggggtggaaggtggtggtatggagcaaggggtaggtggraagacgacctggagggccttcagggtctattgggaactaggccactgaaatataagaggtttggctgttcctgggccagaaaaaggctgacatatcactgctgtctattactcactaaggccattccaccagctcagtggtcccagcttgctggtcayagctcattggtcatcccagagatgacttgaaggcatttcttcctcccccaccatcaccagcaacaccaaacctagccccccaggagcgggaagaaatgaaaacaagatgggctattaagtgcagaggcaaaaactccccaacaggtgaggaaacaatggcatagaattacttgtgttcggaagaattttaagatgartattccttaagcccaactactctcgggaaatgagaacaatgcaaaaatgagtttgagacatatggwwccagagcatttggaatctgaattagggcaagggaagtggaagagagattttatttgcgggttgtaaatgcagtgccaacaggtgccaggtagataacaacgtaagcaatgagggctggatggcaggggataaatcccagatgacactcgcttcccttcaggggatgcaacacagaagggtgggaaccagcacaatctgcagaactcaagcccctgctgaggtgggacccagcccgcctgtcaccatcaggactgcagggacacggcttccagaccttctgattctttgagacagccaggacatccagactgttacgggaaatctaatatttaaataatggcaacacatactgaaaatcttttaagggcaaaaattaacccaaacacacatggtctccaagctgtctgtgagcaattttgttctaagagatgttgattggggtaayttggtgtaagggaaagaatcagaaagatttgggctgtatgcaatttagtgtcgctgaataaattacttgaccaagctgagataataatatattgctttacaaggattatgtgaggattaaatgcaatggtatttttgacatattatagtactgaagaaattgtagttatttctgcattgaatttttggatgttttataataataataaacatctgagatgtttattatttccaaataagcactaaagagcggtggttagttaagagtttactctcccaagcaccttggctaagtgactggtgacctaaatctatactaagatgctcacaggaactctagtatccaaaaatgatttcatgaagtcaggaattattttacaatgcaaataatcaaccccctaattaatcttctttagaagttctgattcttatgtgccataatgaatttttttgataacgagacccacttgtgttcatttttggctattttgcagttaataactcagtccttgggaagtggttcaaagctgaactaatcagaactctagagctgctgcatttctcagctcagaagacattcctgcatcttacgttgttcttctactattggaatttaaaattacggcattttggagttagaagggcctcataagtcagtctagtttcttctactttgggaatcttatcctacagcgtccattacagtcagtattccaattacaagtgtgtagcactagaaccaagggaatccctttcacaaggctcttcattctaataaaccactctcattgcagaaaactatttcttgcacaaagctggaatcaatattcctgcaatgtccttcatttggccttaaaattatttagaaatctcagtctttagaagtcgatggaatgagcacaattataattatctctcggcttgcgtgttttaaaaggaaatgtgagccatcttaataagtatttgttgaatgcacgtgacagtggaatgacaatgtccagcgcctacttgggtggctaagagggttctaaagtggggtggtcataacatataactgaactgcagggggagccacacgccagagactgtccacccagctcccctcgggtataggagaatccactcaaccactgctggttgagaattagaaagatactacctgactttgcacattttagaatataaaaagaccttaaagaccatctgctttaaactctttgatttacctactgttagtctacctttcagctcatcaacttggtgtggacggcaatttccgctgcaaatttgagatgcctagggtgttttctaaacgatgcattcgtgagccctcactccctgagattctgatataattagcctggaatgtggtccaggcaagagtagtttgaaaactttcccaggtgattctatcatgtaaacaaggttgagaaccactgtgttagggaccgcaaagatgagacccatgtgttcacagctgttgtattggtggaacagggaaaacggagaaaaaggagacgagaggcctgggccagttgtggtgccacctgctcctaattccaaccagtcatctaaaaagtgtttatcgtgagccagtcacagaaagacaaatactctctgattccagttagatgaggtactcagagcagtcaaattcgtagagacaaaaagtaggatggtggctgccagtggctgtggggagggatggaatagggagccatttaacgascacagggtttcagctgtgcaagatgaaaagggttctggagatggttggtggtgagggttgcatgacgatgtcaatgtacttgacgtgaccgaactgtacacgtaaaatggttaagatggaaatgtttatatcttctcacaactaaaaattgttaatagtttcttttgtttttgtttttgtttttgagacagaggctggagtgcagtggtggatcttggctcactgcaacctccgcctcctccygggttcaagtgattctcatgcctcagcctcctgagtagctgggattataagtgtgcaccaccacacagggcagatttttgtatttttggtaaagacagggtttcgccatgttggccaggctggtctcaaactcctggcctcaggtgatccaccctccttggcctcccaaagtgataggattacaggcgggagccaccaggcctggcccttaatggtattttctaatgaaaactcttcctgaagataagattatcgagactcgcacagggaagagttcagcaggcagagctccagtcatccttgacccctggcataatgttttactgactctgtcatttttttgaatttaccctaacctaaaatgaccacttctgaatatcttccatgagcattgttgaaatacacatggttggttttgtccctttatacacagttgagagcagaactgaccccktcctttttcttctgaattgtagggtctgggcttctcagccaagacaagctgacactttgcctggatgcttctttaattcagaaggccctggagtgctgaggcacacaatgagtacctctgggattagggtcaccaactcgtcctggtttgcaggagactttctcaatgtcaacactgaaagtcccacgttccttccaggaatccctcagctcaatgcaaactcagctcacaggactggtcaccctattagtagtcctaaatcttagggcaccaaactggggggaaagtaggggaaggagcaagaaaaagactagaaaaaccggaaagctgtgcacagtgtatatgacctttgatggccctcatggttatcatggatttctgattcttgctttgagtttactgtgattataatgatgtgcttaattaccactagaattatcagtgtaataataaaaaccaacaaatgtgaacacatgtctccagcaccatgctagtttattacaagtattatgtcatttctttctaactataattctctaaggtaaatactattattaatcctatggtaagaagtcccactaacgatgtaacttatgctttctcaggtctagagagaaagacaccagaatgtcaccctgaccatccttgagagcataaatggccaggcactgtggctcacgccagtaatctcagcactttggagggctgaggcgggaggaggtcacaagttcgagataagcctggccaacatggtggcaccccgtctcttactaaaaaatacaaaaattagccaggtgtggtggtgcacacctgtattcccagctacgaaggcatgagaatcgcttgagcccgggaggcagtgttgggctgggcccatcawgccactgcactccagctgggtggctgaggaagattctctctcaaaaataataagaaagaagataaaattttggagtattaaaggccactcttcctctggagataatcaaggtagctgcaatttaagtatgagctggttgctttaatgttcagaaagaatatgatcaaaaccatttagagggtggggcctcctcctatagacaatgaaggcaactacccttagaagctctattatactggaaaagagatatgagatccttcttgctttaagaatcaatgaagccgggcgtggtgactcactcctgtaatcccagcactttgggaggccgaggtgggcagatcacctgaggtcaggagtttgagaccagcctggccaacatgacgaaatcctgtttctactaataacacaaaaattagccaggtgtggtggtgcacacctgtaatcccagctactccagaggctgaggtaggaaaattgcttgaagccaggaggcagaagttgcagtgagccgaggtcgtgccactgcattccagcctgggagacagagcgagactccgtctccaaaaaaaaaaaaagaatcaatgagaaaggcctgcctgatctctggttgtgtggatccttcgggaaggaaagtgaacagaggttccaagtctacaagggaaaaagcccagcctactctgaagagctttgcgggacggctcatccaaactactgagctctaagaactggaaagctggaaaccccagcaagaggacacctgcagagctggaccaggccccgaagaagcagatcatcctccctcagagatctacagcaggtgggaacccagatctgcagacccgcttggtttgagggtactgtgtgggaccatctgtcaacactgacaccctgtagcagtgagaagcaaaggcagcagccggctgagcctccaggctcgccctgctggaactagaaagtccaagtggcccccttcttcctccctttttggttttgtttgcttttgtttttgttttgttcaagatggkgtctcgctttgttgcccaggctggagtgcaatggcacgatctcagatcactgcaacttctgcctcccacagtcaagcgattctcctgcctcagcctccccagtagctgggattacaggtgcacaccaccatgcctggctcattttccccttccttkttggattcgctgtgcttcaaggcactgaggccatgaggcagggtttgcagatacaggrtawctacagccctgatgcgactgatcctgacaccaaaatggctgtggatccctgcatggtgtggctgtatactcctgtctcttaaacctgcttcttaacttacttccccaaatgctcaattcagggaaggtggatgatttatattagactcacatgatgaaggagcagtagctccacctagtggaaacattgaggttgaaaaggtcatgttcggggatgatgctattttataaagtcaagatatttcgtgtccctccaggaagccttccttgattcgagttatgctttctcttaacaatctgttttcccagtcataggagttcatgcacaaatgtaatctcctacttgtttgtcttgctttcctaataaatttgtggaagccaggaacaatgttttgttcaccactgtatccccactgccttgtatgtggtgaaaccaaagggttacttttacacttaatctatagcaccagactcaggggaggtctgggaagaatgggaaaacgttttccctctgctgtctgatgccatggttttttctagctggtatctgcaatttggaaagctatggacctctctctatctggaagtctgaactttagcttttctttttgcttgtgtttcctttgttttgcttttgagacagggtctggctatgtcacccaggctggagtgcagtgcatgatctcaactcgctgcaaccctccacctcccgcgcccaagtgatcctcccacctcagactctcaagtagctgggactacaggcacgtgccactatacctggctaagttttgtgttttttgtagaaatggggtttgccatgttgcccaggctattcgcaaactctggggctcaagtgattcgcccgcctcagcctcccaaagtgctgggattacacgctgagccaccgccccggcctgaatttcagttttgaaagcagtttacataggctgccaccctgagctaatgcaccccctgccccgggctggttgtttatgctatcaacacggtattttttccttagaaattgtacttaaagttataaaatgcagccgggagcggtggctcatacctgtaatcccagcactttagaaggccgaagtgggtggatcacgagatcaggacttcaagaccagcctggccaagatggtgaaaccctgtctctactaaaaatacaaaaaattakctgggcatggtgatgggcacctgtaatcccagctacttgggaggctgaggcagagaaatccttgaacccaggaggtagaggtggaagtgagccaaaatcacgccattgcactccagcctgggcaatagagcgagactgcatctgaaaaaaaaaaaaagtgataaaatgcaaccatttgacataacaagagctttcagcaatgacacagaagggaagggaactgcatttggacatcataaaaccacttttatttttaccatagcaacattccagtgaacatttcttgactgacttgggagaaaakatctggttttgtgattcctcacgccttctccgagggtgaatatactctttccgaaggacagggaaggaggctgaaccataaaatcatatgaacattttcacaagaggattcctcttgaagcttcaaggaaattgtttacagtcagaaraaaatatgcacttcttgatgaaaacagagagtaaacattgcaactctaacctagacacctatatgggtaaaaaaaagaaaactggcaaatgcgaactcacagttgatcactctatgaaaaggaattcagagatgtttggagctcttaacctaagaggccaatttcatggaagaactctaccttctacttcagagacagaacactgggctagatasgatgcttgtctggcccgaagtggaatttcttaccatctgtatactcccccaagacccacaacagatggttactgagttgcagcttgccactgatccttaatgatgtcaacaagctcagctctgggagctggcactccasaagcccaggtcaggggagcaagggaaagtggagatgggaacagagctctgattcctrgccccatatttgatacttactcccttcaaagtcctgtccatggactacaaatttagctcccagttagtaatcaaaaacccatgaaatatgagttgtatttctaagatatgcctgactgtagtatgatgtttaagagaaaagggcagtgagaaccatgaagaaacggcaagatcttttctttttttttttggatctaagagtggactgatgaagcacctggcaaggagcaagaggccttcttacaaatcaaacattgagactgagattcctaatgactagggtgagctctaaagagaaaggtggctgggygcggtggctcacacctgtaatcccagcattttggggggccaaggtgggcggatcacttgaggtcaggagtttgagaacagccyagccaacatggtgaaaccccatctctacgaaaaatacaaaaattagacaggcatggtggtatgcacctgtaatctcagctactggggaggctgaggcaggagaatcacctgaacccaggaggctgaagttgcagtgagccgagatcgcatcattgcactccagcctaggcgacaacagtgagactccatctcaaaaaaaaaaagagagagagagagaatggtgagattgtggacatattggacacacaggacatggggcatggggrcctgaaacacygttttacaggacagatgtacacaaataggaatgcagcctgccattgtgtttcttcctttctcctctatcccttctcccatccctgggaaaccacagtagcagaastctcattcaatcaaatagctgtcaattatatgagttgyacttttctcttcctgaacagcaaactggctttcctcctctttgtcctcctctttctgcctgtagagcaatttcytcctgtcyactttgcagggccgatagctcaaatacagtgctatggtgatgacacccactccaagggcaacggtaataatgacaaagagggtagagctkattccttcatccagtcctgcccaagcacagaagatagagttaggaaagtctgagagtacaaagatcacccaccccagcccaccaggcccacttctgagtctcattcttcccaacctagtagaatctttcttattttcatgcttggataagaatcccaaacccctgaggggtttccatcctgggcctggcagcagggcagcaaaggttaccttgaacaatgacagcaatgtctttgctgacagagcccagctggttagtggctgtgcagcagtaggttccagtgtggttctgggttgccttctgtggcacttcaaggtcaaagaccaccccattccaggtacacaccaaggctggagctgggtttccctttgggacgcaggygagcgtgtgttccatcccttccagccaggtctgtttggcagagcaactggattcctctaaccatggcttgyctgcaaaaacagtttcccraagagctgagttcagtgcaccacactccctccctaccttcaycccctgctccctctcctcccctcacccaaatgctgtccccttcacycaacagctttccttcccaagggagcactagcagctccctgctttgagccaactcttctttcccactttccgtatgggcagggagtcccagatgaaacctagggtgttcttatggatttggactaaawtataatgctgctctgtccatggtggccctggggcccctgcttcccatgtttgtttctcggtgggtaaggagctaggtaacagtgaactcagagatgaggatttttctacttttctttttggttttttcgttgttttgtttgtttctttctttgtttgtttgcttgtttttgagacaaagtcagtctcacttcttcgccctggctggagtgcagtagtgtgatctcggctcatgacaacctctgcctcccrggttcaagcaattctcgtgcctcagccgctccagtaactaggattatcggcaaatgccaccacccccgctaatttttctatttttagtagagatcagtttcaccatgttggccacgctggtctcaaactcctgacttcaggtgatccacatgtctcagcctcccaaagtgttgggattacaggcatgagccaccacgccggcctatcctgagccttttgaagctgacgccagaggtgcaaagcscagcctctccccactggccacrtagaggctcttgttgggtagtctctcagcctgcagcagccagggatctggcctcaagtgatgccccaacagtgagcgacttcccagtactgtcaggggaatcccaagtctaattcaaagttgattttttaccagcaatgaatgatagacatggtctccattgctcaaggctctgggaagatctagactagagaaaatgatcattgacttctacccacacctgtgggcctcagttmttccctctggtccatggttggcatggtaaccccttacaaaggtgtttccccaggggttcctagagtcctctgagtcaccataattctgcggtcaacagaaatggagaggtgagaggagacactcccctgccctggcaggtcccacatgttcctggcagtaacctgcatggggagcctcgccacccgtgtgcccacctgcggagttatgtagtggtccccaactagggcccctgccaccctctttcctaagggaggctgcagacttcttccatggccaaaaatccacatctaagtccccagcactggctaaaagrccctgtcatgggggctccctgtcccagctgacaytggaggaaggatggtgggggaggcagggaccctcttctacttggagctcagggaccctcttccattcccacctggctcctcctctttgctggtgctggaaggagcaggggaaagtggtgactccaccctcccttgaccccatatttctcagagctggtatcatcgatgacacccctcttggatcctcctacaggcctgcctggagaacagctcacagcacagtgccctcccagcagatgatgagtctggggtgctagtccagtaatgcttcaggaatgacggcagaaaaaggagctctgttttctgctctgaaagtggggagatggcagggccccagcattcacatcctaggccacaggggtgtgggtgttcaatgttggttgccaacaccactgccaaccacttctggaagcgtttgcctgtttgtttgcttgtgtttctacagagtcaagtgctagatgctcttaaactcaggggggaagatttcaccactagagagggtsstctttcctgctgccatctctgggggcatctgatgcttgtgacctccagattatattgaaatagccccarctctgggcaccaggagacaggaggctcagtcctggccttctctgccttcaccttttcctgctgtgaggtttccacaaggcaccccatgccactgggccattctcacctgagaattgagaaagaacaatctgccccttatggaaagacaaaatcaggcaaagggccccttgtgttgggggcaggatccctgcactcagagggatatagaagctgaaataactgggttgggagcggtggctcatgccagtaatctcagtactttgggaggccagggagggtggatcacctaaagtcaagagctcgagaccagcctggccaacatagtgaaaccccgtctctayttaaaaagtacaaaacttagcccggcatagtggcgggcgcctgtaatcccagctactagggaggctgaggcgggagaatcactggaacccaggaggtggaggttgctgtgaggcaacatcatgccactgcactccagcctcrgagacagaatgagactccatcaaaaacaagaaagaaagaaagacaaagagagaaagaaagaaagaaagaaagaaagaragagagagagagagagagagagagaaagaaagaaagaaagaaagaaagaaagaaagaaagaaagaaagaaagaaagaaagaaggaaagaaagaaaggaaactaaaataactaaataactgagtagcaccacaccacctgctctggagaaaggacttttgttgttgttgttgttgttgttgtcgttgttgtggttgttgaaatggagtctcactctggcgcccaggctggagtgccatggcccaatcttggctcacggcaacctctgcgtcctgggttcaagcgattctacctcctcaccctccggagtaactgggattgcaggcttctgccaccacacacagctacttttgtatttttaagagatggagttttgccatgttggctagtctggccttgaactcctgacctcaagtgatccacccacctcagtcttccaaagtgctgggattacaggcatgagccaccatgcccggcctggagaaaggactttaaatgacgcaatgtgggaagagcmaggttgtggagatctgctgccctggctgaggtagctcatgcaatcagtctctctgagcctcagtctcctgatctgtgaaatgggatgatastcatacctcctacacaagacaagttgcaggtcagacgtgagaatgcacaggcaggcctttgacaactggataagctctacacaggtctggaaaggaggaagagacaaaagaggacgggcttccatggctggatagggcctctttcggcgtgatgtgttctgagttttaaagctggggaagagactcaaatcttcaagagctcttccaactttgagattctctgttggtttcaggactatgggaggaagcgcttgtggtccgtgtctgttcccgggatttctgtttcttggtttgtatctctgctwcaggtccaaggagctgrggcaataccttgagtctgggttattcrtccccagkgacctgggggagccccaccgcctccgccccaaggttcagggaaaggggagagcaatgtgtggggttggttctctctagtggtcagtgttagcactgcatccagctgactcaggtgggcccaggagtcatcagcaaaagtggaattcaggactcaatggtgctcagaacccccacaatctattggctgtgcttggccccttttcccaacacacacattctgtctggtgggtggaagttaaacacgcggggaggaggaaaggaataggatagagagtggaatggggtcggtaggggtctcaaggactggctatcctgacagccttccccgcgttcaggttgaccaacatggcctgcagccagagggcacccacctgacccttaaagagaggacaagttgggtggagtctgtggctgacactctgtgcacaatccttacaacactggtgatggtgagaagggaaagacgacaagccagggggcatgatcccagcatgtgtgggaggagcttccaaattatccattagcacaagcccgtcagtggccccatgcataaatgtacacagaaacaggtggggtcaagcagggagagagaactggccagggtataaaaagggcccacaagagaccggctctaggatcccaaggcccaactccccgaaccactcagggtcctgtggacagctcacctagtggcaatggctccaggtaagcgcccctaaaatccctttgggcacaacgtgtcctgaggggagaggcagcgccctgtagatgggacgggggcactaaccctcaggtttggggcttatgaatgtgagtatcgccatctaaggccagatatttggccaatctctgaatgttcctggtctctggagggatggagagagagaaaaaaaacaaacagctcctggagcagggagagcgctggcctcttcctctccggctccctccattgccctccggtttctccccaggctcccggacgtccctgctcctggcttttgccctgctctgcctgccctggcttcaagaggctggtgccgtccaaaccgttccgttatccaggctttttgaccacgctatgctccaagcccatcgcgcgcaccagctggccattgacacctaccaggagtttgtaagttcttggggaatgggtgcgggtcaggggtggcaagaaggggtgactttcccccactggggaagtaatgggaggagactaaggagctcagggttgttttctgaagcgaaaatgcaggcagatgagcataggctgagccaggttcccagaaaagcaacaatgggagctggtctccagcatagaaaccagcagtccttcttggtggggggtccttctcctaggaagaaacctatatcccaaaggaccagaagtattcattcctgcatgactcccagacctccttctgcttctcagactctattccgacaccctccaacatggaggaaacgcaacagaaatccgtgagtggatgccgtctcccctaggcggggatgggggagacctgtggtcagggctcccgggcagcacagccactgccggtccttcccctgcagaatctagagctgctccgcatctccctgctgctcatcgagtcgtggctggagcccgtgcggttcctcaggagtatgttcgccaacaacctggtgtatgacacctcggacagcgatgactatcacctcctaaaggacctagaggaaggcatccaaacgctgatgggggtgagggtggcgccaggggtcrccaatcctggaaccccactggcttmgagggctgggggagagaaayactgctgccctctttktagcagtmaggcgctgacccaagagaactcaccttattcttcatttcgcctggtgaatcctccaggcctttctctacaccctgaaggggagggaggaaaatggatraatgagagagggagggaacagtgcccaagcgcttggcctctccttctcttccttcactttgcagaggctggaagacggcagccgccggactgggcagatcctcaagcagacctacagcaagtttgacacaaactcgcacaaccatgacgcactgctcaagaactacgggctgctctactgcttcaggaaggacatggacaaggtcgagacattcctgcgcatggtgcagtgccgctctgtrgagggyagctgtggcttctaggtgcccgmgtrgcatcctgtgacccctccccagtgcctctcctggccctgaaggtgccactccagtgcccaccagccttgtcctaataaaattaagttgtatcatttcatctgactaggtgtcattctataatattatggggtggaaggtggtggtatggagcaaggggtaggtggaaagaagacctggagggccttcaaggtctattgggaactaggccactgaaatataaraggtttggctgttcctgggccagaaaaaagctgacacatcactgctgtctattactcactaaggccattccaccagctcagtggtcccagcttgctggtcacagcycattggtcatctcagagatgacttgaaggcatttyttcctcccccaccatcaccagcaacaccaaacctagccccccaggagcggaaagaaatgaaaacaagatgggctattaagtgcagaggcaaaaactccccaacaggtgaggaaacaatggcatagaattacttgtgttcggaagaattttaagatgagtattccttaagcccaactactctcgggaaatgagaacaatgcaaaaatgagtttgagacatacagaaccagagcatttggaatctgaattagggcaagggaagtggaagagwgattttatttggggttgtaaatgcagtgccaacaggtkccaggtagataacaaygtaagcaatgagggctggatgggaggggataaatcccagatgacactcrcttcccttcgggggatgcaacacagaggggtgggaaccagcacaatctgcagaactcargcccctgctgaggtgggacccacccagcctgtcaccatcaggactgmagggacacggcttccagaccttctgaccttttgagacagccaggacatccagacttttacaggaattctaacatttaaacactggcaacacatattgaaaatcttttaagggcaaaaattaaccsaaacacacatggtctccaagctgtctgtgagcaattttrttctaagagatgttgattggggtaacttggtgtaagggaaagaatcagaaagatttgggctgtatgtaatttagtgcccccgaataaattacttgaccaagctgagataataatatattgctttacaaggattatgtgaggactaaatgcaatggtatttttgatatattatagtactcaagaaattctagctatttctgcattgaatttttggatgttttgtgttttctgatggagtgtctaaatacctgtagtgaaattatattgttttcctaatgacaattaggaaataataaacatctcagatgtttattatttccaaataagcactaaagagcggtggttagttaagagtttgctctcccaagcaccttggctaagtgactggtgacctataaatcgatgctaagatgctcacaggaactctagtatccaaaaatgatttcataaagtcaggaattgttttgcaatgcaaataatcaaccccccaattaatcttctttagaagttcgattcttaaatgctataatgaattttcttgataatgagacccacttgtattcatttttggctattttaccattaataactcagtccttgggaagtggttgaaagttgaactaaacagaattctggagctgctgcatttctcagctcagaagccattcctgcatcttgcattgttcttctactatcgggctttaaaattatggcattttggagttagaagggcctcataagtcagcctagtttcttctactttgggaatcttatcctacaacatccattacagtcagtattccatttacgagtgtgtagcactagaaccaagggaatcactttcacaaggctcctcattctattaaaccactctcattgcaaaaaactatttcttgcacgaagctggaatcaatattcctgcaatgtccttcatttggccttaaaattatttagaaatctcagtctttagaagttgatggaatgagcacaattataattatctctcggcttgcgtgttttaaaaggaaatgtgagccatcttaataagtatttgttgaatgcacgtgacagtggaatgacaatgtccagcgcctacttgggtggctaagagggttctaaagtggggtggtcataacatgtwactgaactgcaggsggagccacactccagagactgtccacccagctcccctcgggtataggaaactccactcaaccactgctggttgagaattagaaagatactaccaactttgcacattttaaaatataaaaagaccttaaagaccatctactttaaactctttgatttacccactgttagtctacatttcagctcatcaacttggtgtggacrgcaatttccgctgcaaatttgagatgcctagggtgttttytaaacgatgcattcgtgagccctcactccctgagattctgatataattagactggaatgtggtccaggcaagagtaatttgaaaactttcccaggtgattctaacatgtaaacaaggttgagaaccaccgtgttagggaccgcaaagatgagacccatgtgttcacagctgttgtactggtggaacagggaaaacagagaaaaaggagatgagaaaaaggagaaaaaggagatggcagttgtggtgccacctgctcctaattccaaccagtcatctaaaagtgtttatcgtgagccagtcacaaaaagacaaatactctccgattccagtcagatgaggtactcagagcagtcaaattcatagagacaaaaagtaggatggtggctgccagtggctgtggggagggatggaatagggagctatttaatgagcacagggtttcagctgtgcaagatgaaaagggttctggagatggttggtggtgagggttgcatgacgatgtcaatgtacttgacatgactgaactgcacaggcaaaatggttaagatggaaacgtttatatcttctcacaactaaaaattgttaatagtttctttttgttttgtttttgtttttgtttttgagacagaggctggagtgcagtggtgggatcttggctcactgcaacctccgcctcctcccrggttcaagtgattctcatgcctcagcctcctgagtagctgggattataagtgtgcaccaccacacagggcagatttttgtatttttggtaaagacagggtttcgccatgttggccaggctggtctcaaactcctggcctcaggtgatccacccaccttggcctcccaaagtgataggatcataggcaggagccaccaggcctggcccttaatggtattttctawygaaaactcttcctgaagataagattagtgagactcgcacagggaagagttcagcaggcagagctccagtcatccttgacccctggcataatgttttactgactctgtcattttttttgaatttaccctaacctaaagtgaccaattctgaatttcttccatgagcattgtcgaaatacacatggtgggttttgtccctttatacacagttgagagcagaactgaccccttcccttttcttctgaattacagggtctgggcttctaggccaagacaagctgacattttgcctggctgcttctttaattcagaaggccctgaagtgctgtggcacacaatgagcaccgctgggattagggttaccaactcgtcctagtttgcaggagactttctcaatgtcaacactgaaagtcccacgttccttccagggatccctcagctgaatgaacactcagctaacaggactggtcaccctattagtagtcctaaatcttagggtaccaaactgtggggaaagtaggggaaggagcaagaaaaagactagaaaaaccggaaagctgtgctcggtgtatatgacctttgatggccctcatggttatcatggatttctgattcttgctttgagtttactgtgattataawgatgtgcttaattaccactagaattatcagtgtaataataaaaaacaactaatgtgaacacatatctccagcaccatgctagtttattacatgtattgtgtcatttctttctaattataattctctaaggtaaatactattattaatcctatggtaagaagtcccactaacgatgtaacttatgctttctcaggtctagagagaaagacaccagaatgtcaccctgaccatccttgagaggataaacggccaggcacggtggctcacgccagttatctcagcactttggagggctgaggcgggaggasgtcacaagttcgagacaagcctggccaacatggtggcaccccgtctcttactaaaaatacaaaaattaccaggtgtgatggtgcacacctgtattcccagctactgaggcrcgagaatcacttgagcccaggaggcagagttgcactgagcccatcatgccactgccctccagctggatggctgagcaagattctctctcaaaaatagtaagaaagagggtaaacttttggagtattaaaggccactcttcctctggagataatcaaggtagctgcaatttaagcataagctggttgctttaatgttcagaaagaatatgatcaaaaccatttagagggtggggcctcctcttatagacaatgaggcagctacccttagaagctctattatactggaaaagagatatgagacccttcctactttaagaatcaatgaagccgggtgtggtggctcacgcctgtactcccagcattttgagaggccaagctgggcagatcacctgaggtcaggagtttgagaccagcctagccaacatgatgaaatcctgtttctactaataacacaaaaattagccgggtgtggtggcgcacatctggaatcccagctactccagaggctgaggcaggaaaattgcttgaagctgggaagcagaagttgcagtgagccgagattgygccactgcactccagcctgggagacagagcgagactctgtctccaaaaaaaaaaaaaaagaaaagaaaaaaaagaatcaatgagaaggggctgcctgcctgaccactggttgtgtggatccttcgggaaggaaagcgaacagaggttccaagtctacaagggaaacagcccagcctactctgaagagctttgcgggacggctcatccaaactactgagctctaagaactggaaccctggaaaccccagcaagaggacacccgcagctggaccaggccccgaagaagcagatcatcctccctcagagatccacagcagctgggaacccggatctgcagacccgcttggtttgagggtactgtgtgggaccatctgtcaacactgacaccctgtggcagtgagaagcaaaggcagcagccggctaagcctccaggatctccctgctggaactagaaagtccaagtggcccccttcttccctctttttttkgttttgtttgttttgttttttgtttgtttgcttttgtttttgttttcttcaagatggggtgtcactctgttgcccaggctggagtgcaatggtgcaatcttggctcactgcaacctcagtatcccgggttcaagcgattcttctgcctcagcctccccagtagctgggattacaggtgcacaccrscatgcctggctcatttttcccttcctttttggattcgctgtgcttcaaggcactgaggccatgaggcagggtttgcagatacagggtaactacagccctgatgcgactgatcctgacaccaaaatggctgtggatccctgcatggtgtggctgtatactcctgtctcttaaacctgcttcttaacttacttccccaaatgctcaattcagggaaggtggatgatttatattagactcacatgatgaaggagcagtagctccacctagtggaaacattgaggttgaaaagktcatgttcsgggatgatgctattttacaaagtcaagatatttcgtgtccctccgggaagccttccttgatccgagttatgctttctcttaacaatctgttttcccagtcataggagttcatgcacaaatgtaatctcctacttgtttgtctagctttcctaatatatttttggaagccaggaacaatgttttgttcaccactgtatccccactgccttgtatgtggtgaaaccaaagggttacttttacacttaatctatarcaccagactcaggggaggtctgggaagaatgggaaaacgttttccctctgctgtctgatgccatggttttttctagctggtatctgcaatttggaaggctatggacctctctctatctggaagtctgacctttagctttcatttttgttcctttattttgcttttgagacagggcctggctccgttgcccaggctggagtgcagtgcatgatctcaactcgctgcaaccctccacctcccgtgctcaagtgatcctcccacctcagactctcaagtagctgggactacatgcatgtgccactatacctggctaagttttrtgttttttgtagaaatggggttttgccatgttgcccaggctattcgcaaactccagggctcaagtgattcacctgcctcagcctcccaaagtgctgggattacaggcgtgagccaccacaccagcctgaatttcagttttgaaagcaggtcaaataggctgctgccctcagttaatgcacccccggccctgggctggttgtttatgctatcaacacggtattttttccttagaaattgtacttaaagttataaaatgcagccgggagtgatggctcaggcctgtaatcccagcactttagaaggccgaggtgggtagatcacgaggtcgggacttcaagatcagcctggccaaggtggtgaaaccctgtctctactaaaaatacaaaaaattagctggtcatggtggtgggcgcctgtaatcccagctactcttaatctatagaggctgaggcagagaattgcttcaacccgggggtggagtttgaagtggacygaaatcacaccactgcactccagcctaggcaaagagcgagactccatctaaaaaaaaaagttataaaatgcagccatttgacataagagcttttagcaatgacacagaagggaagggaactgcatttggacatcataaaaccacttttatttttaccatagcaacattccagtgaacatttcttgactgatttgggagaaaacatctggttctgtgattcctcacgccttctccgagggtgaatatactctttcycaaggacagggaaagaagctgaaacataaaatcatatgaacattttcacaagaagattcctcttgaagcttcaaggaaattgtttacagacagaagaaartatgcacttattgatgaaaagggagagtaaagattggaactttaacctagatgcccatatgggtaaaaaaaagaaaactggcaaatgcgaactcacagttgatcactctatgaaaaggaattcagagatgtttggagctcttaacctatgaggccaatttcatggaagaactctaccttctccttcagagacagaatactgagctagataggatgcccgtctggcccraagtggaatttcttaccatctgtatactcccccaagacccgcaacagatggttactgagttgaagcttgccactgatccttaatgatgtcaacaagctcagctctgggagctggccctccagaagcccaggtcaggggagcaagggaaagtggagatrggaacagagctctgattcctggccccatatttgatacttactcccttcaaagtcctgtccttggactacagatttagttcccagttagtaatcagaaaaccatgaaatatgagttgtatttctaagatatgcctgactttagtatgatgtttaagagaaaagggcagtgagaaccatgaagaaacggcaagatcttttctttttttttttttggatctaagagtggactgatgatgcacctggcaaggagcaagaggccttcttacaaatcaaacattgagactgagattcctaatgaatagagtgagctctaaagagaaaggtggctgggcgcggtggctcacacctgtaatcccagcaytttgggaggccaaggtggscggatcacttgaggtcaggagtttgagaccagcccagccaacatggtgaaaccccatctctacgaaaagtacaaaaattagacaggcatggtggtgtgcacctgtaatcccagctactggggaggctgaggcaagagaatcacctgaacccgggaagctgaagttgcagtgagcccgagatcgcatcattgcatccagcctagggcacaacagcgagactccatctcaaaaaaaaaaaaagagacagagagagaaaggtgagcttgtggacatattggacacacaggacatggggcatgggggcctgaaacaccgttttacaggacagacgtacacaaaggggaatgcagcctgccattgtgtttcttcctttctcctctatcccttcttccctccctgggaaaccacagtagccagaagtctcattcaatcaaatagctgtcaattatatgagttgtacttttctcttcctgaacagcaaatggctttcctcctctttgtcctcctctttctgcctatagagcaatttgcctcctgtccactttgcagggccgatagctcaaatacagtgctatggtgatgacacccactccaagggcaacggtaataatgacaaagagggtagagctgattccttcatccagtcctgcccaagcacagaagatagagttaggaaagtctgagagtacaaggatcacccaccccagcccaccaggcccacttctgagtctcattcttcccaacctagtagaatctttcttattttcatgcttrgataagaatcccaaacccctgaggggtttccatcctgggcctggcagcagggcagcaaaggttaccttgaacaatgacagcaatgtctttgctgacagagcccagctggttagtggctgtgyagcggtaggttccagtgtggttctrggttgccttctgtggcacttcaaggtcaaagaccaccccattccaggtacacaccaaggctggagctgggtttccctttgggacgcaggygagcktgtgttccatcccttccagccaggtctgtttggcagagcaactggattcctctaaccrtggtkggtctgcagaaacagtwtcccaaggagctgagttcagtgcaccacactccctccctacttcaycccctgctccctctcctcccctcacccaaatgctgtcmcctycacccaacagctttccttcccaagggagcactagcagctccctgctttgagccaactcttctttcccactttccgtatggrcagggagtcccagatgaaacctagggtgttcttatggatttggactaaatgataacsctgctctgtccatggtggccctggggcccctgcttcccatgtttgyttctcrgtgggtaaggagctaggtaacrgkgaactcagagatgaggatttttctacttttctttttggttttttttggttgtttgtttgttttggagacaaagtcagtctcactycttcgcccwggstggagtgcagtggcgcgatctcggctcatgacaacctctgcctcccaggttcaagcaattctygtgcctcagccgctccagtaactaggattacaagcgcatgccaccacacccggctaatttttctatttttagtagagatcagtttcaccatgttggccacgctggtctcaaactcctgacttcaggtgatccacatgtctcagcctcccaaagtgttgggattacaggcatgagccaccacgccggcctatcctgagccttttgaagctgacgccagaggtgcaaagcgcagcctctccccattggccatgtggaggctcttgttgggtactctctcagcctgcaggagccagggatctggcctcaagtgatgccccaacagtgggcgacctcccagtactgtcaggggaatcccaagtctaattcaaagatgattttttactagcaatgaatgatggatgtggtctccattgctcaaggctctgggaagatctagactagagaaaatgatcattgacttctacccacacctgtgggcctcagttcttccctctggtccatggttaccatggtaatcccttataaaggtgtttccccaggggtccctagagtcctctgagtcaccataattctggggtcaacagaagtggagaggtgagaggagacactcccctgccccggctggtcccacgtgttgctgtcagtaacctgcctggggagccttgccacccctgtgcccacctgcggagttatgcagtggtccccaactagggcccctgccaccctcattcctaagggaggctggagacttcttccatggccgaaaatccacatcgaagyccccagaactggctaaaaggacctgtcatgggggctccctgtcccagctgacattggaggaaggatggtgggggaggcagaaagctacatggagctcagggaccctcttccattcccacctagctcctcctctttgctggtgctggaaggagcaggggaaagtggtgactccaccctcccttggccacatatttctcagagctggtatcattgatgacacccctcttggatcctcacacaggcgggcctggagaacagcccacagcacagtgccctcccagcaggtgatgagtctggggtgctggtccgataatgtttcaggaatgatggcagaaaatggagctctgtyttcygctctgaaagtggggagatggcagggccccagcattcacatcctaggccacaggggtgtgggttttcaatgttggttgccaacaccacagccaaccacttctrgaagcatttgcttgtttgcttgcttgtgtttctacagagtcaagtgctagatgctcttaaactcaggggggaagatttcaccactagagagggtgctctttcctgctstcatctctgggggyatctgatgcttgtgacctccagattatattgaartagccccaaccctgggcaccaggagacaggaggctcagtcctggccttctctgccttcaccttgtcctgctstgaggtttccacaaggcaccccatgccactgggccattctcacctgagaattgagaaagaacaatctgccccttatggaaagacaaaatsaggcaaagggccccttgtgttgggggcaggatccctgcactcagagggatatagaagctgaaataactgggttgggagcagtggctcacgcaagtaatctcagtactttgggaggccagggagggtggatcacctaaagtcaagagttcgagaccagcctggccaacatagtgaaacccccgtctctactaaaaaagtgcaaatcttagcccggcatagtggtggacgcctgtaatcccagctacttgggaggctgaggcgrgagaatcaccggaacccaaaggtggaggttgctgtgaagcaacatcatgccactgaactccagcctgggtgacagaatgagactccatctcaaaaaaaaaaaaaaaaggaaatgaagctaaaataactaaataactgagtagcaccacactacgtgctctggagaaaggattttttttttttttttttttgagatgtagactcgctctgtcatccaggctggagtgcagtggcgcaatcttggctcacagcaacctctgcctcctgggttcaagcgattctcctgcctcagcctcccaagtagctgggattacgggctcgtgccaccatgcccagctaatttttgtatttttaggagagatggagttttgccatgtgggttagcctggtcttgcactcctgaccttaagtgatccacccacctcagcctcccaaagtgctgggattataggcatgagccaccgtgcccggcctggagaaaggactttaaatgacgcaatgtgggaagagcaaggttgtgaagatctgctgccctggctgaggtagctcatgtaatcagtctctctgagcctcagtctcctgatctgtgaaatgggatgatagtcatagctcctacacaagacaagtggcaggtcagacgtgagaatgcacaggcaggccyttgrcaactggataagctctacacaggtctggaaaggaggaggagacaaaagaggaggggcttccatggctggatagggcgtcttttggcgtgatgtgttctgagttttaaagctggggaagagactcaaatcttcaagagctcttccaactttgagattctctgttggtttcaggactatgggaggaagcgcttgtggtccgtgtctgttcccgggatttctgtttcttggtttgtatctctgctacaggtccaaggagctggggcaataccttgagtctgggttattcgtccccagggacctgggggagccccccccccccacacccacacccacccccacccccacccccatccccacgccccgcccccgcccccgccccaaggctcaggtaaaggggagagcaaagtgtggagtttgttccctctagtggtcagtattagcactgcatccaggcgggcctgtctcagrcgagcccaggagtcagcaaaagtggaattcagcactgaatcatgcccagaacccccgcaatctattggctgtgctttggccccttttcccaacacacacattctgtctggtgggtggaggggaaacatgcggggaggaggaaaggaataggatagagagtgggatggggtcggtaggggtctcaaggactggctatcctgacatccttctccgcgttcaggttggccaccatggcctgctgccagagggcacccacgtgacccttaaagagaggacaagttgggtggtatctctgctgacattctgtgcacaaccctcacaacgctggtgatggtgggaagggaaagatgacaagtcagggggcatgatcccagcatgtgtgggaggagcttctaaattatccattagcacaagcccgtcagtggccccaggcctaaacatgcagagaaacaggtgaggagaagcagcgagagagaaggggccaggtataaaaagggcccacaagagaccagctcaaggatcccaaggcccractccccgaaccactcagggtcctgtggacagctcacctagcggcaatggctgcaggtaagcgcccctaaaatccctttgggcacaatgtgtcctgaggggagaggcggcgtcctgtagatgggacgggggcactaaccctcaggtttggggcttatgaatgttagtatcgccatctaagcccagtatttggccaatctctgaatgttcctggtccctggagggaggcagagagagagagagaraaaaaaaaacccagctcctggaacagggagagcgctggcctcttgctctccagctccctctgttgccctccggtttctccccaggctcccggacgtccctgctcctggcttttggcctgctctgcctgtcctggcttcaagagggcagtgccttcccaaccattcccttatccaggctttttgacaacgctatgctccgcgcccgtcgcctgtaccagctggcatatgacacctatcaggagtttrtaagctcttgggtaatgggtgcgcttcagaggtggcaggaaggggtgamtttcccccgctgggaagtaatgggaggagactaaggagctcagggttgttttctgaagtgaaaatgcaggcagatgagcatacgctgagtgaggttcccagaaaagtaacaatgggagcwggtctccagcatagaccttggtgggcggtccttctcctaggaagaagcctatatcctgaaggagcagaagtattcattcctgcagaacccccagacctccctctgcttctcagagtctattccaacaccttccaacwgggtgaaaacgcagcagaaatctgtgagtggatgccttctccccaggtggggatggggtagacctgtggtcagagcccccgggcagcacagccactgccggtccttcccctgcagaacctagagctgctccgcatctccctgctgctcatccagtcatggctggagcccgtgcagctcctcaggagcgtcttcgccaacagcctggtgtatggcgcctcggacagcaacgtctatcgccacctgaaggacctagaggaaggcatccaaacgctgatgtgggtgagggtggcaccagggatccccaatcctggggccccactggcttccagggactggggagagaaacactgctgccctctttttagcagtcaggcgctgacccaagagaactcaccgtattcttcatttcccctcgtgaatcctccaggcctttctctacaacctgraggggrgggaggaaaatggatgaatgagagagggagggaacagtgcccaagcgcttggcctctccttctcttscttcactttgcagaggctggaagatggcagcccccggactgggcagatcttcaatcagtcctacagcaagtttgacacaaaatcgcacaacgatgacgcactgctcaagaactacgggctgctctactgcttcaggaaggacatggacaaggtcgagacattcctgcgcatcgtgcagtgccgctctgtggagggcagctgtggcttctagctgcccgggtggcatccctgtgacccctccccmstgcctctcctggtsgtggaaggtgctactccagtgcmcaccagccttgtcctaataaaattaagttgcatcattttgtttsactaggtgtccttgtataatattatggggtggaggcgggtggtatggagcaaggggcaggttgggaagacaacctgtagggccttcagggtctattgggaaccaggctggagtgcagtggcacgatcttggctcgctgcaatctccgcctcctgggttcaagcgattctcctgcctcagtctcccgaatagttgggattccaggcatgcacgaccaggctcagctaatttttgtatttttggtagagacggggtttcaccatattggccagtctggtctccatctcctgacctcaggtaatccgcccgcctcggcctcccaaattgctgggattacaggtatgagccactgggcccttccctgtcctgtgattttaaaataattataccagcagaaggacgtccagacacagcatgggctacctgrccatgcccagccagttggacatttgagttgtttgcttggcactgtcctctcatgcattgggtccactcagtagatgcttgttgaattcctgggcctggggctgtgtcagctgcctcrtcccatcaccttctggcttattctctccctccgtatcttagctttttacttcatgggaatgtttccaattcgaaatttctattttaccgttatatatttacttttttgctgttttctcggcccccagtagattgttagctccagaagagaaaggatcatgtcttttgtttatctagatatgcccatctgcctggtacaatctctggcacatgttataggcaacaactacttgtggaattggtgaatgcacgaatagaagaatgagtgaatgaatgaatagacgaaaggcagaattccagcctcaggcagggcgcggtggctcacgcctgtaatcccagcactttgggaggtcgaggcaggtggatcacgaggtcaggagttcgagaccatcctggctaacacagtgaaaccccacctctaaaaatacaaaaaaattagctgggcaaggtggcgggcgcctgtactcccagctactcgggaggctgaggcaggagaatgtcatgaaccccagggggcagagcttgcagtgagccgagatcgcgccactgcactccagcctgggtgacagagcaagactcggtctcaaaaaaaaagaaagaaagaaatccagcctcaaagagcttacagtctggtaaggggaataaaaatgtctgcaaatagccacaggacaggtcaaaggaaggagaggctatttccagctgagggcaccccatcaggaaagcaccccagacttcctacaactactagacacatctcgatgcttttcacttctctatcaatggattgtctccctggagaataatccccaaagtgaaattacttagcacgtcaggttaggtagatccttgtgtacttcttggttgttcagagatcatcaaccagtgcaaacaatccccccatcaatacacagcggtgcctgccccttgcctccccagaccttccgaggcccttcctccgtgcctgaaccccctggacatatcatgtggcaaactgaagggtccaacgacatacaggaagcgaaacacgatgtacactgaaaygtgcaatacaaatatgcagcatgaagtgcctcggttcactaacccgagctacgttgggtgcctcttttctaccactttycttaatgcctatggacacctcattctgtggctgaagttccttgtgttcaattccccccatcttcattgaacatcctctgtgcagggacttgacccctgtcctgctagctttgcactgaggcaagttctgtccatgcctattagtgccaccatctttactagatgaggtttctaaagagcttggcatggaaggaaagcccaggggccttggaagccattacttaggaactgggagagctccaggcaaaccatcttatctctttgggcctcagtatcctcactcacatccctatggtcagtagagtgccaagcacatggtggacacacagaagtattgatcatcttcctcacctcccctaggagagcccttgggaatccccayataatattctctgaagacctcaatccaatgagccgagtaattgactcagtagcaaactcatagaaaggacattagaagccaaaaggaggtagagtatgtcccagtacaataaccagcctctgatctcaaggaagaaagaacagagctgcaggtgagaagtgtgcgcctcaaatcaccaaagtgagagtggaaggagcacccaccagtccctcggaggcgattcctgagaccggtgagaatggcttcgaaaaatgtgatcgtcctcaaccccacagtcttgaacctaacaggagatcttgaagcctgaaagacaccactttaggatcaacagcagatctgtgactttccacagcaggcacacagaaccctagagttagtcgaggttggacataggaagggcttccaaacacacagataaattcatggatcctaaattataaagggaggttccttaaaagaagcaagatgattgtgagattatcatcagcttttttttttctcttgatacagagtcttactctgtcacccaggctggagtgcagtggcatgatctcggctcgctacaacctccacctcccgggttcaagcaattccctgccacagcsacctgagtagctcggattacatgcgcctgccaccacgcgcagctaatttttgtatttttagtagagacgggatttcaccatcttgaccaggttggtcttaaactcctgacctaatgatccacccaccttggcctcccaaagtggtgggattacaggtgtgagccaacgcacccgacctatccagagccttttgaggctgatgctagaggtacaaagcccagcctctccccactggccatgtggaggctcttgttgggtagtctttcagcctgcagcagcgagggatctggcctcaagtgatgccccaacagtgggcaacttcccagtactgtcaggagaatcccaagtctaattcaaagttgattttttactagcaatgaatgatagacatggtctccattgctcaagggaagatctagactagagaaaaggatcaccaacttctayccacacctgtgggcctcagttcttccctctggtccatggttgccatggtaaccccttataaaggtgtttccccaggggtccctaacgtcctctgagtcactataactctggggtcaacagaagtggagaggtgagaggagacactccccttccctggctggtcccacatgttcctggcagtaacctcggcacccctgtgcccacctgtggagttatgcagtagtccccagctagagcccctgcccccctcattcctaagggaggcttcccttacgaatggccaaaaatccacatctaagtccccagaactggctaaaaggtcctgtcatgggggctccctgtcccagctgacattggargaaggatggtgagggaggcagggaccctcttctacttggagctcagggacccacttccattcccacctggctcctcctctttgctggtgctgggaggagcaggggaaagtggtgacaccaccctcccttgaccccatatttctcagagctggtatcattgatgacacccctcttggatcctcacacaggcttccctggagaacagcccacagcacagtgccctcccagcaggtgatgagtctgkggtgctggtccggtaatgcttcaggaatgatggcaraaaawggagctctgtcttccgctctgaaagtggggagatggcagggccccagcattcacatcctaggccacaggggtgtgggttttcaatgttggttgccaacaccacagccaaccacttctagaagcatttgcctgtttgcttgcttgtgtttctacagcrtcaagtgctacatgctcttaaactcagggtgggagaagatttcaccactacagagggtgttctttcctgctctcatctctgggggcatctgatgcttgtgacctccaggtggtatggaaatagccccaaccctgggcaccaggagacaggaggctcagtcctggccttctctgccttcaccttgtcctgctacgaggtttccacaaggcaccccatgccactgggccattctcacctgggaattgagaaagaacaatctgccccttatggaaagacaaaatcaggcaaagggccccttgtgttggggrcaggatccctgcactcagagagatttagaagctgaaataactgggttgggggcrgtgactcacgccaktaatctcagtactttgggaggccagggagggtggatcacctaaagtcaagagttcgagaccagcctggccaacatagtgaaaccccgtctctactaaaaaagtacaaaacttagcccggcatagtggtgggcacctgtaatcccagctacttgggaggctgaggcgggagaatcactggaacccaggaggtggaggttgcagtgaggcaagatcatgccactgcactccagcctgggagacagaatgagactccatcaaaaacaagaaagaaagaaagaaggaaggaaggaaagaaggaaggaaggaaggaaggaaggaaagaaagaaagaaagaaagaaagaaaaagaaagaaagaaggaaggaaggaaagaaggaaggaaggaagaaaggaaggaaggaaagaaagaaagaaagaaaaagaaagaaagaaagagaaagaaaaaggaaagcaagaaagaaaagaaagaaagaaagaaagaaaaagaaagaaggaaagaaaagaaactaaaataactaaataactgagtagcaccacaccacctgctctggagaaaggacttttgttgttgttgttgttgttgtcgtcgttgttgtggttgttgaaatggagtctcactctggcrcccaggctggagtgccatggcccaatcttggctcacggcaacctctgcgtcctgggttcaagcgattctacctcctcaccctccggagtaactgggattgcaggcttctgccaccacacacagctacttttgtacttttaagagatggagttttgccatgttggctagtctggccttgaactgacctcaagtgatccacccacctcagtcttccaaagtgctgggattacaggcatgagccaccrtgcccggcctggagaaaggactttaaatgaygcaatgtgggaagagcaaggttgtggagatctgctgccctggctgaggtagctcatgyaatcagtctctctgagcctcagtctcctgatctgtgaaatgggatgatagtcatasctcctacacaagataagtggcaggtcagacgtgagaatgcacaggcaggcctttgacaactggataagctctacacaggtctggaaaggaggaagagacaaaagaggacgggcttccatggctggatagggcmtctttcggcrtgatgtgttctgagttccaaagctgggaagagactcaaatcttcttttttttttctttttttttaattattattattcttttactttaagttttagggtacatgtgcacaatgtgcaggttagttacatgtgtatacctgtgccatgctggtgtgctgcacccattaacttgtcatttagcattaggtatatctcctaaagctatccctccccctccccccaccccacaacagtctccagagtrtgatgttcccctgagactcaaatmttcaagagctcttccaaccttgagattctctgatggtttcagggctgtgggaggaagcgcttgtggtccgtgtctgttcccgggatttctgtttcttggtttgtgtctctgctrcaggtccaaggagctgaggcaataccttgagtctgggttmttcgtccccagtgacctgggggagccccaccgcctccgccccaaggttcagggaaaggggagagcaatgtgtggggttggttctctctagtggtcagtgttagcactgcatccagctgactcaggtgggcccaggagtcatcagcaaaagtggaattcaggactcaatggtgctcagaacccccacaatctattggctgtgcttggccccttttcccaacacacacattctgtctggtgggtggaagttaaacacgcggggaggaggaaaggaataggatagagagtggaatggggtcggtaggggtctcaaggactggctatcctgacagccttccccgcgttcaggttgaccaacatggcctgcagccagagggcacccacctgacccttaaagagaggacaagttgggtggagtctgtggctgacactctgtgcacaatccttacaacactggtgatggtgagaagggaaagacgacaagccagggggcatgatcccagcatgtgtgggaggagcttccaaattatccattagcacaagcccgtcagtggccccatgcataaatgtacacagaaacaggtggggtcaagcagggagagagaactggccagggtataaaaagggcccacaagagaccggctctaggatcccaaggcccaactccccgaaccactcagggtcctgtggacagctcacctagtggcaatggctccaggtaagcgcccctaaaatccctttgggcacaacgtgtcctgaggggagaggcagcgccctgtagatgggacgggggcactaaccctcaggtttggggcttatgaatgtgagtatcgccatctaaggccagatatttggccaatctctgaatgttcctggtctctggagggatggagagagagaaaaaaaacaaacagctcctggagcagggagagcgctggcctcttcctctccggctccctccattgccctccggtttctccccaggctcccggacgtccctgctcctggcttttgccctgctctgcctgccctggcttcaagaggctggtgccgtccaaaccgttccgttatccaggctttttgaccacgctatgctccaagcccatcgcgcgcaccagctggccattgacacctaccaggagtttgtaagttcttggggaatgggtgcgggtcaggggtggcaagaaggggtgactttcycccactggggaagtaatgggaggagactaaggagctcagggttgttttctgaagcgaaaatgcaggcagatgagcataggctgagccaggttcccagaaaagcaacaatgggagctggtctccagcatagaaaccagcagtccttcttggtggggggtccttctcctaggaagaaacctatatcccaaaggaccagaagtattcattcctgcatgactcccagacctccttctgcttctcagactctattccgacaccctccaacatggaggaaacgcaacagaaatccgtgagtggatkccgtctcccctaggcggggatgggggagacctgtggtcagggctcccgggcagcacagccactgccggtccttcccctgcagaatctagagctgctccgcatctccctgctgctcatcgagtcgtggctggagcccgtgcggttcctcaggagtatgttcgccaacaacctggtgtatgacacctcggacagcgatgactatcacctcctaaaggacctagaggaaggcatccaaacgctgatgggggtgagggtggcgccaggggtcgccaatcctggaaccccactggcttagagggctgggggagagaaacactgctgccctctttgtagcagtmaggcgctgacccaagagaactcaccttattcttcatttcgcctggtgaatcctccaggccyttctctacaccctgaaggggagggaggaaaatggatgaatgagagagggagggaacagtgcccaagcgcttggcctctccttctcttccttcactttgcagaggctggaagacggcagccgccggactgggcagatcctcaagcagacctacagcaagtttgacacaaactcrcacaaccatgacgcactgctcaagaactacgggctgctctactgcttcaggaaggacatggacaaggtcgagacattcctgcgcatggtgcagtgccgctctgtagagggtagctgtggcttctaggtgcccgcgtggcatcctgtgaccgacccctccccagtgcctctcctggccctggaaggtgccactccagtgcccatcagccttgtcctaataaaattaagttgtatcatttcatctgactaggtgtcattctataatattatggggtggaaggtggtggtatggagcaaggggtaggtggaaagaagacctggagggccttcaaggtctattgggaactaggccgctgaaatataagaggcttggctgttcctgggccagaaaaaggctgacacatcaccgctattactcactaaggccattccaccagctcagtggtcccagcttgctggtcacagctcattggtcatcccagagatgacttgaaggcatttcttcctcccccaccatcaccagcaacaccaaacctagccctccaggagcgggaagaaatgaaaacaagatgggctattaagtgcagaggcaaaaactccccaacaggtgaggaaacaatggcatagaattacttgtgttcagaagaattttaggatgartattccttaagcccaactactctcgggaaatgagaacaatgcaaaaatgagtttgagacatacagaaccagagcatttggaatctgaattagggcaagggaagtggaagagtgattttatttggggttgtaaatgcagtgccaacaggtgccaggtagataacaacgtaagcaatgagggctggatgggaggggataaatcccagatgacactcgcttcccttcaggggatgcaacacagaggggtgggaaccagcacaatctgcagaactcaagcccctgctgaggtgggacccacccagcctgtcaccatcaggactgaagggacacggcttccagaccttctgattctttgagacagccaggacatccagacttttacaggaattctaacatttaaacactggcaacacatattgaaaatcttttaagggcaaaaattaacccaaacacacatggtctccaagctgtctgtgagcaattttattctaagagatgttgattggggtaacttggtgtaagggaaagaatcagaaagatttgggctgtatgcaatttagtgctgctgaataaattacttgaccaagctgagataataatatattgctttacaaggattatgtgaggataaatgcaatggtatttttgacatattatagtactcaagaaattgtagttatttctgcattgaatttttggatgttttgtgttttctgatggagtgtctaaatacctgtagtgaaattatattgttttcctaatgacaattaggaaatagtaaacatctgagatgtttattatttccaaataagcactaaagagcggtggttagttaagagtttactctcccaagcaccttggctaagtgactggtgacctataaatcgatgctaagatgctcacaggaactctagtatccaaaaatgatttcatgaagtcaggaattgttttgcaatgcaaataatcaaccccctaattaatcttctttagaagttctgattcttatgtgctatcatgaattttcttgataacgagaaccacttgtgttcatttttggctattttacagttaataactcagtccttgggaagtggttgaaagttgaaataatcagaactctagagctgctgcatttctcagctcagaagacatttcttcatcttacatcattcttctactatcgggctttaaaattatggcattttggagttagaagggcctcataagtcagtctagtttcttctactttgggaatcttatcctacggcgtccattacagtcagtattccaattatgagtgtgtagcactagaaccaaaggaatcactttcacaaggctcctcattctattaaaccactctcattgcaaaaaactatttcttgcacaaagctggaatcaatattcctgcaatgtccttcatttggccttaaaattatttagaaatctcagtctttagaagtcgatggaatgagcacaattataattatctctcagcttgcgtgttttaaaaggaattgtgagccatcttaataagtatttgttgaatgcacgtgacagtggaatgacaatgtccagcgcctacttgggtggctaagagggttctaaagtggggtggtsataacatataactgaactgcagggggagccacatgccagagactgtccacccagctcccctcgggtgtaggagaatccactcaaccactgctggttgagaattagatactagctgactttgcacattttagaacataaaaagaccttaaagaccatctactttaaactctgatttacccactgttagtctacatttcagctcatcaacttggtgtggacggcaatttctgctgcaaatttgagatgcctaggatgttttctaaacgatgcatacgtgagccctcactccctgagattctgatataattagactggaatgtggtccaggcaagagtagtttgaaaactttcccaggtgattctaacatgtaaacaaggttgagaaccactgtgttagggaccgcaaagatgagacccatgtgttcacagctgttgtactggtggaatagggagaaaggagaaaaaggagatgagaggcctgggccagttgtggtgccacctgctcctaattccaaccagtcatctaaaaagtgtttatcatgagccagtcacaaaaagacaaatactctctgattccagtcagatgaggtactcagagcagtcaaattcatagagacaaaaagtaggatggtggctgccagtggctgtggggagggatggaatagggagctatttaatgagcacagggtttcagctgtgcaagatgaaaagggttctggagatggatggtggtgagggttgcatgacgatgtcaatgtacttgacatgactgaactgtacacgtaaaatggttaagatggaaacgtttatatcttctcacaactaaaaattgttaatactttatttttgtttttgtttttgagacagaggctggagtgcagtggtgggatcttggctcactgcaacctccgcctcctcccgggttcaagtgattctcatgcctcagcctcctgagtagctgggattataagcgtgcaccaccacacagggcagatgtttgtatttttggtaaagacagggtttcgccatgttggccaggctggtctcaaactcctggcctcaggtgatccacccttcttggcctcccaaagtgataggattacaggcgggagccaccaggcctggctcttattggtattttctaatgaaaactcttcctgaagataagattagcaagactcacacaaggaagagttcagcaggcagagctccagtcatccttgacccctggcataatgttttactgactctgtcattttttttgaatttaccctaacctaaaatgaccacttctgaatttcttccatgagcattgtccaaatacacatggtgggttttgtccctttatacacagttgagagcagaactgaccccttcccttttcttctgaattatagggtctgggcttctaggccaagacaagctgacactttgcctggatgcttctttaattcagaaggccctggagtgctgaggcacacaatgagcaccgctgggattagggtcaccaactcgtcctggtttgcaggagactttctcaatgtcaacactggaagtcccacattccttccaggaatccctcagctcaatgcaaactcagctcacaggactggtcaccctattagtagtcctaaatcttaggggaccaaactggggggaaagtaggggaaggagcaagaaaaagagtagaaaaatcagaaagctgcacacggtgtatatgacttttgatggtgctcaaggttaccatggatttctgattcttgctttgagtttactgtgattataatgatgtgcttaattaccaccagaattatcagtgtaatcacaaaaaccaacaaatgtaaacacatgtctccagcaacatgctagtttattgcaagtattatgtcatttctttctaagtataatcttctaaggtaaatactattattaatcctatggtaagaagtcccactaaagatgtaacttactctttctcaggtctaaagacaaagacgccagaatgtcaccctgaccatccttgagaggataaactgccaggcacagtggctcaagccagtaatctcagcactttgggaggccgaggcgggaggagatcaggagttcaagacaagcctggccaaaatgatggcaccccgtctctactaaaaatacaaaaattagccaggtgtggtggtgcacacctgtattcccagctactgaggcacgagaatcgcttgagcccgggaggcagagttgcgctgagcccatcatgccactgcactccagctgggtggctgagcaagattctctctcaaaaataataagaaagaggataaaattttggagtattaaaggccactcttcctctggagataatcaagatacctgcaatttaagcgtgagctggttgctttaatgttcagaaagaatatgatcaaaatcatttaggggtggggcctcctcctatagacaatgaggcagctacccttagaagctctatcatactggaaaagagatatgagacccttcctgctttcagaatcaatgaagccaggcgtggtgactcacgcctgtactcccagcacattgggaggccaaggtgggcagatcacctgaggtcaggagtttgagaccagcctggccaacatgatgaaaccctgtctctactaataacacaaaaattagccgggtgtggtggcagacacctgtaatcccagctactctagaggttgagaagggaaaattgcttgaagccgggaagcagaagttgcagtgagccgagattgcgccactgcactccagcctgggagacagagcgagactctgtctccaaaaaaaataaaaagaaaagaaaaaaaagaatcaatgagaaggggctgcctgcctgaccactggttgtgtggatccttcgggaaggaaagcgaacagaggttccaagtctacaagggaaacagcccagcctactctgaagagctttgcgggacggctcatccaaactactgagctctaagaactggaaccctggaaaccccagcaagaggacacccgctgctggaccaggccccgaagaagcagatcatcctccctcagagatccacagcaggtaggaacccagatctgcagacccgcttggtttgagggtactgtgtgggaccatctgtccacactgacaccctgtggcagtgagaagcaaaggcagcagccggttgagcctccaggatctccctgctggaactagaaagtccaagtggcccccttcttccctctttttttggttttgtcttgttttttgtttgtttgcttttgtttttgttttcttcaagatggggtgtcactctgttgcccaggctggagtgcaatggcacgatctcggctcactgcaactctgcctcccaggttcaagcgattctcctgcctcagcctccccagtagctgggattacaggtgcacaccggcatgcctggctcatttttcccttcctttttggattcgctgtgcttcaaggcactgaggccatgaggcagggtttgcagatacaagrtaactatagccttgatgtggctgatcctgacaccgaaatgtctgtggatccctgcatggggcagctctatactcctgtctcttaaacctgcttcttaacttacttccccaaatgctcaattcagggaaggtggatgatttatattagactcacatgatgagagagcagtagctccacctagtggaaacattgaggttgaaaaggtcatgttccgggatgatgctattttacaaagtcaagatatttcgtgtccctccaggaagccttccttgatccgagttatgctttctcttaacaatctgttttcccagtcataggagttcatgctcaaatgtaatgaacttttttgttcattacatacttgtcttgctttcctaataaatttgtggaagccagggacaatgttttgttcaccactgtatccccactgccttgtatgtggty

SEQ ID NO: 17594 - DNA, 43484 bp, Homo sapiens
tttattttaacttatttttattttactttaagttctgggatacatgtgctgaacgtgcaggtttgttacataggtatacatgtgccatggtggtttgctgcacctatcaacccataatctagtttttaagccctgcatgcattaggtatttgtcctcatgctctccctccccttgcctgccaccccccaacaggccccagtgtgtgatgttcccctccctgtgcccatgtgttctcattgttcaactcccacttatgagtgagaacatgcagtgtttggttttctgttcctgtgttagtttgctgaggatgatggtttccagcttcatccatgtccctgcaaaggacatgaactcattcttttttatgactgcatactattccatggtatatatgtgccacattttctttatccagtctattattaatgggcatttgggttggttccaagtctttgctattgtaaatagtgctgcagtaaacacacacgtgcatgtgtctttatagtagaatgatttctaatcctttgggtatatacccagtaatgggattgctgggtcaaatggtatttctggttctagatccttgaggaatcaccgcactgtctttcacaatggttgaactaatttacactcccaccaacagtgtaaaagcattcctatttctccacatcctcgccagcatctgttgtttccagactttttaatgatcaccattgtaactggcgtgagatggcatctcattgtggttttgatttgcatttctctaatgaccagtgatgatgagctttttttcgtatgtttgttggccacataaatgtcttgatggtgagaagtttttagtgtgtccggcattgcccaagagagggaggtttcagatttggggcatggatattttagttgaatttgctggtgtaatcttaccttgaaaagggccaagtgagtttgctgctgcagcttaatagtaatattccgttaagatcatctgactatcttagctcagattctgtgatcaccagcttatcaaaagacttcctagtactctgatattgggaatgggggtcctacctcacagacataagggtccaatcagcatggcatatataattctttagataatacataaattgtcatccagattatagatcattcttttatgaatcacaggatctcaatgttggagtatatttaagggacatttagttaaccatctacctggtgctgatattccccttataaaaagctgacaaggggttgtccatttttccttgagagtctcaagtaataggaaactcattacctctttacttctctgaatacccgtgttggaaaattctgctttatattgaaaaaaaattgtgttactttatttatttttatttttattttttgacacagaatcttattctttcgcccagtctggagtgcagtggcgtgaccttggctcaccacaaccctcgcctcctggattcaagcgattcaagtgcctcagcctcccgagtagctgggactacaggcatgcaccaccatgccaggctaatttttgtatttttggtagagatgggggtttgccatgttggccagccaggcttgtctcaaactcctgaccccaggtgatctgcccgcctcagcctcccaaagtgctgggattataggcgtgagccaccatgcccaacctaaagtgtgttactttagagcctctattccttggttgactccttgggtcacatacaaaacaatctaaatcttcttaaaaaaaatgtagataaactcatgtccccgataaacctctttccaggccaaattccctacactctttaaatcctcctaatataggatgctttcaactcattacatcatcttggtcacccttccatggacaggctttagtttctcttttaatgtgtggtcttgggcacgggcaagtgtttttgtaaaatttacaaatgtaaaatattttcattgctagtgattgactgtctcttaccactccaacttccctctgtcacacttcccctcaggtcaagtgatgctggagtggccatgagcatttctggaatacagataagaggttgttgtgttggtggtatatttagtttggatttaggagaatatatattatgtggttcactgacacttctatatctagttaactgattgatarctgccttagtgtagaaatggcttccagraaaactcctaccacccactgtgccaatttcacctggcattatgatactaaattgcaggtgtgttcagcagctaatgaaaatgttgtttttatgggttttgtgatgttgaagagatttttcagctttttacaataaatataaaatgtgctgtgcattgcgctatactccttataatgggaacatttcatggcatataaattatacctcaataaatctgttaattgtgctgtgctttcttttctgttttaaataaatatttgcttttgtgcctaaagtaaagtaaaataaaaatatgtagcaggatatctacaaaacctatacaaaacattctacttaagggtgaaatggaagaatcccctttgagattgggaattaggcaaggggatcactacttctacctttgtgcagcattgtactagaagttctagtgagtgcagtaagcgaagaaaaagaaataaaagttataagaattagaaaaaagaaggctgggcacggtggctcacgcctgtaatcccagcattttgggaggccgaggcaggcgtatcacctgaggtcaggtgtttcagacctacctggccaacatggtaaaacccagtctctactaaaaatagaaaaattagccgagcatggtggtgggcgcctgtagtcccagctactcgggaggctgaggcaggagaatcgcttgaacccgggaggcagacgttgcagtaagccattgcactccagcctgggcaacaagagggaaactccgtctcaaaaaaaaaaaaaagaattagaaaaaagaaataaaactgtgtttagagcgaaaaatgtgactgtgtttatagacaatgtaagacaaaatacagaaatattattacaattaataagtgagtttagcaatgttgctgggcataaaaatcaatatgtaaaaacaaattgtatctttaacagccatcattaaaaattaaaattaaaatatataatttacaacctcatgaaaacatataaagttcttagaagtggatataacaggctgggcacggtggctcatgcctgtaatcccagcactttgggaggccgaggcaggcggatcacgaggtgaggaggtcgagaccatcctggctagcacagtgaaaccccgtctctactaaaaaatagaaaaaattagccaggcgtggtggcgggcgcctgtggtcccagctactcgggaggctgaggcaggagaatggcgtgaacccgggaggtggagcttgcagtgagccgagattgcaccactgcactccagcctgggcgacagagcgagactccgtctcaaagaaaaaaaaaaaagaagaagaagtgaatataacaaaggagacgcaagaatttgattataaaatttacatgaaaatgaaaaaggccaagaataaaaacaaaacacagaaccccccctccccccaaaacaaagaaacaaacaaacaaaaagtcaagaatagccaaagcactcttgaagaacaaggtggggaaacttgtcttatcagatgtcaagacttagtaattaaggcagtggcatggaagaactgaatggagagctccggaacaaactcgtgtatatagacatttcatatataatagaactgacattttagatcagcgaagaaagtatatttttgaaagtacttttcaaaaatggctgagcgcagtggctcatgcctgtaatcccagcactttgagaggcccacgtgggtggatcacatgaggccaggaggtcaagaccagactggccagcacagcaaaaccctgtctctactaaaaatacaaaaattagccaggcatgatggcgcttgcctgtaatcccagctactcgggtggctaaggcatgagaatcacttgaacccaggaggtgaaggttgcagtgaagggagatcacaccactgtactccaacctgggtgacagagtgagaccctgtctcaaaaaaataaaaataaaaataaaaagtacttttcaaaaatgatgctggggcaattcgttttccatatttaaaagtagtaaattggataccatacatgaaaatcagctccaggtggattcaaaacataaatgtaaaatgcaaaaatataaaatttctagaagaaaatataaaagagtatcttgatatctgggtagtgatggatttctaaaacaagacataaaatgcataaatcataaaagaaatgactggtaatcagagtgcattaaaattaagaacttccatttatcagaaaacactattaagagactgaaaagacaagccataaacataagcaataaaagattagtataagattataaacagaaccctaagaatctaaaagcaaaagaaaaaccaatagaaagatagaccaaaaagtagaataggctcagaataggctcttttaaaaagagaaaactcaaatggccagcagttgaattaaaagatgctcaaactcattagtaatcagggaaatgcaaattaaaatcataatacgatagttttccacacttacttgaattataaaaacaaaaaagtctggaaaataccaagggttggtaagcatgtagaggaagtagaactctcattcataactctctgtagtatacatttaggtggtcacttcggaacgggtttggaattacacagcaaagtagaatatgtgcaaatctcaggaccctggaattttactcctgggtatataccttagagaaactgtagcatatgtgtgacatttgatcaacattgttccatcatcatatccatcagtagtaggatgaatgaatacattaatgtatattcattcatgcaatggcatattagatagcagtgtaagtgaaccgcaattacatgtacatgtatgaatctcaaaaacccaatgttgaaagaagcaaaccacagaagcatacatacacactgccaggtttcatttacaaaaagttcaaaaacaggaaaaactaaacaatatattgcttagggatgcaattatagttagtaaaaatataaagaaaaataacagaatgattaccccaaatttcaggatagtgattacatccggtggggtagaggaggggaagaagatagatgtgatcagggagggaaatacaaagagctttaagatactggagaaaaatagtctattttctttaatctgagtagtgaacacatagatacttattccttaaaattattctttaagttacatatgtatgttttatatactcttctgtgtatatttcaccattttagaaaagggaaaaaaaatcagtgcccagagctgaacacacaactctagtaaatctatcatactagaagacaatcatctccattcttttgagtgctctgcctctgtttattttgaaccaaagtgcacttttatacttgttaaattttctcttgctctatttggcccttcttttcacttgtccttccagccagtcaagttctccccaaagccatcatcatatatgtcaaccacagatcatcctccaggggaactggtatgctaaagtttctgagctagccaggctgaaatccaaatggcagccggcagatgtggcaacagtttgaaaagtgcactttgaaacagcttccttaccacacacgcttccctccctacttctcctgaagtaatctgtttacagacccagactaataatcttttttatgagaaactttagcaaatcttttatctaggaaggcaatgcttcacattaggtcatgttgataagatgatgagagagaatattttcatccaagaatgttgctatttcctgaagcagtaaaatccccacaggtaaaacccttgtggttctcatagatagggctggtctatctaagctgatagcacagttctgtccagagaaggaaggcagaataaacttattcattcccaggaactcttggggtaggtgtgtgtttttcacatcttaaaggctcacagaccctgcgctggacaaatgttccattcctgaaggacctctccagaatccggattgctgaatcttccctgttgcctagaagggctccaaaccacctcttgacaatgggaaactgggtggttaaccactggttttcagttttgtttctggtaagtgatgtttgacttcctattaattaggaaggattaaggagaaatcatgttttttaatatttgtaaagcaatttgaaagagaaagatgattccatgccgattattgggctcatcaagaccagttagttaaaaaatacaactrtgggtcagatgagaggacagaggcaaataacatgcaattgttcatgttgtcaaatcacaagtatttggaatttcaatctgttttcattttctgtcatctccctttctcttccatctcacttctaactactaccatgagtgctgatttctctctatctttcctatactggtcccatcaagatttcaaaaagtcactgaatgtttgagatgaaagtgatcttagagatcatctggcccagtactgaccactagaaatatagcaaaccacataatgtaattcctaaattttctaatacctacaccgaaaaggtaaaaataaacaggtgaagttaatatttaacaatataattcatttaacccaacatatcaacaaatcctttcagtatgtattcaatattgaaaatattaagaagctaatttacatatttttatttttactgagtctttcaaatctgatgtgtatatatacccacagcacatctcagtgaggactagccacatttcaagtgctcagcagccccatgtgggtagtggctgtggcattgcatagtgcagatgtaaaccaacttattgattgtacaaaggaaaataagacctagatgtcacacaatgaattgactgaattggcatcactcgaacccagctccccaatgacgttcaggccagaacccctttatcaccctttgtatgcacaatccctttctcctaacactctaacacctctctccactctcattcttccatttctgagccacagttgagcctggggctccctgtgtcctttctcactttcctagatcttcattcattactctttctcttttctcctgttttgcttttgggtcccacaggcaaaacagaagagagaaggtgtgatgcttctttttattcctgtctacccccccgccccccgaccaggtgctccagggaaaaatatgtggagtttccctggagggttgtttgttttacatttaacaaaagtgcttattttgtcaggttatcccatgacatattttaaatgctcaatgccttatattgagttccttttgcactataatggaaagaacactagtttaggagaaagggaacctggcaagtactttgaattctgctactaactgggtgatctcgatcaaattatttatcctctctagacttcaggtcctgtgggtgtgtaggtggggggaattgggcaggggaggggagcaggggattaataaagtgactagattagatacaaatataagggtgtttctagctctaaaatccacatttacctgcattttttccccctctcttattttttgctgggagagtttaccagctatgatggtgactcacatttaactctctagctttgaattttcatcccccaccaaaccagctggcaagcttagacttctcattatctctgacatatactcctatgcactgatttttaaataaaaaataaattacttaaaaatagttttattcctccttcctcccaggtcttgtagtttaccttctttgacgttcatagtggaggaaatgacagctaagatggggaatggaatgccttactcctagatatcactgtatttcatcatttgccttgcctacaattgatgatgggctgacacagttatttgcccctgtgtctctttgcgatccagaaatatttctgctccctctaaataaacttctctcctctgtcttccaaattcttgaggtgtctgtgactgttgactttcttttctttcaaagacgtttctctggaagacactcagctctggaaaagggtaactgagcaaaggaggcaggaagaaattgattggtaaagcaggttcggtggtgacacaactctgtagctagcacttattgatctcttactaagccccaagcattgcattaatcactttacacgcattatctgacgtaagcctcatagcattactataaagtaggtcctgttattatcctcattttgcaggtgaagaaattgaggtttagaaaatttaaatcatatgtctgtctgagattatagagctattaattggtgatgctacaacttgactccaatatcacactttaaatcactatattatagtactaaaggtgtgtgagtggtctagatctagggagtctgaataggccatgtcctaggctaaaggccctttgcctgttgtgctgagatggttctgactcatactgtggggcgagggatatatactagcgccctggagacctgtcgaattacagactagcacctccacacttgggctagagaccagttggttggtcctcaaggcaatgggcagtgagttccaaatttcacctttagccagtgcagagacagaacttggaacaggcaaaagcagtcttaagagctcaaaaaagtccaaaggaaaaatagattaatttgaaaaaagactcacaatctgaaaacagaaaaatgtgtgtcagggtgtaattaaaaaggcaggcccatctggaatggtttagttcttttcagttaggtattgttataggygctaaatttgttctttgtttcttcagatatccatttattcacttattgccatcttttaggtgcaacagtttgaatgctctagtccaagaaatggcaaatgtttctgtaaaaatctagatagtacatattttaggctttgcaagccatatggtctctgtcccaactactctactccgtcattgtatcacaaaaacagccataaacaatacaaaaatgagtagcagtggctaagttccaataccactttatttatggtcactgaaatttgaatttcatrtaactttcacatgccacaaaatattcttctttcgattttctcaaccattagcaaatttgaaaatataaaatataaaaaacaattctgagcttgcaggctgtggcaaaacaggtaatgggccatgggcctcagtttgctgaccctgctctagtctaatgcatgtctcaaagtgctaactcactctgaaagccagttagatactagcaggattgcactcatttaaaatgaaaacaggtaaacacaaaatagccaaaacggcgacactattgctatccctatcccttatttactccttcccatactcaaatttcactttattctttgcatgtttttttttctttctctaggttgtttggttagggctgaatgttttcctgtttgtggatgccttcctgaaatatgagaaggccgacaaatactactacacaagaaaaatccttggggtgagtatcacggttgtcacggatagaatctctattgttttccttatctctgattccagcttctttgtgacccaatgccctgatattctctagggctagggttgccagaaaaagtacagaatgcccaactgactttgagtttcagataaatgacaaattatttttttatgtaagtatgctccaaatactgtatgaaacacaggtatactaaaatatttattttaaaaagtctgaagttaaaatttagcttagcatcctgtatttttattaaataaatctgataaccccatctagggcacactacccagacccaataaaggaaacatgcaataaagaaaactattaggcagttgttttcaaactggtttccagaaactcaggtgttcctacagggtatgaggggaaggctaactgggcagtgctcctgctcctgctcctgcccctatttcttttttttttttttttacaaggaggaactggtaccattcttctgaaactatttcaatcaatagaaaaagagggaytcctccctaactcattttatgaggccagcatcattctgataccaaagcctggcagagacacaaccaaaaaagagaattttagaccaatatccttgatgaacattgatgcaaaaatcctcaataaaatactggcaaaccgaatccagcagcacatcaaaaagcttatccaccatgatcaagtgggcttcatccctgggatgcaaggctggttcaatatacacaaatcaataaatgtaatccagcatataaacagagccaaagacaaaaaccacatgattatctcaatagatgcagaaaaggcctttgacaaaattcaacaaccyttcatgctaaaaactctcaataaattaggtattgatgggacatatttcaaaataataagagctatctatgacaaacccacagccaatatcatactgaatgggcaaaaactggaagcattccctttgaaaactggcacaagacagggatgccctctctcaccgctcctattcaacatagtgttggaagttctggccagggcaattaggcaggagaaggaaataaagggtattcaattaggaaaagaggaagtcaaattgtccctgtttgcagatgacatgattgtatatctagaaaaccccatcgtctcagcccaaaatctccttaagctaataagcaacttcagcaaagtctcaggatacaaaatcaatgtacagaaatcacaagcattcttatacaccaacaacagacaaacagagagccaaatcatgagtgaactcccattcacaattgcttcaaagagaataaaatacctaggaatccaacttacaagggatgtgaaggacctcttcaaggagaactacaaaccgctgctcaaggaaataaaagagkatacaaacaaatggaagaacattccatactcatggataggaagaatcaatatcgtgaaaatggccatactgcccaaggtaatttacagattcaatgccatccccatcaagctaccaatgcctttcttcacagaattggaaaaaactacttcaaagttcatatggaaccaaaaaagagcccgcatcgccaagtcaatcctaagccaaaagaacaaagctggaggcatcacactacctcacttcaaactatactacaaggctacagtaaccaaaacagcatggtactggtaccaaaacagagatatatatcaatggaacagaacagagccctcagaaataatgccgcatatctacaactatctgatctttgacaaacctgagaaaaacaagcaatggggaaaggattccctatttaataaatggtgctgggaaaactggctagccatatgtagaaagctgcaactggatcccttccttacaccttatacaaaaatcaattcaagatggattaatgctcctgcccctatttcaaccaaagcagactatatctatctatgaacacctgcttacaattttaagaaagagtttggtttttttttaaaaaaaaggaaagtaaaaaagaaaaaacaaacacaacttgaaaacactgctgtcatggaaacatacctctctatcaaataggagggatacttaggggagtctcatgggtgctacagaattcaaggcctgcagaaaggagggctcaggtcaaggttacagaacctgagaagcttggggaagtggcagatcaaaaacagaagagggagggagggagtgggtagggcacaggggtgtggaggtgaccaggaggaagcacggagttgaggatggttctctcacaggctgatgaacccggatgctgcctggttagaagagcatatttgactgctacctctagtctattatgcaataacagatagaggattttaaatcactttcatcttgacagtgtcattttttcagtagcttttggtatcttcccaatgtacatgtttaaagacagcttgtccttttaaaaaatgcttttttctctctccataatcaaagaatccatgttgagatcacaactaatttgaacgttctgttcatggtttatttcaccctgctgttttccattttaaatgttcatccttgatccttctttagaaactataactccaaaggaggtattaatttgctttaaaaatagctttttactaagagaatgatgcaataaatgtgactagttattaacagcttgattactacatgaccaaaatgtcagcagcacaaaaataaattatgctgatgtcccatggacatttttttttcaaaattatttaaaaattgtttacatatgtagggggtataagtgcaggtctctttctttccttctttcttttttctctttcttcctttctttattcttccttccttttctttctctttcttctctctctctttctttccttccttccttccttctttccttctctctttctctytttcttcttttcttttccttccttccttccttctttctttctttgttttcattctttttattttgagacagggtctttctctgttacccaggctggcatgcagtggcatgatcatggttcactgcagcctcgactctcccaggcttcagctatcttcccacctcagcctcctgattagctgggaccacaggtgtgcgccaccaagcctggctaattaatatgccataatttatttaaacattccacagtcattaaaacatttaccatcactgcataactgcatagagctctcagccttttaagagaataacaattcattgcattgatatgccataatttatttaaacattccacaggttatttcttaaattcatgctcaccttgggaaaatacagggaacaatttgattcactatgaagtagagcagataagcagcagaggaagaagtttaaatccataatttaaaaacatttttttgccaggcgctgtggctcacgcctgtaatcccagcactttgggaggccgaggcgggcggatcacgaggtcrggaratcgagaccmcggtgaaaccccatctctactaaaaatacaaaaaattagccaggcgtggtggcgggcscctgtagtcccagctactcgggagactgaggcagaagaatggcgtgaacccagaaggcggagcttgcagtgagccgagatcgcgccactgcacyccagcctgggcgacagagccagactctgtctcaaaaataaatacataaataaataaatactttttttttgtagacatgaggtctccgtgttgctcaggctagtctcaaaactcctgggctcaagtaatattcccacctcggcctcccaaaggccgggtattacaggtgtgagcgaccatgcccagtcacaagtgtaggtttcttacatgcatatattgcatagtgatgaagtctgggtttttagttacctatcacctgaatagtgaacattgtacccagtgggtcatttttcaaccctcactcccctcccaccctcccacattttgtagtctccaatatccattattccactctgtaggacatttcattttttaaatccctattttaaaaccttaattatcaataatgctgcttccaatgagatcaaagcacatattagtttggtgcaaaaattattgctattaaaactgtttgcaaaaaccgcaattacttttgcaccaagcgaatagaagtgtataagtaaaatgtgaaaatctccctcccatcctactccccagagatacacacacacacacacacacacacacacacacagggacacacacactgacataagctcacaaatgtatcagacacgtaggttttgtttttgaggtgggtactatcgtttattcactttttcattttcatatagtaaaatttgctgttttttggtatacagttctatgagtttgggtaaacacatataataagacacacagctttttgttttaaccaaaaaagggatcactttgtagatattggctggaaattgcttatgttaatatatctcagatatctttctttcttttttttttttttgagatggagtctcactctgtcgcccagcctggagtgcagtggcgcaatctctgctcactgcaacctccacctcctgggatcaagcgattttcctgcctcagtctcccaagtagcaggggttacatgtgcgaactttcatggctggctaattttttgtatttttagtagagacggggtttcaccatgttggccaggctgatctcaaactcctgacctcaagtgatccacccgctttggtctcccaaagtgctaggattacaggcgtaagccactgctcccagcctcagatatctttccatgtgagtgcctaaccagtggtgtgctgaaaccagctcataccaggttgcaatgccagttgcgtgcatctcttcccaactctgcattcagtggtgttcaatgacatcaagttagtgtcttgaaatctggcatggtgggagtatttacatcatcaaaattggcaaatgctggaaatcaggaatccccttcctcccaaaaagctagtcattaaaacatttaccatcactgcatcactgcatagagctctcagccttttaagagaataacaattcattgcattgatatgccataatttattgaaacattccacaggttatttcttaaattcatgctctgctcaccttgggaaaatacagataacaatttgattcgctatgaagtagagcagataagcagcagaggaagaagtttaaatccayagtcaattatgcattaatgacagcaggagttcaattataacaccagtgagtggagatctagagaaatgaacatacattggcatatttaaatgtgctgcaacgaggaaaaaatgttttctctaaaaagaattcatcctatacagatagccaccacagaatatggaactgtgaaattatagtcctatattttcaattcacttgccaattttagctttaagaaatctctgtgattcaaataagcaagtagtgggaaccaatgtggaaatgcaggatctctgagatgagcagaggaaatttactcagaagtggaacaggctgtctgtaccaaaaacagtcagggtgtgagtcagcagagggagaaaacacaggtcatgtggaaaagccagaaatggaaaacagtagggcagcttttgttcaccacattgcctgacattcttagccattatagatactaggcagatcttgtcctggcttattaaactaacatcacatgttcctgggtttacgatataaggaaaaatcaattttgtgcttcatagataattacaaaaaggccaagaaattgttaaccttaacccatacccctccttttagaaagtctttgacaggcacacaatgtaaggctggccagtcagcagaagtgcaacaaaaattgcctggctgctgctgtcagctcctctgctacaacattgtcacactccatagcagtcccaagttcatgaagtagactcagagaccggttgtacagagttgaggagagaagtcagatttagctgccatggagttaagcatattctgtccagcttatacctagtaaggcctgttttttggggctaaatgcttctttgaagcattgattccttgtctcctttgctagcagcttctactgctggatcaggttgttcttgatttatgctgcctggccacccaaggaaatcagcttaaaattttgctcctctgaagttctcccttctcaaatatctacctgtttaaaaattttgctccaagaggtttgctagtcttgactaaatttattcaatttttaaagacatcttaaatagaattggttaaaaattttaagtgtttttattatacaactcttatgtgcttataactgcaatattagaaaatacagaaaagaataaaataccatctgtaattgtacctctaagtatgagctttatttaaaatgcaaataaaggtatatatgatccttggccaggcatggtggctcacatctgtaatcccagcactttgggaggccaaagcaggcagatctcttgagctcaggagttccagaccagcctgggcaacatggcaaaaccctgtctctaccaaaaatacaaaaattggctgggtatggtggtgcacgcctgtagtcccasctactcaggaggctgaggygggaggatggcttgagcccaggaggcagaggatgcagtgagccgatatctcgccactgcactccagcctgggcaatagtgccagaccttgtctcaaaaagaaaaatctatatctatatctatatctatatctatatctgatccttaggactcttttacaagtgacaaataacaaaattataataaagagtattaagtaaaatgttacagccatagaatgttttgctaacatgtaatcattaaatcctattctctttcatgttaataaatgtagtcaaacatttccaaactactgtcatgggaatttctcaactcaatattaaattcagtatgttttatgtattttgcaaacagagcctggcctgatggtgttagctactgagagagaggagaggcagctgtagccctgttcatttgcaggcctcagatgagtgggctgggtcagttgctcacgtgctagatggtgaaatgaagcagctgatggtctctttttctcctctgctgtagtcaacattggcctgtgcccgagcgtctgctctctgcttgaattttaacagcacgctgatcctgcttcctgtgtgtcgcaatctgctgtccttcctgaggggcacctgctcagtgagtcccaaccactcctaagtcaactttcacattaaagaaggagaccccagactcctcagtaggacagtccaacaccatgctcctaggaatggaagctagaagtctcctttggtagctaagggggtgggttagtgcgggtgagtattggcatgctatatgcaagacatattggttatgggttagtgaatttaataaagctggctggcgacatctgaccatgatcattctacatttgtagttttgcagccgcacactgagaaagcaattggatcacaacctcaccttccacaagctggtggcctatatgatctgcctacatacaggtaactcaggcaatccatgaatctgcagactccagggcattcagaatcttgcttcattcatccatccatatgcacattcaaaaaatatttatcgagcactgggcactatttgtcaggcactgttcttggcctgttttcatggagcttaagttctattcctttgggaacagagtaaatataaaaaagatctctccgcaatcgagggtttattgggcaccttctgtgcactcagcattctgctaagcactataatgtaggattcttctagtctagtggggcacacctgccatgatgttgctgagatgcctcttaacatttcttttcatctttccatttagctattcacatcattgcacacctgtttaactttgactgctatagcagaagccgacaggccacagatggctcccttgcctccattctctccagcctatctcatgatgagaaaaaggggggttcttggctaaatcccatccagtcccgaaacacggtgagttgactttctagcaaagcatctgagatctggtcatgagcaggaagtgcacaggtggacattgtgtcaggstgacatttctcctttcacagacagtggagtatgtgacattcaccagcattgctggtctcactggagtgatcatgacaatagccttgattctcatggtaacttcagctactgagttcatccggaggagttattttgaagtcttctggtatactcaccacctttttatcttctatatccttggcttagggattcacggcattgggtaagatcctcgaaccctcattctcatgccccagcccctgaccttgcataattctttgtcccaaaccatccttctttgtctatttcagtggaattgtccggggtcaaacagaggagagcatgaatgagagtcatcctcrcaagtgtgcagagtcttttgagatgtgggatgatcgtgactcycactgtaggcgccctaagtttgaagggcatccccctgaggtaagagccctacgggcaaggacagactcttgttaggagctgttactgttattattcttattattactcttattgttattatcatcattattattagttcagtcctgtgctgggtcttatgaaggatrtctatggggttcctacctttaagaaacttccagtatcactggcaacaggcaattacaaggggatcttgaagagaaaaaactaatagttcttgcatgttgtgagaccctctgcaaaggtaataatgatagcccacattattaattgtgtttatcatctgccagccttgctgcataatatggattatttcatttatatatagcaatagcctatgagatattacttcttttttgtctaaattttgaaacaaaaggacaggattccaagagattaagtaaactgacaagctcttacagtaagtagtggagcttgaatacaaacccaggccttttggattccaaaggtttgaactcttgaccactatactgtcccaaagctcagccgtgatattccagtcaaattctggggggaaataaagcattcttgaagtgggctttctttggtgttctaagaatatgcttggaaatttttgttagatactgggtgattatgaaactgtgttctagggaactcaaggtgtgccccagggtaattcttgcggatattattatttacctttgcttgctcacaaaataggttatattgaggagtaaatggaaggggaaggttgatttgtggtgcctcagagtattctgagaatgattaaggtctttaaatcagattcaggattaagagcaatagcttagttctcatctggaacaggaaaaatatataaaacaaaaagtcttctaaagttggcattttaattcagcaggaaaaggataaatgaataatttttagcacaataagatcatcatctgggaaaaaagctatatcttcatttcacgccttgcactaaaatatgaatcgaggatacatgaagcaaaaaaaccataaaagcaccttaagaccacgtgggaagtttttttctaatactgaagtggaggaacatgtttctaaataagataaaccaccctgaagccataaaagaagagataattttgcatggcaaaagaaatccccatcgggccgggcacggtggctcacacctgtaatcccagcaatttgggaggctgaggtgggtggattgcttgagcccaggagtttgagaccagcctgggcaacayggcaaaaccckatctctacaaaaaatacaaaaattagttgggcatggtggtgtggagggtgaggtgaaaggattacttgagcctgggaggctgaggctgcagtgagctgtaatcatgccactgcactccagcctgggtgacagtgagatcctgtgtcaaaataaacaaacaaataaacaaaaattcccattgtaaataaagatagacaaaaaattaccaagtaggaaaagtatttacaactcacagggcatggactaattttctaatatataaataactcctagaaatcaataagaaaaagcctaataacatgataaaaagagaaacagaagatgtgaacagaataatctcagaaatggagatatatccttatcttaaatatatgaaatgatgcttaatgttattcataatggaaaaaaatgccaaataaaactacaagaatctgttaacctaacagattagcaaagattaaaaaacctgctaatgtatggtgctggcaagtgtggaaaaatgctcttatgcattgctggtgagagtgtaaacctatacaactgcttgtagagagtgatttggcagtagcaattaaggtttaaaactcgacttccaatttattccacaaatatacttaaatatgtgttaaattacatgcattaagttattcattacagcattgttgaatagaaaaaaagactggaaacaagtgtccatcagtggggaactagttacattttgggactttcatgcagtggaatagtctgcaaccagtaaaacgaaagagacagtaccatagacactaatagggaccagtctctaagatgttaaatgcaaaaggcagggcagtgtgtagagtctcctatcatttgcattgaaaagatcatttaaatgcatgttctccagaagaattcacaaaataataacattacctctggggatctggaggggyaggaggatttgctttttactattgtactgttgtactttcagattttgtaccatatacatatattacctatttagaaagtaattttctaataagatagatagaatgctagctacacaaataaagaatagaccactagctacactaataaagaaaaaagagagacaatccaaaaaacacaatcagaaatggcaaagaggacattaygactgaccgcacagaaattaaaaaaaaaaaaaccctcagagactactatgaacatctctatgcacacaaactaaaaaaaaaaacaacctagaagaaatggataaattcctggacacatacaacctcgcaagaccagaccacgaagaaatttaatccctgagcagaccaatattgagttccaaaactgaatcagtaataaaaaagcctacaactaaaaaatgcccaggaccagatagattcacagccaaattcttccagatgtacaaagaagatctggtaccattcctactgaaactattgcaaaaaaattgaggaggagggtctccttcctaactcactctatgaggccagcatcatcctgataccaaaacgtggcagagatacaacgaaaaaagaaaacttcaggccaatatccctgatgatcattcattgatgaaaaaatcctcgacaaaatactggcaaactgaatccagcagcacatcaaaaagctaatccaccacgatcaagtaggctttatccctgggatgcaagtttggttcaacatatgcaaatcaataaatgtgattcatcacrtaaagagaactaaagacaaaaatcatatgatcatctcagtagatacacaaaaggctttcaataaaattcaacattccttcatatgaaaaactctcagcaaactaggcattgctggaacatatttcaaaataacaagagccatctatgacaaacccacagccaacatcatactgaatgggcaaaagctggaggcattccccttgaaaactggaaaaagacaaggatgcattctcttaccactcctatttaacatcgtgctggaagtcctgtccagagcaatcaggcaggagaaagaaataaaaggcatccaaataggaagacaaaaagtcaaactatccctgtttgcagacaatatgattctatacctagaaaaccccatagtctatgtccaaaagctcctagatctgataaacagcttcagcaaagtttcaggatacaaaatcaatatacaaaaatcagtagcattgctataccccaacaacacccaagctgagagccaaatcaagaatgcaatcccattcacaatagccacaaaaaaaataaaatacctaggaatacagccaactagggaggtgaaagatctctacaatgagagttacaaaacactgctcaaagaaattagagatgacacaaacaaatggaaaaacattccatactaatggataggaagaatcaatatcattaaaatggccctactgcccaaatcaatttacagattcaacactattcctaccaaactaccaatgacattcttcacagaataagaaaaaaaaactatttcaaaattcatatgaaaccaaaaaagagcccaaatagccaaggcaatcctaagcaaaaagaacaaagctggaggcatcatgttacccaacttcaaactatacaaggctacagcaaccaaaacagcatagtactggtataaaaacagacacacagactgatggaacagaatagagagcccagaaataatgttgcatatccatgaccatgtgatctttaacaaagtcaacaaaaataagcaatggggaaaggactctgttcaataggtggtgctgggataaccggctagccatatgaagaagattgaaactggactctttccttacaccatatacaaaaaccaactcaaaatggattaaagacttaaatgtaaaaccccaaactataaacaccgtagaagacaaccaccctggaagacaacctaggcaataccattcaggacataggccctggcaaagatttcatgatgaagataccaaaagcaaatgcaacaaaaatgaaaattgatgaatgggatctaattaaactaaagagcttctgcacagcaaaagcaactaccaagagagtaaacaaacaacctacagaatgggagaaaatatttgcaaactacacatccgacaaaggtctaatatctagcatctataaggaacctaaacaaattaacaacaacaacaaaaaaacacaaattatcccataacaaagtgtgcaaagtctcaaaaaaaaaaaaaagtgggcaaaggacataaagaaacacttttcaaaagaagacacacacrcagccaacaagcatatgaaaaaatgctcaacatcgccgatcattagagaaatgcaaatccaaaccacaatgacacaccatctcacgccagtcagaatggctattattaaaaagtcaaaaaataacagatgttggtgaggttgcaaggaaaagggagcacttatacagtgctggtggaaatgtaaattagttcagccattgtggaaagcagtgtggtaattcctcaaagaattgaaaacagattaccgtttgacctagcaatcccattactgagtatatacccaaaggaatataaatcattctatgacaaagacacatgcacttgtgtgttcattgcagcactattcaaaactgcagacatggaatccacctaaatgcccatcaatggtagactggataaagaaaatgtggtacatatataccatggaatactacgcagccataaaaaataacaagatcatgtcctttgcagcaagatggatggagctggaggccattatcctaagcaaactaatgtagaaacagaaaaccaaatatcacatgttctcatttataagtgatagctaaacattgagtacatatgcacacaaagaagggaataacacactggggcctacttgagaatggagaaagggtggagagagaggatcaaaaaactatctaatgggtagtaggcttattacctaggtgatgaaataatctgtacaccaaacccctgtgacatgtagtttacctgcaaactgcacatgtacctctgaacctaaaatagaagttaaaaaaaaaagtaattttgggtggggcacagtggctcatgcctgtaatcccagcactttgggaggctgaggcaggaggattgcttgagctcaagagttcgagaccaatctgagcaacataggaagaccttgtctctacagaatattaaaaaattagccgggcatggtggtgcacgactctggttccagctacatgggaggctgagatgggaggatcacttgagcccaggagattgaggctgcagtgagctgtgatggcaccaccgcactccagcctggttgacagagaaagaccccatctcaaaaaaaaaaagtaattttggaaggacatacctgggatatgttaatagcacatttcatttctaaagtcagaggaaattataagatcataaccagggatctgtattagcggactagtagacaagaggaccttaaagatagggagctattgcctttccgcccgtgtacgccactgaagaagcatcgttaaagtctctcttctcccttccatcttgtctaagtcagagtctcctaaagagctcaaacagctgaggaagctcttcattggagatttgagctttgaaacaactgacgagagcctgaggagccattatgagtgatggggaatgctcacagactgtgtggtaatgagagatccaaacaccaagcgctccaggggctgtgggtttgtcacatacgccactgtggaggaggtggatgcagccacgaacgcaaggccacacaaggtggatggaaaagttgtggaaccaaagagaactgtctcaagagaagattctcaaagaccaggtgcccacttaactgtgaaaaagatatttgttggtggcattaaagaagacacggaagaacatcacctaagagattactttgaacagtttggaaaaatggaagtgattgaaatcatgactgaggcagtggcaagaaaaggggctttgcctttgtaacttttgacgaccatgactccgtggataagattgtcattccgaaataccatactgtgaatggccacaactgtgaagttaggaaagccctgtcaaagcaagagatggctagtgcttcatccagccaaagaggtcgaagtggtcgtggaggtggttttggtgggaatgaaaactttggttgtggaggaaacttcagtggtcatggtggctttggtggcagccatgatggtggtggatatggtggcagtggggatggctataatggatttggtaatgatggtggttatccaggaggcggccctggttactctggaggaagcagaggctatggaagtggtggacagggttgtggaaatcaggacagtggctatggcaggagtggcagctatgacagctgtaacaagggaggcagaggcggctttggcagtggtagtggaagcaattttggaggtggtggaagctacaatgattttggcaattacaacaatcagtattcaaattttggacccatgaagggaggaaactttggggcagacgctctggcccctagggtgatggaggccaatactttgccaaaccaccaaaccacagtggctatggcggttccagtagcagcagtagctatggcagtggcagaagatgttaattgggaatcaaagcttagcaggagaggagagccagagaagtgacagagaagctacaggttacaacagattcatgaactcagccaaacacagtggtgrcagggcctagctgccacaaagaagacatgttttatacaaatactcatgtttatgggcaaaaaagtcaaggactgtatttgtgactaattgtataacaggttattttagtttctgttctatggaaagtgtaaagcattccaacaaagggttttaatgtagattttttttgcacccatgcaaaaaattgctatatgtgatagtctgatcatgacrctgaataaatgtctttttttttttaatgtgctgtgtaaagttagtctacwctgaagccatcttggtaaatttccccaacagtgtgaagttagcattccttcagggtgatgccaggttctatttggaatttatatacaacctgcttggrtggagaagccattgtcttcagaaaccttggtgtaattgaattgatagttactgttgtgacctgaagttcaccattaaaagggactacccaagcaaaatcatggaattattggttataaaaataattgttggcacatcctatgcaatatatctacgttgaataatggtaccagataaaattatagatgggaatgaagcttgtgtatcatccattatcatgtgtaatcaataaacaatttaattctcttgaaaaaaaagatagggagctatttaaagattattaggaaagcttactagctaagatggttaataccttgtcttatcttgcacatcagcttctgtctttttctcatctattacctgagttaagttatagttggtctatttggtatccttaaaacttaggggttgctttggttggtcgtgtaatactctaagagagagaayaccagttttgccacctgaatgtattgctttgtttcttccataaacatttaaaaaatactctctccatattcaccccatttaaaaattagaaaaataatatacatttattgtagaaagtttggaaaatacaaaaaatactagaagtaaataaaaaatttcatagagttctaccacctagaggaaataatgtttttccttgattgatataatggatgctttcctttgaaacatttttttttgttttgagacagtctccctctgttactcaggctagagtgcagtggtgtgatcttgtctcactgcaacctctgcctcctgggttcaagtgattctcctgcctcagcytcccaagtagctgggactacaggcgcgcaccaccacgccctgctaatttttgtatatttagtagagacggggttttgccacgttgaccagactggtctcgaactcctgacctcaggtgatccacctgccttggcttcccaaagtgttgggattacaggcgtgagccaccgcacccggccttgaaacatttgttttaaaatagttggccaggagtggtggctcatgcctrtaatcccagcactttgggaggctgaggcaggtggatcattcgaggccagcagttccagaccagcctggccagcatggtgaatctccatctctactgaaaatgcaaaaattcgccaggtgtggtggtgcatgcctgtagttttagctaattgggaggctgaggcaggtggatcattcgaggccagcagttccagaccagcctggccagcatggtgaatccccatctctactgaaaatgcaaaaattcgccaggtgtggtggtgcatgcctgtagttttagctacttgggaggctgaagcaggagagttgcttgaacccgggaggcgggggttgcagtgagccgagactgtgtgactgcacggagtgagactctgtcaaaaaaaaaaaagaaagaaagaaaggaaggacgcaaggaagaaagcaaggaaggaaggaaggaagaaaagaaagaaagaaagaaagaaagaaagaaagaaagagaaagagagagaaagaaagaaagaaagaaagaaagaaagaaagaaagaaagaaagaragaaagaaagraaggaargaaggaaggaaggaaagaaagaaaaagaaagaaagagaaagagaaggaaaatatgtgtatggtatatataccattttaatcatttcttaaagtaaacattgtggccattactttactcgtgcataatactttttcacaccttaattatttatcttcatttcccagaagtgaagttccagggtaaaagagaaggaatgcttttgaggctattgagacatactgctcaactgctctctgggaagatgttgccaatttgcattttcacccctgtgaaatgcatgttcaatttgcatgcccacgtgaacactcccatttccctgaatcccagttaatgctgggcattattaattaaaattgtttttcaatttgagagactaaaatggtatcttgttttaatatttattactctgactatttctgaggccaatatttttttcacattgttattatccatttcttaaatatgtttttcctcaaattgagctggggaattttcttcaaataagaaatagcactgaattgcataatgttcactctgtttgatttgtcccatctctgcctcttccttccctagagatactcaaggaagttatttgcttgcaccagcttaagaaacctcacttcacacagtcccaatgtatcacacttgagcaactgtgcaagaaaggacataatttagtattgctaggaagtatatttttagtagttcctgtgcaggtagaagcaaactgctgctttgcaaagatctcagggatagaaaagctgctttatttatttatttattttatttattttgagacggagtctcrctctgtcacccaggctggaatgcagtggcgcgacctgggctcactgcgacctcctgggttcgagtgattctccttcctcagtctcccgagtgtctgggattacaggcrcccaccaccacactyggctaatttttgtatttttagcagagatggggtttcrccrtgttggccaggctggtctygaactcctgatctcaagtgatccacccgccttggcttcccaaggtgctgggattacaggcgtgagccactgcgcctggccaaaaagctgcctttaaaaaaaatgtagacaaggtaaaaaagatattactatgttaaatgtttaagcacttgagaaaggaggtgatggataagtactgagttttatgtaccagtagcatcagtcacatactttcccttttttgtgtttgttttgtttttaatcatctgcctctatttcacatctactttctctgttggttttttagattggacaagctgtcctcgaagacagtcttagattcttaaaattaaatcttatttwatttttttggagacagtgtcttgctctgttgcccaggctggagtgcagtggtgygatctcagctcactgcaacctctgctgcctcctgggttcaagcgattcttatgcctcagcatcccatgtggctggaattacaagcatgcaccaccacgcgcagctaattttttgtatttttagtagagacagggtttcgctatgttgcccaggctaggtctccaactcctgagatcaggcagtctgcccgcctcggcctcctaaagtgctaggatgagccactgtgccaggccttaaaattaaattttatatgtaatttaagaataagaatatttaccatgtgttccatttctgtgcttttctcctgcttcttggtcagacttgtaaattttcaggaaatggtctgttttatgaataacagattagcaaacgaaaccattgtcctttattttttctatttccatcttccagatttggtgaaattagtagcttaaaaatgatacacattggagaactcagtaaagaatgaaggatgaactgctacacaaataagtcctaaacaagaaattagtgtgtaatctcattcttaaccctgtctctgtgcagtcttggaagtggatccttgcaccggtcattctttatatctgtgaaaggatcctccggttttaccgctcccagcagaaggttgtgattaccaaggtaaagaatatgcactttcctcttgctgtgataagagttatcttctaccggactacagaactaaatttttatgttgtcaccctgaaagaggaacttggaaactgggcacagtgggtggtagtcccagcactttgggaggccaaggagggcagatctgttgaggtcaggagttcgagaccagcccggccaacatggcgaaaccccatctctaataaaaaaaaaaaaattagctgagcgtggtggtgcccacctgtaattccagctacttgggaggctgaggcgggaraatcgcttgaacccgggaggcagaggttgcagtgagttgaaatagcgccactacactccagcctgggtgacagagagaggctctgtctcaaaaaaaaaagaagaagaacttgggtttggcatacctcagttcctccagcactggacagaactgggaaagaggggcttggccgaaatcatcaggatgagtctatatcagaggttgcaaacaggcagcctgggccagagctagttcacagctatattttgtttggtgcacacaatgtttgtttataaagttgaattggttgccaacatttaaaaatctggatggaagctttcgtttgattttttaaaagctatttcttgcttctcttgaagaatcaggaaacctgataacactgtcatggttccatatcgcaaccactgtctggagctaagtagctgctgccctctttagagaggacttgtgtttgtagttcaccactgtcaccagccctccagcttcactcatttgctttatctgcctgtccctgtcgycattagagtttgctttctttggtctatgtgcttcattcacaggttgttatgcacccatccaaagttttggaattgcagatgaacaagcrtggcttcagcatggaagtggggcagtatatctttgttaattgcccctcaatctctctcctggaatggcatccttttactttgacctctgctccagaggaagatttcttctccattcatatccgagcagcagggractggacagaaaatctcataagggctttcgaacaacaatattcaccaattcccaggtaggtccttgagaccaggagagtcccagaccaggatgcagactggcagaaaagagaaagcaattcttcgttgaatcttaagtttggtacaatagaataggattataataaatatgcagaagtcagccatgrgaacaactatatttctgggaggatgtttgaggttggaggtggaggggagtcttcagttgcccgttatcttctgtcttctgccaggattgaagtggatggtccctttggcacagccagtgaggatgttttccagtatgaagtggctgtgctggttggagcaggaattggggtcaccccctttgcttctatcttgaaatccatctggtacaaattccagtgtgcagaccacaacctcaaaacaaaaaaggtataatcccgtatatcacttttcttctggcctgagtctgacaagtctattgccttcttgggctaagctctttacaattgataagggagcaacctatccctggagttatgagaataagtgatcacttctcttggccaggacatycacttctacagatttatcataagaacagggtcttcttttcaatttggagtttaagatcaccctgaccaaagatgttggaaggctcgttcctaaggaaaattgtcagaactctgaacattcctgctgcctaaagtttgcggctctataaatgtgacttttaaggtcacctaataaggctatgttctctcttgctgatttcagatctatttctactggatctgcagggagacaggtgccttttcctggttcaacaacctgttgacttccctggaacaggagatggaggaattaggcaaagtgggttttctaaactaccgtctcttcctcaccggatgggacagcaatattgtgagtccaaataacacactaattcccctactaaacataagacgaatgtcagacaaaggatagtgcatatggattagaagttatttcttatgatttcctacctgccctcacactcacacacaagtttaaaagtggtggaaagaagaggcagctatcaggacttggtttttcttttctttctttcttcttcttttttttctttttgagacagagtttcactcttgttgcacaggctggagtgcaatggtgcgatcttggctcaccacaacctctgcctcctgggtttaagcaattctcctgccttagcctcccgagtaactgggattacaggcatgcgccaccatgcccagctaattttgaatttttagtagagatgggggtctcaccaygttggtcaggctagtctcgaactcctgacctcaggtgatccacccmcctcggcctcccaaagtattgggattacaggcgtgagccaygcacccagcctaggacttggtttttctaacttttattcctctgaatccaggttggtcatgcagcattaaactttgacaaggccactgacatcgtgacaggtctgaaacagaaaacctcctttgggagaccaatgtgggacaatgagttttctacaatagctacctcccaccccaagtaagtatattttcctctagtaagatgagtttacaggggccgtgcgtggtggcttactgcctgtaatctcagcactttgggaggccgaagtgggtggatcacctgaggtcaggagttcgagaccagtctggccaacttggcaaaaccccgtcactactaaaaatacaaaaattagctaggcgtggtggcrcatgcctgtaatcccagctacttgggaggctgaggcaaggagaatygcttgaacctgggaggcagaggttgcaatgagctgagatagcgccattgcactccagcctgggcaacaagagagaaactctgtctcaaaagaaaaaaaaaaagatgagtgcggagttaggatttaggaaaggtattacaacatgttgaacactcttaagaaaagatctctggggcagaaatcttttgtgccattcttagattcttggtgaagaccgaggaaatttcatctggggttttagaaaaatagggtcatgatcttgaaaatgatgaaaagaggtttttttgccccagcaaactccattcaaacagtgaggcaagtggacccacttctgatctatactaccaaacaaactagagaactggagcaattcaaatgcatttttgcggggaggggactcaataatctctacttaaagtaacaaaggtattatctagtttactggccacctgagctcaatctttctggagggttttgagacatgttacagcacaaaaaatcctggtgctatgaaatcagccattccaatgggaaggagatgaagctgagattccctgaacaagtagggaggtgatgatcaattcaatgctacaaatattcttgattacctttttttttttttttttttgagatggagtttcgctcttgtcgcccaggctggagtgcagtggtgcgatctctgcttgctgcaatctccgaatcccgggttcaagcgattctcctgcctcagcctcccatgtagctgggattacaggtgcccaccaccatgcccagctaatttgttgtatttttagtagagatggtgtttcaccacgttggtcaggctaatctcgaactcctgacctcaggtgatccacctgcctcagcccccaaaagtgctgagattacaggcatgatccaccaagccccgccttggttaccttttataagctcagctctcaccattctagaagctttggaggttgaaagagaaataggatatggttcttgcccacaaggaacatacatttgaataagagatgcacacaatcacctcaaagcagaataatgcactccgtgaaagaggttcacggatgctggagggaagaaaagtctacggccacatggggtgattaggaaaggcttcaggaaggcagtggctagagcacttagtgacttggattcagatgatcctgggtcctcatgctggttctctctttttttcttgagacacagtcttgctttgtcacccaggctggagtgcaatggtgccatctcggctcactgcaacctccacctcctgggttcaagcagttctcctgcctcagcctcccgagtagctgggattacaggcatccaccaccacatccagctaattttttgtatttttagtagagatggggtttcgccatattggccaggctggtctcgaactcctgacctcaggtgattcactcacctcagcctcccaaagtgctgggattacagcatgagccaccatgcccggcccttattctggttctgacactttctagttatgagaccttgaacttctgaactctctgatcttgattcctcatctgtaagacaagggtcatattagtgaatgcctgctctactcacttgcagggttgttatgacaattaagtgagacaatatatgaaaaaatgctttgtaaattttaaagcagcatataagcataaaagatgctaattatcatgttgaatgtaactgaagttttgagagagtatgaggttgtcaggagagagagagagagggagggagagagagagactagcgagggacagagtaccaaggaatgctgcctaggttatatgggaagggaaaaagacaaaccagggaagaaataggagtacacagagaagtggtgtcacagaacccaagggagcaaatattagagaagcgtggtcaatagtgttggaagagtagcagggtcaggaaatgttcatttagcttaagcatatttatagacagaacaaggaccagtacataaaataaaataaatacatgaaagaggggagaggactaagatggccataataaaagatggacaatagtattggcaaggaagtggagaagttgcaatcctagtacattgcttgtggaaatgtgaaatgataccacactcggggaaaactctttggcagttcctcaaagtgttaaacacagtttccagctgggcatggtggctcgcgcctgtaatcccagcactttgggaggccaaggcagrtggatcacraggtcaggagttcragaccagcctggccaacatagtgaamcctygtctctactaaaaatacaaaaaattaggccgggcgtggtggctcatgcctgtaatcccagcactttgggaggccgaggtgggtggatcacgaggtcaggagatcgagaccatcctggctaacacggtgaaaccctgtctytactaaacatacaaaaaaaaattagccgggtgcggtggcgggcgcctgtagtcccagctacttgggaagctgaggcaggagagtggcgtgaacccaggaggcagagcttgcagtgagccaagatcgtgccactgcgctccagcctgggcgacagcgagattccattaaaaaaaaaaaaggtgaaaagaattagctgggcatggtggcgggcacctgtaatcccagctactagggaggctgaggcaggagaatcgcttgaacccrggaggtggaggttgcagtgaccccagatcataccattgtactccagcccgggtgacagtgcaagactctgtctcaaaaaaaaaaaaaaaaaaaaaacacatagtttccatatgacccagcaatcccactccttgttatacacccaagagaaatgaaaatatatgtctacacaaaaacttgtacatgatgtacatagcagcattactcataatagccccgaagtgaaaacaagccaagcatccatcaatagatgaatggatgaagcaaatgtagtatattcacatactggaatattatttagctattaaaaaaaaaacaaagtactgaatcatgctacaacatggacaaatcttgaaaacatcatgctgaaaaacaccagacaccaaaggccatgtattgtatgattccacttatgtgaaacattcaggataggcatacccacagagacagaaagtaaagtgattgtcttgggtaggacagggtagttgggaggaaatgaggactgctaatgtggatggggtttctttgcggatgatgaaaatgttctggaattagatagtggtgatggttgcataactttgtggctgtgctaaaaagcacaaattgcacacttcaaaggggcgaattttatggtatagaaactataccataattatatttttaaaaaagagggggagagaaaggtatgagagaaggaagaagacggtgagacccagagcatagttggaaagattagctttggcaagaaagaacactacctctccactaggagaaattttgaggtagggataagctcacagtggatgggtttaatgggagctaatacatatgtacttgctatgtgccaggcatttttctaatttatttacatgttcttatttaatccttaaaacaaccctatgtggtragtactatttttatccccattttacaggtgggaaagctgaaacagagagaggttaagaaattttcccttgtcggacattgtggctcacgcctgtaatcccagcacttagggaggctgaggcaggcggatcacttgagrtcaggagttykagaccagcctggccaacatggtgaaaccccatctctaataaaaatacaaaatttagctgggcatgctggtgcgtgcctgtagtcccagctactcaggaggctgaggcaggaraawtgcttgaacctgggaggtggaggttgcagtgaaccgagattgtgccactgcactccagctgggggacagagcaagactccatctcaaaaaaagaaaagaaaaaagaaaaaaagaaatgtgcccaaagtcccacaggtgggataaatgtcagagctgagatttgagcccagacaacccagacagactggctgcacagtctggcacttagccactgcactgtcttatgtctgtcatctgtgttctcaaaacagggaaggctgagtgctgagagtgttaagggctgagagcatatttggggtttgtgcgcagaaaaggttaaaaaactaccatgaagaacgtgggagtaaacaaccgaatttttattcaaggttcttggaagtagtagaggcctaacagaggcagtttctccattctgtcattgctgcattctagcccttactattgttctgttcctacaggtctgtagtgggagttttcttatgtggccctcggactttggcaaagagcctgcgcaaatgctgtcaccgatattccagtctggatcctagaaaggttcaattctacttcaacaaagaaaatttttgagttataggaataaggacggtaatctgcattttgtctctttgtatcttcagtaatttacttggtctcgtcaggtttgagcagtcactttaggataagaatgtgcctctcaagccttgactccctggtattctttttttgattgcattcaacttcgttacttgagcttcagcaacttaagaacttctgaagttcttaaagttctgaagttcttaaagcccatggatcctttctcagaaaaataactgtaaatctttctggacagccatgactgtagcaaggcttgatagcagaggtttggtggttcagagttatacaactaatcccaggtgattttatcaattccagtgttaccatctcctgagttttggtttgtaatcttttgtccctcccacccccacagaagatttctaagtagggtgactttttaaataaaaatttattgaataattartgataaaacataataataaacataaataataaacaaaattaccgagaaccccatccccatataacaccaacagtgtacatgtttactgtcacttttgatatggtcttatccagtgtgaacagcaatttattatttttgctcatcaaaaaataaaggattttcttcttcacttgatgaatgagtcttttgttacttctttttgggctctccatttgggaaagaaaatctagaaagtatgctcattgtaattgaaattgtattataattgcaagtcagctatactgtcatcttgtattattctgttaaaagcgattgtgaaaacttgaactccatgttaggatgacttatttagtcaagaggagctctttatcactattaagggagtttattaatgtctagtttaaaaaataacaatttataattttcatagatttttgtggactcctacctatatcgctaaggaatcattcagctaataacataagcaaaatgccttcattctctatcagaatgctttttatttctgccatctacccaacctcggcctacaaggaccacactggctctgggatgttagtcgtcacagtgaatccctagaaggagagaagcccagggctcttaagagagaaacctcacacttcattgtgcccagacaattcaactcattatagattagaagaatggttgtactgaattagcattatattatctattttttctaccattaagtgaccacgaatgaacaaatggttgtttctaatagtttaggaacctctacggcttgagggataaaactgtttttggtttttttttgtcactagtctgagcacaataaaggtaggtcatgaactcatggtggctaatcatgtttcatttattacaacagtaaaacaatactgatggttgtttacatagggagggataccactgctgttgccaatttgttcacccggatttcagctaattcaggtttaataaggctttgggaaaatgcacaatgaaaccttgaagacatgattcttattagacaactactgaccaaatgacaacttcatcttcaatgaccttgatttggaatcttgaaacttacaacgagttcctaatgagaaaggcatcactcttggtctccatgtctaaatatattgacacactcacttcaagatatgatggctgccaaaatcaatatcccaaggcttgaatatttatgggagtaggcataaattcgtgattatattcatggtaatgaatataataaatcctatgcatagccaacatccaagttgaactggggatgagcaggatacacagaaagctcctcacctgctttgagcaagtttttcttgcaaagttgtaatatgaaataccttaatcaacaaatttcttataaatgtttatatgagtagaaaatccctcaatttcattgtcactcaaaaagttgattatctttgcattcttttgcttgacatgtaagcaatatgctattacattctctaagcctatgccaggcttttaattcacctgaccataatcctaacccaggggatagaattccaagaatataaattggctcaaaagtagttccagtagaactttactgattattaaggcaactcttaacctcttgaggttggcctgatagagagaaaccatgttcctccttaatgccactacgagagagatggggttggggtggggggagaggaggaggcggcggcgcggcgagagagagaaatactaggcaataagacccatagattagagctaatggcactaattatgttcatacctatccgcaaggaagcaggcaggagcagacctaatgagcaatctgactgtgctctacatttggtccacttaaaatgagaagaatgtacaagttttagggttttctgtgttgtaagttcccagaataaacgtagttacagggtagggctgcaggttagggactgcctggaagataggatgaaatgtattttgttcatttgatttctgtttttatttcatcttgagcatgtgaaaaatcagtggctttttaaactttcaaagttgactgcctagactgataagtttaagaacacacaagtaaatgtcaacagtctcttgtgttgctgacacactcaaaccagtgctaaaacaatttttgtcttaactctgaattatacatgttcagacctgctattgaaacaaatgcattttgatatttggatttttctaaactaaacacacagctgtgctaggctctttgctctgttagccttctgaccattttatagctctaagcatgtgatattttctcctagaagactccgaagtgctagaatattttcagagggcaaagccttataataattcttactggaagcaaactaaacaaaaaccaagttccagaaaacattgcttctgagaaattctcaaatatcatcaagaagaataagtggttaacttaaaaacaaaactatggcaatatgttaaagtacaatactgcagtaagggtagaaaacacatctaaggtttcacccttagtgttaagctttttaaaagcaaaaaggtcatgtgtatcaatttgcagtgtactaaaattgtgttcaaagtttatttcaagtcacagaaaatatacaaactaagacaataaaatgaagtgattttgttctgagagaaggtgatgggagtcctccacctggcactgatttgagtcattcaagggttaggatgcaggtcatcttttttcaatatttcaacaaaattatagaatttccagatttcttgccaggtatttttgaaaacctgtaagaagaagttaggacaaagccattagaagtgaagacaaagctctcttccggaaaaacttcaggaaaaaaaataaaaaggctaggggagggaggacaggcatataatcaaatcaccaggacagatttgcaaagtatctgtctcctgcctcctgactcctcaaagcaatcagcccttgcagcagggtttctcaacctcagcactactgacattttgggctggagtactagttgctattgggaagtgggtgagggggaccatcctgtgcattatgggatgtttagcagtatctctggcctctacccactgaatgccagtagcatgccatactccctaaagttgtgatgaccaaaaacgtctcaagacaatgtcacctagggggcaaaactgcccttgtttgagaaccattcatctctaatgacaacagtatagaagcctgtccatgatggcagagatggatcacaactagctaggtataggatggaggaaaacccaacactttagccatggtatgcacaaacaccagtagacacacaataaaatcttgcccacataaaattgcatagaaccacacatacatatacacaaatcatgatagtttttttaaaatggtgaaaactgagtttgcagtcaagttaacagtaatgtgccaatgtcaatttcttggttttgcactacactgggtgaagggtacatgagactccttgtactatttttccaactttccttgagtctatgattatttaaaaataaaaggtaaaaaaatagacaaaaactttgccttgtggttaatatgcaaggccttaaattaaacatcctataagcaaaactataatgaaagaaatttcagaaacatttctacctctactatccagaaacagtaaggagtaattttctcacattgtagggaatgccttctctggcttaagtaaattagtaaaagaaataatttttatttattcctctgaatgtaataggtagtctatacttttactaaaaaaaaagaatatgtggggtttgtggaataaaacgttaaggtaccaaaagtctactgagccttctatctatgatagcttctcattaattcatttaaggtctaaatacatatatgatgcatagtcgcagtttaaatgtttaaagacatcacaagtatggattaaaatgatatattttgtaagagtggtaattattaatagttaaatgagttcactattatataacataagaataggaattataatatggatggggtaaaaagtagaaatttaaattgtgctgtcctacctgatagtggggcaacatgaattttaaactgtttttagaaaaaagaactgtttataaaatacaaaatgctggggaaattttttttaaaaaagaaacactgatacatgtatgtgtaatcaagttgtcacatgattatttatgaagcaggttacctggatccttttttttttttttttttgacacagagtctcactctgtgacccaggctagagtgcagtggcataatcatggcttactgcagccctgacctcctggactcaaccagtcctcccacctcggcctcacaagtagctggaactataggcgcatctcaccatgcctggctaattttttaaaaaatttttgtaaagatggggtctcactatgttgcttaggctggtcttgaactcctggtctcaagtaatccttccacctcagcctgccaaagctgagattacagggctcagccactgtgcttggcccctggattctttctgcctaaatgatgagcaagaaaaataagggtagcggggtacagcgatctccaaaatatatagaaactgatggtgatgacggacatttactaccttaaattatgtgctactatagttcaacatcaaaatattccctataaaataaatacaagaaacaaaatatttacacattttattgaaatgctttgtatttttccattttgacaggacagtttggaataaaataatacaattgattgtagaaggatacacaccaaactatatttagaggttttgtctggggaatgagattgaggaaacagggctttttacctttcaccttctacatttctgtatatgattacttttgttaaactgatcatacattacctttgtcattaggaaagattataagcaattcaacaactgaacaaacattgtatagccttactctatccctacaggagctgacctactgaagggtaaagaagagtctagctgagtggattgagggccgctgagagaacaatcttgttggttaaggttaaaagtatatacccagaatagacaaggagctagtcctactcagatggggattaagtttgctcacctatcaaggtgctccagtggatttctgtatttgttcctttaaaatcaggatactctgcctttgctcaggaggcaacatggcaatctggtctgcagtcagttgtagaacctgcataatcaaagcagcctgtgcagaggaaaaaaaaaaggtagtgagttttaatgatggcagctaaaaaatacaaaacaaaacaaaaaacccaccaccagcttctgtccaaaaagctactgtagtgggatatgaagcaaaatggaaaaaggaagaacatttcacacagaaaaaaaccaacagcccccctccaaaaaaaataaaaaataaaaaaaaactggtgagaaaaggtacaatgaaaagaacaagtataaattaaaatacctaagattagacgattcaaaacagacaacttcatgaactcaaagttcctggagactaagatggtatctgtgagccctggaaatccttcaagttttaatcctgttttgaaagtctctctttttcacaaattttagcctttccatcagacataagctccccacaatggtcaaatataaaaacagaaagatataatcatggggaatctactattgtttttagggataaagtagaaagggaaggaaaaagggtgtggattttcaggtcaatctggcctgaacaagaaaaacctgctattggcagatgagtgtgaaatataaaataagctgccatttacatccacttaagaacttcacatccattaggaacttcaggaccagactcacaaattttcaggtaacaagatcataaaagagttctaagttagaataaacatcacctccaaagggactttgaagacccaggatcgtcacatggtaactgtgaaaagaggaatcaaaaaggctagaattgtgcataaggaggcagtcagacagtgttgcttaccttctcatgatcctgtggagtgacttggttctgcccgggactaaagccgccaggctggcttccaccctgtatacttgctccttgcattcctgttccctgcatgactgggacctatgtgtacaaagagaaaagagagatttttggcatttttaatgtataggtaacctgaattcagtaataatgtgacaaattatgatctctatacagatatgagtaaaaaaagcaaatcaatgactctgaagatcattttctactgttagcaatagcagaaggcagggtttagccagagatcaactagcaagttcgacatacttgcttacaacacctccagcatcatcaacaaatattacacagcacaactggataccactgaattaatcaaaattcagccaaataagcacagtgaaaactgagaacaccctggaaactagtgctcactggaaatacaaatgaaagccaacagagtctagagaaaatgtatgctggtccactggggaagttacattcacagggccaccccctaccctagttcaatcagatacaggtagtttgtcccaaagggccctatcccacaagtgaggcagagatgttca

SEQ ID NO: 17595 - DNA, 20773 bp, Homo sapiens
tgaatgaatgcattatgaaaggaattcttttacatgcgagtttgctgatagtcttagctaattctcatgtgtgtaggtgtcttgcctatctgtcagtcttagccttaaaggaaagagtcccatcacctcacttgcggcctcatcatcatggaccgcatgatgatgcggaatgagaatttttattgtttgtactacttcaaaatcattcagtacgtgatcacctgtcatgtatagggctctttatatttctagtttagtcccttttgttttctctaggaaagatgttttagacctgggacaaaagaagaaagagtgtatgctgacatctaggagggaagcacccacctcccctaagctccatctccctgagcactcatttcccaatgaccataccaggttttggccctagagagtttattacaaaataagaaagagaagtctggggaaggttcactcatcatagaattttggcagttcattgcccaagatgactcgatggtccacaccggcagctgtaatagtgaccaggtagatgacacccccgcttgagccatcccggctcatggccagagcaatagctgcagagggtttcaagttggagagagggagagagaggatggcttagcttcaaaaatctttttactccccctccatccatatgcctactaccactttcacctcaaaactcatcttccaggaaggcatatttagtggtgtgctggtaaatcagtttttttacaaaaaggcttccatatgtggcatctgctgatgtccgtggtgtaaatgctcccgctatgatgaattgcaagttacaaatagctaagcagttcacaaatccttgactatttaacagtccgctctcatgagtggtcccaagccagcctcagcacacctcagcacaccactggttctttttttttttttttttctccagacagggtctctctctgtcacctaggctgcagcgcagtggtgcaatcaccgctcactacagccttgatctccccggctcagatgatctttccacctcagcctcctgagtagctgggactacaggtgtgcaccactatgcccagttcatttttttttttacttttttttattgttttttgtggagacagggtttcaccatcttgcctaggctggcctcaaactcctgggctcaagtaatcctcctgcctcagcctcccaaattgttggcattacaggtgtgagccactgtgcttagcacaccactggttctcacagtgactgtgtatcctcatttgatttactcagaacagccctggtttatccgtattgcccaagaaccccattgagctttgcatttgtcctgccccttttcactcttaaaagtgtaccaggcccggcattaacttaaatggccacccctgtatttctcttcctgttcctcataatctacttccttcccatgtttcaaagccctccccaggtacccttccacttggctggttaccgtctgtggtgaagcgcctgcactcctcgggagacatgcctggcttataygctgcatccacataaccatagataaaggtgctgccggagccaccaatggcaaaaggctgtcgagtcagcattcctcccagggttccatatacctgggaaagggatcctcaggttaaagaatcatcaagcccttccttcccactgagacattaagtggtctctgcaccctgcaatgaagccctggtatctcatatccccaaagtactatgctttcagaggtagtgtccttggaactcattgctagaatgacataggacttccatcttcctctgcaggagagtggggaagcccagaggagagagtgctttgggagaaactcacctgacctccttcacgttggtcccagccagctaccatgagatgtgcagacaagtcctctcgatatttatagctgatatttctcaccacatttgcagcagccaaaacaagtggaggttcctccagttctatcctgagggaaatattaggaataaaggttgatagaattttaagtctcattctcctatactgttaccatcatccctgctaaacgacccctgaaaactgtaactgcaatagctcaaactgcagcctccctcccacatgtacaggggaaccagagtcccacaccaccaactggtaagaagctttcaattgctcactcttttgctcagccccacccacataactttcttttggctgcaaggaccctgctcttatggggaaaagcagataaggttacttccrtcccaacgaccttgatttctcgtatggtaactgcctgatattatggtgggtcacaatatcaccttcttcctgattatttatatcaggatagtgatttacagcttttaaactgtgttcacatatagaatgtggttctcaaaataaccgtctcatgaggtactatattatctccactttacagatgcagaaactgacagattcaagtgccagcaagagccgaaacaagacttttccatttcccagtgtccagctcctggaacagcacactgtacagggattcatgcaggttgggggagctctagtgggtggggagtcagaactccagagcttcatacccatggagctccagctggtaggcggccatgtcggccacggcttgggcatcagcagctgaaccagagagtgcacagtagatgygctcgtgcagcggggacagcttgtcaaacactcggttcaccaccgcctcgctgtcaggagggagtcaacagtcaccaagttaaaactcaggtttttttttttttttttttttttgagacagtctcactctgtcacccaggctggagtgcagtggatcaatcttgggctcactgcaaacttcgcctccctggttcaagtgattctcctgcctcagcctcccgaatagctgggattacaggcacccaccaccaagcccagctaatgtttgtattttcagtagagacaaggtcccaacatgttggccaggctggtctcaaactcctgacctcaaatatctgcccacctcggcatcccaaagtgctgagattatagatgtgagccactgcacccaaccagaactcaggaatttttgagggtgatcattcaatgtctctcaaatttctttgacaagagaatagcatgaagtttaatgcttggattaaagcaggaggcaaataatcatctcagatattattaatcactgcagatgttaatcaaaattaggcttatttttcaggcttagattttataacaaagcaaaaaatgctaaggtaagaaaaatatgcctcatcaattttctttgctattaacaatcttgagagagttatgttctatggaacataatgtcagtaatattgacctaaccccatatactcattttgcatgtgaggaaattggttaggagtgggagaagagacaaaatagttcaatatatggtaaatgagaaaccaggtatctgcttgacagaatcatctttttgatccctaagcacagatggaaagaagaccctcaaaaatctatctcctgtccccctctcagaccctattcctttactcatccctgtacactactgggacaggtcacatacacattcagaccccagatcctcctccacaaattcagagacccaagcacccaccaaatagcttatcatagtggcttttggggaaggtcaactccattcctccaaggctccagtttgccagtcttttcatgaatgggtaaggaaagtgtgtatttgaggccattagcttctttccaaatgcatacatcttcacttttactcaccctgcagacactcgggaatcagaacccatcacaacgcccccgtcaaactccactgccatgatggtggtctgcagagacacagaatatggaatgtcagggcaagaacagccttgatgccctcatgttagagaagaagaaacattcccagagaggcgaagtgactggctcaaagattacacagtaacaggccagagctgactgtcagtacaggctttttttcccttcatctttccactttctctattgcttcatccggctgcaggggaatgccacagcccagctgtgatacaacacagaaagaactgtgtccctaagttccaacttgcctagtggaatcctctccactgtagagaggtggagatgaggctcctacaggtagaagtgaagcagctccgcaagtgaaaattatctccaayggaagggctcatagtatgtgcagatgtggtgtagacccaacacagagtaattgactatgatcttgggaaacaaggtcagtctatttttttttttttggtccacaatcctccactctcaccccccatttcatcagaagtgagctcttccaatttactgaacattggaaaaaatcgaggagggcagtggttagcatggccaggggcaaggcaggagagaagcagcaaggaacacatacagatggttgaaaataaaagtttcagttatggaatttccgatcaagaggtaaatacatatctcagcagccagggaggtaaatttgtaccaagagataatttgactgagaagtttaagctgacttttccaggtcaagaaaagaatcaagaagaagtgagggaagataaagctacatttattctactattgagttggaaggagccttaaagatcctcggttcaaatgaggaaaccaagtcacagaaaatgcaaacgacttatgcaaagtcacacagagttaatagtagacctgggactaaaattcaggtctaactcttatcccttgtttccacttctacttcctacttgccactgctcatttggcagtgaggggagatttcccaaattataagtggtttcactgtgtctttcttaccaggccgtaagttactctggccccaaaggacgctcctctgagtatgctttccgacggaccgacttatcatgaatagagggtcaaagaacagggttaacttcaagttagaggctattcctctctaacaaagccgcccccaagccacgagtggtggcagtagtccagagcagaagccagccagccagtcttggggctgccatctgccccaggcgcccatcctaagcaaagtccccccagtgggcacatgggagtgggcagggaagacacagggaagggagtaaggcagcatctgggccaaggagaggccttcctgggtcaagctagggaagggcatcactagttaacacagaacgcccattatcagtgcttgggctaagagttgcccagtggcaagtttatcaaaagtctgtgtgatgagttggtccttctcaataagtgcctatatttccttctcccaagtgctgttctacttcacccagggcaccatttcctcatctctttgcaccatccccaaccccctttcttgatttaaccagcccccactgtccgggaccagagtgaaagcgaaagcgctttagagtagcttcccgttgacgcttccagctaagagtcaaagcacccgctttttccaccagcctcgcgtgcctgttcccttcacggacactctagacgacccccctcagaaaagaaatactctatgctcattgcgggttgcaagcgctggctgctacaggcgacctccctgcgctcccgttggtctctgcattcacttctccgcgcgcgcttccagggtcccctggccgctgcatctcctccacccctctgccaaccctcaagcccagacccattaccccggtgtggacttctcccgcccggggtaagtccycggttggtgctcccgcccgcagcatccctgcaaggcaccgctctcctcgccgcctggggcactggtttccaacctgggacagcgcacaacgcgcagccgacagccccgccccttcgcggcgccgccaggaggcgcctgggtgctgcggggctgctttgcgcgcggcgctaacgtgtgtagggcagatctgccccgagacaagtgacgaggcagccccgccctgaggctggggtgggaaaactggtgcaagtggaaaggcaggaggcagggagaggcgagaagggtgtgcgtgatggagaaaattgggcaccagggctgctcccgagattctcagatctgatttccacgcttgctaccaaaatagtctgggcaggccacttttggaagtaggcgttatctagtgagcaggcggccgctttcgatttcgctttcccctaaatggctgagctkctcgccagcgcaggatcagcctgttcctgggactttccgagagccccgccctcgttccctcccccagccgccagtaggggaggactcggcggtacccggagcttcaggccccaccggggcgcggagagtcccagrcccggccgggaccrggacggcgtccgagtgccaatggctagctctaggtgtcccgctccccgcgggtgccgctgcctccccsgagcttctctcgcatggctggggacagtactgctacttctcgccgactgggtgctgctccggaccgcgctgccccgcatattctccctgctggtgcccaccgcgctgccactgctccgggtctgggcggtgggcctgagccgctgggccgtgctctggctgggggcctgcggggtcctcagggcaacggttggctccaagagcgaaaacgcaggtgcccagggctggctggctgctttgaagccattagctgcggcactgggcttggccctgccgggasttgccttgttccgagagctgatctcatggggagcccccgggtccgcggatagcaccaggctactgcactggggaagtcaccctaccgccttcgtygtcagttatgcagcggcactgcccgcagcagccctgtggcacaaactcgggagcctctgggtgcccggcggtcagggcggctctggaaaccctgtgcgtcggcttctaggctgcctgggctcggagacgcgccgcctctcgctgttcctggtcctggtggtcctstcctctcttggtaaggggaacgcagggcaagaggggaggacacaaggggactgggacaggaatcaaaggtaattgtcagtaaggtagagtagcgtgggttctgggaaatgtggagcrggagaaggactcctagcgtgggtcttggaacaccacttcggtgtagaagaaacggcactggactggcgggggccagaggttctgggctccattgctgaccgggtcttgattctttgggccacgccggaagcggggaaatcctttgctctggggccgaagggcggggcatcctcatctctaacaggaggcttttctacttcatgatctccagccttcctaataaaatcctgaaagttctggtagagcaaccacagggtagtgagttccagggcagcctatttaggttcgggattgagacgtcagtgtttcctttctgctgatgccctccaggataatggtgagggggaggaggcgtggtggggccagtctgactgraactgacctacttagacttaatatttgtgcgtgacctctcttctctttctccaggggagatggccattccattctttacgggccgcctcactgactggattctacaagatggctcagccgataccttcactcgaaacttaactctcatgtccattctcaccatagccaggtctgggggctgaaaatggggcaccctgcaaatgagggagttggaagttggggctgctgtccgaaatgcacttatatggggatacctgggaccttcagtctgttccctgaacacaccctgaycccctttttttccgggttctttatagtgcagtgctggagttcktgggtgacrggatctataacaacaccatgggycacgtgcacagccacttgcagggagaggtgtttggggctgtcctgcgccaggagacggagtttttccaacagaaccagacaggtttctcctgaaactctttcrttatacgccaygtactgttcatatcctcatacatctgctttgatctcccccctccccgctctctctctctcacacacacatacacacattgttccttctcattcttgatataccctctccctgtctctctctctctgtctctgtctctctctctctctctcwyacacacacacacacacaattgtttttctcattcttgatatacctcaggagcaaaatattgtcctccttaccttaagaaaaacctagagttttcatctagcattttcttataaatctattcctatgtatccttagatagaaaccatagaatttcaaacctggaaattttgagctcatagagaccarctgcctcatctgacagagaaggaaactgaggccaagaccctaaatgctgaaactgcacagttacatatggctagagacacacttggggttagaaccctggtctcttgagtgctccacagacttcggcatgctttctagcagcactagaagctgtacagttacatatggctagagatagacctggggttagaaccctagtcccagtgagtgctccacagactttggcatgcttcctagcagcaccctcctcctccatctctgttatgtgaccagtttaagctcttcctgcctgtgtgtatagcatgggacatacaggttctctagggaacagaaagctttcaggaaaatggaaattcacatgtgcattaatgactttataattaaaatgaaggtcaggcctttcctctttaacactcatcttccctgcactgagatttgcagacctctggagaaccctaaccttgtttcctgcagcctccttagaaccccatgttgacacccctgaccctggcatcctggctcattkttagttcgtctcatcacttggaacctgtctgattcacctcactctcttctccccaaccctgcaggtaacatcatgtytcgggtaacagaggacacgtccaccctgagtgattctctgagtgagaatctgagcttatttctgtggtacctggtgcgaggcctatgtctcttggggatcatgctctggggatcagtgtccctcaccatggtcaccctgrtcaccctgcctctgcttttccttctgcccaagaaggtgggaaaatggtaccaggtatgttcatggagttggcccgctctacacagaccctcatctyccagacttggcagactcagttcctctcacattgctttcagtccagctttcctggcacccttactgattctccatcttcatggaacaccctgtccctgtggtccatgttcccaggttgctcaacattaacctccatactctctgggtcttcttttctagcttctccccacaatctgtctttaagaatttgatccccaacccgttctgagtcattttcctcttcctygtatttctttagcatccaagggscatagctgtgtctctttctcttttctccttttcctctgtctcttctcacctttaatttccaaataggtaactcaggtattagtgtccctgatggtttgccaacccgtgtgacatctcttgtccatgtatccacagttgctggaagtgcaggtgcgggaatctctggcaaagtccagccaggtggccattgaggytctgtcggccatgcctacagttcgaagctttgccaacgaggagggcgaagcccagaagtttagggaaaagctgcaagaaataaagacactcaaccagaaggaggctgtggcctatgcagtcaactcctggaccactagtgtgagcacctgaagatgaatacccattcccttgtccttaagatgccgtgactccattcccattccyrtgaccctgctcccactcctyctttactgggaaatggttggttcagtattttcgtcctagcaacctgaggctcaatgactctactcagtgtccctagccccctccctctctttaaagatgctaggtggcttcctttcagtatggtacataaaatccacccaaccatgtggattggagagatgcgtgtcttccagtcctagggccttcctttgcctctcaggggaagtgcmgggmgccataaattcttgcacctgggmctgcttcatgctggtaccttgtagatttgttagtgagagtgatgggaatagtggaagccagggatgagggacatctgtgatgcactggaaagagagctacgccagtgatccgaagatcctggcttgatgatgcaatttacttgtcttgtgatcatgacaacaaatttaccttctctgagactgtttcctctttatttatttatttgtttgtttgtttgtttatttttacttattattattatttttgagctggagtctcgctttgtcgcccaggctggagtgcagtggcgcgatctgggctcactgcaagctccgcctcccgggttcacgccgttctcccgcctcagcctcctgagtagctgggactacaggcacccgccaccacgcccggctaattttttttttttttttgtatttttagtagagacgaggtttctccgtgttagccaggatggtctcaatctcctgaccttgtgatccgcccacttcggcctcccaaagtgctggaattgcaggcatgagccactgcgcccgactggttgtttcctcatttttcaaaaatggagtgatataaccttctttataaggctcttcatgtattagctgacatcacatgaatgaaagccttttgtgaagagtaaaaygctccccagacaaggtgatagtggtgatggtggtgaagataactgtgacttgcatgatgtgcattgagtcagactccatggggtctctggttcattctcctgtctgcctattgagcctgccgatgtcacttrggagacagggacttgatatttccttyaggttaatgactryggttctttgtgtcccctccagatttctctacctcagtccctttttttgtggtctctttatagatttcaggtatgctgctgaaagtgggaatcctctacattggtgggcagctggtgaccagtggggctgtaagcagtgggaaccttgtcacatttgttctctaccagatgcagttcacccaggctktggaggtgaggtccctccaccttcactccccagtgtgattccttcctctggcccagcaccatctgtgtgatktccttccattctttacccttcttgcttcacataatgmtggcaagcagactacctcactttcactattcttacctccctctaggtactgctctccatctaccccagagtacagaaggctgtgggctcctcagagaaaatatttgagtacctggaccgcacccctcgctgcccacccagtggtctgttgactcccttacacttggagggccttgtccagttccaagatgtctcctttgcctacccaaaccgcccagatrtcttagtgctacaggtacaacctaccactccctgtattccactggccccaactgcaattctgccatcctaaattttcttcctgccttcagcctgcttactgccaagcatatatcctccctaaccctttaaaggcaatggtaggcatcatctgttccataaatcttccccaaactcaagaacccagtttgggcttccaaagagaatgagagaagaggtttcgaagagagtgctctcacgttccaaggaattgctgcagcaaaatctgtgtcttcggtcttccatctttccttttcctttgtaatttggaatgtgatttttccctttcctggtggtatctgacatcaagtgtgtggcatagtggtgctgggtctctgcccttgtctttgcygcttcttctatctctactccttgggraggcatcacccagaaatctgtgcatgtgggagggtaggagtttctrtatttccctgtttttsttctggggtaagacatcatgctrtgtaacaaggcartgacactctcaaggttagaggccttggtagcctcttatcgtgtgcttctctggcctctaggggctgacattcaccctacgccctggcgaggtgacggcgctggtgggacccaatgggtctgggaagagcacagtggctgccctgctgcagaatctgtaccagcccaccgggggacagctgctgttggatgggaagccccttccccaatatgagcaccgctacctgcacaggcaggtatggaagcaggtggcttgaaggagggcagggagcatcaaatacgaagagcattcttactgagcactctgaaagaggggttagggaatgataagagaccttgggtggagatggtggtgtagtcaggagggaggtagtatgattttgtgacatgttctcartaaagattttgagtcttcratctctagataaccatactcccatgtgycttgttctrtgactcttcatcatatttcatctcaggtggctgcagtgggacaagagccacaggtatttggaagaagtcttcaagaaaatattgcctatggcctgacccagaagccaactatggaggaaatcacagctgctgcagtaaagtctggggcccatagtttcatctctggactccctcagggctatgacacaggtactctctccactcatctcaccacccagccatctttacctttgctgaaaccccagtagtcttgcctttatccttcagttcctccttactcatggacatcaatttgaagttgtaagatcatgctcctatggcttcttcatcctgacatcctcaggattctgttcatcttcccagaatctcccctatccagctacaaccgtcagatcttggtgtgtgtgagtgcgtgaatgcatgagtgtgtctgtgtgcytgtacatgcgtgcayacatgtggctataccgttctcatcttggccctttgctctgcagaggtagrcgaggctgggagccagctgtcagggggtcagcracaggcagtggcgttggcccgagcattgatccggaaaccrtgtgtacttatcctggatgatgccaccagtgccctggatgcaaacagccagttacaggtgaggcagtcatcttcttaatggmtrtatcccacccaatcttgcttcttttatacatcttctgttagttttactaacatcataattatacaaaccagtccttgcagttctcagttcccaaatccagttccattggatgcctccccaaggagtagagatagaagacgaggcaaagacacctagaatcagttaaaagagactatctacaaactacagactgaatttctttctttctttccttttttttttttaagacagtgtctcactcagttgcccaggctggagcgcagtggcacaatcttggctcactgcagcttcaacctgctgggctcaagcgattctcccctcagcctcccgagtagctgggactacaggtgtacaccactatgcctggttgrcttttatatttttagtagagatgggtttcaccatgttgcccaggctggccttgaattcctgagctcaggtaatctgcccccctcagcctcccaaagggctggggttataggtgtgagccactgcgcccagtcctatagactgaatttctaaagcgaaacataaggaaaagaccatcctcataatatcgtttatttaaaaaaattattttttgtacagacagcgtcccgctatgttgcccaggctggccttgaactcctgggcccaagtgatcctccctccttgacctcccaaagtgctaggattataggcatgagccacygggcccagcccatcctaatcatattaatattaattaagctagtctgtttacatgcactgtcactcatttattcattaggaatccttctgagctaggcatttatcatcattctacagatgacaaaatggaggttaaaagaggttgaataagctgctcatatagaggtcatatagcttttgagtggcgcagccttgacccaaattcaggtctgcctgacttgaatgctcatctctttactactaagttatatttccttaaaatckaatataaaaatkccaagtccatgggtagagaagaggactattcaatagtctttattcttctgtcacgtgtttcaccctagggttctcatttttatcctacttttgcacccttcatgtaaaacagtccttaatgaaacaaagggtttgcggagaagtactcagaatgggaaacgttggtgtccttggggttgttagcagagccagcagtgatcctgtgaggtcagtcccagccctggaaacacaggtgtctccctgggctgagggtagtccccggctctgacggtccgatgtctttcctcaggtggagcagctcctgtacgaaagccctgagcggtaytcccgctcagtgcttctcatcacccagcacctcagcctggtggagcaggctgaccacatcctctttctggaaggaggcgctatccgggaggggggaacccaccagcagctcatggagaaaaaggggtgctactgggccatggtgcaggctcctgcagatgctccagaatgaaagccttctcagacctgcgcactccatctccctcccttttcttctctctgtggtggagaaccacagctgcagagtakgcagctgcctccaggatgagttacttgaaatttgccttgagtgtgttacctcctttccaagctcytcgtgataatgcagacttcctggagtacaaacacaggatttgtaattccttastgtaacggagtttagagccagggctgatgctttggtgtggccagcactctgaaactgagaaatgttcagaatgtacggaaagatgatcagctattttcaacataactgaaggcatatgctggcccataaacaccctgtaggttcttgatatttataataaaattggtgttttgtactgtggtttcttatgtttccggcacaccaaacggcccactgccttttgcagcgcacttttcagctgcggatgtctcctcttttatcatcctcaatgttttaccccctaactgcatcaccttttcccttaagctttttaattcctatgaggccccttccacttcccctatccccttaggcccacccccaagaatgtgcaagaccccagccacagggcccatcagggcactagcggccgcagctcagagccgtggcctctccgaagtggcagatggggcgggcgcggccagagcaagtgccaggcgggaacagagggactgggcgcgcctcacaactcaccacctcgcccgctggtccttcctggctcgcctggctctgaagctgcacctggaggggaaacctcararcagtaggcgggattgcctagtaaatatctcccattcagggaggcccaggtcrtgtgacgtcgacagttgctgggtagatgaggccaacacaggttgcaagaagaggcggggtttagaggcgtgaaactccgcagtgctcagccaagcagggagcaacgctaggaagggcgggcagaaagggcacgctcttgtgggtgactacaggttaggagaccgttgaacctggaggggccctaggatggaccccgtggaaagattcagagactgcgccctctccctggcgccgccttcccctacacgcggcgggtatattctgttgcagttggcccaggacctgtttccaagactctgccccctcgcacttccgtccctcctggttttgtaaagtgatgctcataggaacccccaccccgcgtgacactactcccagctcctggctgacttctagtcttctggttgaagctgcgcctttagatgacacgaccctacccacccctgtttccagcggatgcccgggcctggaggtacctcttactgtaacccatcgccaagtgggcttttgaaggcgcctgttcctttctcgctttcttcggaagacccttgacccatcattcccccgacccccataacgggagagcagagaagccggtccccagtgtgatggtcctggtccaggcactaactgtccttttctcggaaaaggcagggggatgtggaaaagagtcttgttccctccccttcgatctgtggctttcgctttcacttcctcctccgagagcggacagatctctgggtgctgggcggtcatggcgctactagatgtatgcggagccccccgagggcagcggccggaatcggctctcccggttgcgggaagcgggcgtcgctcggacccaggacactacagtttctctatgcgatctccagagctcgcyttaccccggggaatgmaggtcggggcagtagggaagcccctagggatgcagggaggcgggcgctgaggagtggagggtcgcctgagaggaggaggcgagagcgggagcgcggggtacagggtcgggggtagccttcagtcccggagagcgccagacccaaagaagaggccacatggggatggggcctgagaggaggaagtgcaagttaggacaaagagttacaggtgaggtgggggctcccaaaggaagacaagagaactttcctgcccttgtccacacacaaatggtggagcctttttcatggggttatcacatgatataggaggtgtgtggtgtcttgggaaacctatgaaatttgcctgctggcctcctctcagcaactcactgttgcgcgacttagaacaagtcacttagtctaggtcccaagcccctcttctgtaaagtgaggatactgttactaaacgtgttttgtgagggttgaatgctttatgcatggaagaaaccctttaagtcactctcaaaattttttagtaatggtaacatgtgcttgctttcatttctgttgtgctggaaaatggaaaaggttgatactggcatgcctcttcttttccttctcccaagccatttccttctagagattggttattaactgtttcatttattgatggttagatcatttctgcatatctcctcaccctcatactccctaaaaccttttcctggagcctcttactacagaatttttcattgcctttctcaacctcttttctcttatcagcccacagaattcttccagtccctgggtggggacggagaaaggaacgttcagattgagatggcccatggraccaccacgctcgccttcaagttccagcatggagtgattgcagcagtggattctcgggcctcagctgggtcctacattagtgagtgtatacgctccagcaggcagaatctggggagctgggctctcctttccacaggaggccaactctgcaacaaagtggaagtggatattgatttaggacacactgggggatctatggggtcatcccttctctcccaaagctccatcttcttccaggtgccttacgggtgaacaaggtgattgagattaacccttacctgcttggcaccatgtctggctgtgcagcagactgtcagtactgggagcgcctgctggccaaggaatgcaggtaagcgaggcctctcatcttcctttcttagcctagtggttaatccctggatctctcagatcattgctccttactcttgtcctatgtggtccatcttagtgctaatagtatatttcacaaaacagctttttggtgataagacccttctcccaaatctcagcctgtgctccactcataagccagatagtacgtcaggtatttagcactgacacatccaccctggcgggacagtatcatttactaggctgcctttgtatgtttcagatactttaaattccaaatctttctctgatctttagatcctacaaaataattcctttccaatgcttatctctttaatcatttcctgccccatcaagttggaaagagctaacctctctttcctcactccaccttgtcctcacccaggctgtactatctgcgaaatggagaacgtatttcagtgtcggcagcctccaagctgctgtccaacatgatgtgccagtaccggggcatgggcctctctatgggcagtatgatctgtggctgggataagaaggtgggtgctctccattcttcatgttcccccaccatgttccctatggatgacagatctgtttcccatcatatactcctactccctccctgacaagatgcatggcatatagagtgcttggttatagaactgtttcagtatatccatggactatttattggcccagatatgaatcattgcatgtgttttgtaagcttgtcccttttgttaaacagttgatttcaagtttgtttttcctttttcatttctaaagttcgatgactttaccaaagtggtttcctaattccaatgttcttgtggtaatattaattcttttgttcactttttatgtctcatatttgaacccccatgttaccaacatcttcctctccaatttcagcctgaaatctttcatcttatagggtcctggactctactacgtggatgaacatgggactcggctctcaggaaatatgttctccacgggtagtgggaacacttatgcctacggggtcatggacagtggctatcggcctaatcttagccctgaagaggcctatgaccttggccgcagggctattgcttatgccactcacagagacagctattctggaggcgttgtcaatagtaagagaccaatgctcccaccaccatgcctgggaggagtcggcgggtggtggggggggtgatttaagattgagaaaccagcctggccaacatggcgaaaccccgtctctactaaaactacaaaaattagccggacgtggtgacgggtgcctgtagtcccagctacttgggaggctgaggcaggagaatcacttgaacctgggaggtggagcttgcagtgagccaagatggcgccactgcattccagtctgggccacagagtgagactccttctcaaaagaaaaaaaagaaaatgattgagagactcaaaggagggagagtagtagggaggaaattttcagagtcagaagaagggcattaaaggcccagtcatatggttttaagcttgcgcatgtgtcttgttgctgccttcaacataacatcagtgacaggaacttgctgaggtgaaaggtgactccatgttcttttctcatttgtccacagtgtaccacatgaaggaagatggttgggtgaaagtagaaagtacagatgtcagtgacctgctgcaccagtaccgggaagccaatcaataatggtggtggtggcagctgggcaggtctcctctgggaggtcttggccgactcagggacctaagccacgttaagtccaaggagaagaagaggcctagcctgagccaaagagagagtacgggctcagcagccagaggaggccggtgaagtgcatcttctgcgtgttctctatttgaacaagcatttcccccagggaagtttctgggtgccccactaagtagaataaagaaaaacggttataaatacctctgtcttgtggctgaatggggttgggcctgtggttgttgggtggggcagaaagtaaagagacgctttttctggagaaggggctcagacccctatctaagaaatgtggcctcaccacatagttcttcctggggtttccttccacactcatctctccaagacctcaggaaggctgctcattgctgtccatggacacttgtttgcaatttcacataggttagggtcctttccatagagaggcacctggggactcctgtgtgttccattgttaatggtttgaggaacagggagtagggcacctaggataactgtttttgactttatagagtaggatgaaaaagcttccacttcactttaatatggtaatcatataaacaccataccatttatcccaaataacactttggagatattggatattgaatataaagacagacattaagggtctaatttcatgatgtgtcatgctgaattgcaagatggcaggactataattttagaggaagaagagatcaggaggactcccctaagtgaggagtgtggggaaaatgtaaaagatccaggttagaagaaagagacacacatcatgagattttcggaatcatgctggaactatggaccatgtcactttccagaaaataaaggaaacaaatgcttgaaagtaggagcatgagcttgagcatggagcttttttcattagagagagattcttaaaatgccagaatgaatagagttgtaaaactttagcgagcccctacttaaaatccctcctccccaccaccactattttaaactttaagtgactccttggtagtcacacaggtaacatttcaaaatggtgatctggaatccaagcgacccttcctttggggaatttgtttgtttgtttgtttttagtttgggaggtggtttcaatctgaagagtcctttctggaataaacgaatctttctgttgcataggaaggctctgggtcaggaaggatatttaaaaacctaattactgttctaaacagtgttaaaatagaacaagaaccaaagctcagtacggggcatttccctcataggctgaaggtgcgcccaacataatttggagtacagactcagaggcacctgaacacgcgccagctcaaggtgctccggctgagaaggacggatgaagatgaacgctcagggcctactaaattcaaagtctgtacgtgaaaatcccctttggcctggtgagattggttggaaccttctatttaggagagcccggctcgctcgcctaaaactggagcttgcatggaagagggcactttttttttttttagacgaagtctcactcttgtcgcccaggctggagtgcaatgacccgatctcggctcactgaaacctctgcctcctgagttcaagcgattcccctgcctcagcctcccgagtagctgggattacaggcgtccgccaccacgccctggctaatttttgtatttttagtagagacagggtttcaccatgttggccaggctg

SEQ ID NO: 17596 - DNA, 16175 bp, Homo sapiens
gcagactcagttcctctcacattgctttcagtccagctttcctggcacccttactgattctccatcttcatggaacaccctgtccctgtggtccatgttcccaggttgctcaacattaacctccatactctctgggtcttcttttctagcttctccccacaatctgtctttaagaatttgatccccaacccgttctgagtcattttcctcttcctcgtatttctttagcatccaaggggcatagctgtgtctctttctcttttctccttttcctctgtctcttctcacctttaatttccaaataggtaactcaggtattagtgtccctgatggtttgccaacccgtgtgacatctcttgtccatgtatccacagttgctggaagtgcaggtgcgggaatctctggcaaagtccagccaggtggccattgaggctctgtcggccatgcctacagttcgaagctttgccaacgaggagggcgaagcccagaagtttagggaaaagctgcaagaaataaagacactcaaccagaaggaggctgtggcctatgcagtcaactcctggaccactagtgtgagcacctgaagatgaatacccattcccttgtccttaagatgccgtgactccattcccattcctatgaccctgctcccactcctcctttactgggaaatggttggttcagtattttcgtcctagcaacctgaggctcaatgactctactcagtgtccctagccccctccctctctttaaagatgctaggtggcttcctttcagtatggtacataaaatccacccaaccatgtggattggagagatgcgtgtcttccagtcctagggccttcctttgcctctcaggggaagtgcagggcgccataaattcttgcacctgggactgcttcatgctggtaccttgtagatttgttagtgagagtgatgggaatagtggaagccagggatgagggacatctgtgatgcactggaaagagagctacgccagtgatccgaagatcctggcttgatgatgcaatttacttgtcttgtgatcatgacaacaaatttaccttctctgagactgtttcctctttatttatttatttgtttgtttgtttgtttatttttacttattattattatttttgagctggagtctcgctttgtcgcccaggctggagtgcagtggcgcgatctgggctcactgcaagctccgcctcccgggttcacgccgttctcccgcctcagcctcctgagtagctgggactacaggcacccgccaccacgcccggctaattttttttttttttttgtatttttagtagagacgaggtttctccgtgttagccaggatggtctcaatctcctgaccttgtgatccgcccacttcggcctcccaaagtgctggaattgcaggcatgagccactgcgcccgactggttgtttcctcatttttcaaaaatggagtgatataaccttctttataaggctcttcatgtattagctgacatcacatgaatgaaagccttttgtgaagagtaaaatgctccccagacaaggtgatagtggtgatggtggtgaagataactgtgacttgcatgatgtgcattgagtcagactccatggggtctctggttcattctcctgtctgcctattgagcctgccgatgtcacttaggagacagggacttgatatttccttcaggttaatgactgtggttctttgtgtcccctccagatttctctacctcagtccctttttttgtggtctctttatagatttcaggtatgctgctgaaagtgggaatcctctacattggtgggcagctggtgaccagtggggctgtaagcagtgggaaccttgtcacatttgttctctaccagatgcagttcacccaggctgtggaggtgaggtccctccaccttcactccccagtgtgattccttcctctggcccagcaccatctgtgtgatgtccttccattctttacccttcttgcttcacataatgctggcaagcagactacctcactttcactattcttacctccctctaggtactgctctccatctaccccagagtacagaaggctgtgggctcctcagagaaaatatttgagtacctggaccgcacccctcgctgcccacccagtggtctgttgactcccttacacttggagggccttgtccagttccaagatgtctcctttgcctacccaaaccgcccagatgtcttagtgctacaggtacaacctaccactccctgtattccactggccccaactgcaattctgccatcctaaattttcttcctgccttcagcctgcttactgccaagcatatatcctccctaaccctttaaaggcaatggtaggcatcatctgttccataaatcttccccaaactcaagaacccagtttgggcttccaaagagaatgagagaagaggtttcgaagagagtgctctcacgttccaaggaattgctgcagcaaaatctgtgtcttcggtcttccatctttccttttcctttgtaatttggaatgtgatttttccctttcctggtggtatctgacatcaagtgtgtggcatagtggtgctgggtctctgcccttgtctttgccgcttcttctatctctactccttggggaggcatcacccagaaatctgtgcatgtgggagggtaggagtttctatatttccctgtttttcttctggggtaagacatcatgctatgtaacaaggcaatgacactctcaaggttagaggccttggtagcctcttatcgtgtgcttctctggcctctaggggctgacattcaccctacgccctggcgaggtgacggcgctggtgggacccaatgggtctgggaagagcacagtggctgccctgctgcagaatctgtaccagcccaccgggggacagctgctgttggatgggaagccccttccccaatatgagcaccgctacctgcacaggcaggtatggaagcaggtggcttgaaggagggcagggagcatcaaatacgaagagcattcttactgagcactctgaaagaggggttagggaatgataagagaccttgggtggagatggtggtgtagtcaggagggaggtagtatgattttgtgacatgttctcaataaagattttgagtcttcgatctctagataaccatactcccatgtgccttgttctatgactcttcatcatatttcatctcaggtggctgcagtgggacaagagccacaggtatttggaagaagtcttcaagaaaatattgcctatggcctgacccagaagccaactatggaggaaatcacagctgctgcagtaaagtctggggcccatagtttcatctctggactccctcagggctatgacacaggtactctctccactcatctcaccacccagccatctttacctttgctgaaaccccagtagtcttgcctttatccttcagttcctccttactcatggacatcaatttgaagttgtaagatcatgctcctatggcttcttcatcctgacatcctcaggattctgttcatcttcccagaatctcccctatccagctacaaccgtcagatcttggtgtgtgtgagtgcgtgaatgcatgagtgtgtctgtgtgcatgtacatgcgtgcacacatgtggctataccgttctcatcttggccctttgctctgcagaggtagacgaggctgggagccagctgtcagggggtcagcgacaggcagtggcgttggcccgagcattgatccggaaaccgtgtgtacttatcctggatgatgccaccagtgccctggatgcaaacagccagttacaggtgaggcagtcatcttcttaatggctatatcccacccaatcttgcttcttttatacatcttctgttagttttactaacatcataattatacaaaccagtccttgcagttctcagttcccaaatccagttccattggatgcctccccaaggagtagagatagaagacgaggcaaagacacctagaatcagttaaaagagactatctacaaactacagactgaatttctttctttctttccttttttttttttaagacagtgtctcactcagttgcccaggctggagcgcagtggcacaatcttggctcactgcagcttcaacctgctgggctcaagcgattctcccctcagcctcccgagtagctgggactacaggtgtacaccactatgcctggttgacttttatatttttagtagagatgggtttcaccatgttgcccaggctggccttgaattcctgagctcaggtaatctgcccccctcagcctcccaaagggctggggttataggtgtgagccactgcgcccagtcctatagactgaatttctaaagcgaaacataaggaaaagaccatcctcataatatcgtttatttaaaaaaattattttttgtacagacagcgtcccgctatgttgcccaggctggccttgaactcctgggcccaagtgatcctccctccttgacctcccaaagtgctaggattataggcatgagccaccgggcccagcccatcctaatcatattaatattaattaagctagtctgtttacatgcactgtcactcatttattcattaggaatccttctgagctaggcatttatcatcattctacagatgacaaaatggaggttaaaagaggttgaataagctgctcatatagaggtcatatagcttttgagtggcgcagccttgacccaaattcaggtctgcctgacttgaatgctcatctctttactactaagttatatttccttaaaatcgaatataaaaatgccaagtccatgggtagagaagaggactattcaatagtctttattcttctgtcacgtgtttcaccctagggttctcatttttatcctacttttgcacccttcatgtaaaacagtccttaatgaaacaaagggtttgcggagaagtactcagaatgggaaacgttggtgtccttggggttgttagcagagccagcagtgatcctgtgaggtcagtcccagccctggaaacacaggtgtctccctgggctgagggtagtccccggctctgacggtccgatgtctttcctcaggtggagcagctcctgtacgaaagccctgagcggtactcccgctcagtgcttctcatcacccagcacctcagcctggtggagcaggctgaccacatcctctttctggaaggaggcgctatccgggaggggggaacccaccagcagctcatggagaaaaaggggtgctactgggccatggtgcaggctcctgcagatgctccagaatgaaagccttctcagacctgcgcactccatctccctcccttttcttctctctgtggtggagaaccacagctgcagagtaggcagctgcctccaggatgagttacttgaaatttgccttgagtgtgttacctcctttccaagctcctcgtgataatgcagacttcctggagtacaaacacaggatttgtaattccttactgtaacggagtttagagccagggctgatgctttggtgtggccagcactctgaaactgagaaatgttcagaatgtacggaaagatgatcagctattttcaacataactgaaggcatatgctggcccataaacaccctgtaggttcttgatatttataataaaattggtgttttgtactgtggtttcttatgtttccggcacaccaaacggcccactgccttttgcagcgcacttttcagctgcggatgtctcctcttttatcatcctcaatgttttaccccctaactgcatcaccttttcccttaagctttttaattcctatgaggccccttccacttcccctatccccttaggcccacccccaagaatgtgcaagaccccagccacagggcccatcagggcactagcggccgcagctcagagccgtggcctctccgaagtggcagatggggcgggcgcggccagagcaagtgccaggcgggaacagagggactgggcgcgcctcacaactcaccacctcgcccgctggtccttcctggctcgcctggctctgaagctgcacctggaggggaaacctcararcagtaggcgggattgcctagtaaatatctcccattcagggaggcccaggtcrtgtgacgtcgacagttgctgggtagatgaggccaacacaggttgcaagaagaggcggggtttagaggcgtgaaactccgcagtgctcagccaagcagggagcaacgctaggaagggcgggcagaaagggcacgctcttgtgggtgactacaggttaggagaccgttgaacctggaggggccctaggatggaccccgtggaaagattcagagactgcgccctctccctggcgccgccttcccctacacgcggcgggtatattctgttgcagttggcccaggacctgtttccaagactctgccccctcgcacttccgtccctcctggttttgtaaagtgatgctcataggaacccccaccccgcgtgacactactcccagctcctggctgacttctagtcttctggttgaagctgcgcctttagatgacacgaccctacccacccctgtttccagcggatgcccgggcctggaggtacctcttactgtaacccatcgccaagtgggcttttgaaggcgcctgttcctttctcgctttcttcggaagacccttgacccatcattcccccgacccccataacgggagagcagagaagccggtccccagtgtgatggtcctggtccaggcactaactgtccttttctcggaaaaggcagggggatgtggaaaagagtcttgttccctccccttcgatctgtggctttcgctttcacttcctcctccgagagcggacagatctctgggtgctgggcggtcatggcgctactagatgtatgcggagccccccgagggcagcggccggaatcggctctcccggttgcgggaagcgggcgtcgctcggacccaggacactacagtttctctatgcgatctccagagctcgcyttaccccggggaatgmaggtcggggcagtagggaagcccctagggatgcagggaggcgggcgctgaggagtggagggtcgcctgagaggaggaggcgagagcgggagcgcggggkacagggtcgggggtagccttcagtcccggagagcgccagacccaaagaagaggccacatggggatggggcctgagaggaggaagtgcaagttaggacaaagagttacaggtgaggtgggggctcccaaaggaagacaagagaactttcctgcccttgtccacacacaaatggtggagcctttttcatggggttatcacatgatataggaggtgtgtggtgtcttgggaaacctatgaaatttgcctgctggcctcctctcagcaactcactgttgcgcgacttagaacaagtcacttagtctaggtcccaagcccctcttctgtaaagtgaggatactgttactaaacgtgttttgtgagggttgaatgctttatgcatggaagaaaccctttaagtcactctcaaaattttttagtaatggtaacatgtgcttgctttcatttctgttgtgctggaaaatggaaaaggttgatactggcatgcctcttcttttccttctcccaagccatttccttctagagattggttattaactgtttcatttattgatggttagatcatttctgcatatctcctcaccctcatactccctaaaaccttttcctggagcctcttactacagaatttttcattgcctttctcaacctcttttctcttatcagcccacagaattcttccagtccctgggtggggacggagaaaggaacgttcagattgagatggcccatggcaccaccacgctcgccttcaagttccagcatggagtgattgcagcagtggattctcgggcctcagctgggtcctacattagtgagtgtatacgctccagcaggcagaatctggggagctgggctctcctttccacaggaggccaactctgcaacaaagtggaagtggatattgatttaggacacactgggggatctatggggtcatcccttctctcccaaagctccatcttcttccaggtgccttacgggtgaacaaggtgattgagattaacccttacctgcttggcaccatgtctggctgtgcagcagactgtcagtactgggagcgcctgctggccaaggaatgcaggtaagygaggcctctcatcttcctttcttagcctagtggttaatccctggatctctcagatcattgctccttactcttgtcctatgtggtccatcttagtgctaatagtatatttcacaaaacagctttytggtgataagacccttctcccaaatctcagcctgtgctccactcataagccagatagtacgtcaggtatttagcactgacacatccaccctggcgggacagtatcatttactaggctgcctttgtatgtttcagatactttaaattccaaatctttctctgatctttagatmctacaaaataattcctttccaaygcttatctctttaatcatttcctgccccatcaagttggaaagagctaacctctctttcctcactccaccttgtcctcacccaggctgtactatctgcgaaatggagaacgtatttcagtgtcggcagcctccaagctgctgtccaacatgatgtgccagtaccggggcatgggcctctctatgggcagtatgatctgtggctgggataagaaggtgggtgctctccattcttcatgytcccccaccatgttccctatggatgacagatctgtttcycatcatatactcctactccctccctgacaagatgcatggcatatagagtgcttggttatagaactgtttcagtatatccatggactatttattggcccagatatgaatcattgcatgtgttttgtaagcttgtcccttttgttaaacagttgatttcaagtttgtttttcctttttcatttctaaagttcgatgactttaccaaagtggtttcctaattccaatgttcttgtggtaatattaattcttttgttcactttttatgtmtcatatttgaaccyccatgttaccaacatcttcctctccaatttcagcctgaaatctttcatcttatagggtcctggactctactacgtggatgaacatgggactcggctctcaggaaatatgttctccacgggtagtgggaacacttatgcctacggggtcatggacagtggctatcggcctaatcttagccctgaagaggcctatgaccttggccgcagggctattgcttatgccactcacagagacagctattctggaggcgttgtcaatagtaagagaccaatgctcccaccaccatgcctgggaggagtcggcgggtggtggggggggtgatttaagattgagaaaccagcctkgccaacatggcgaaaccccgtctctactaaaactacaaaaattagccggacgtggtgacgggtgcctgtagtcccagctacttgggaggctgaggcaggagaatcacttgaacctgggaggtggagcttgcagtgagccaagatggcgccactgcattccagtctgggccacagagtgagactccttctcaaaagaaaaaaaagaaaatgattgagagactcaaaggagggagagtagtagggaggaaattttcagagtcagaagaagggcattaaaggcccagtcatatggttttaagcttgcgcatgtgtcttgttgctgccttcaacataacatcagtgacaggaacttgctgaggtgaaaggtgactccatgttcttttctcatttgtccacagtgtaccacatgaaggaagatggttgggtgaaagtagaaagtacagatgtcagtgacctgctgcaccagtaccgggaagccaatcaataatggtggtggtggcagctgggcaggtctcctctgggaggtyttggccgactcagggacctaagccacgttaagtccaaggagaagaagaggcctagcctgagccaaagagagagtacgggctcagcagccagaggaggccggtgaagtgcatcttctgcgtgttctctatttgaacaagcatttcccccagggaagtttctgggtgccccactaagtagaataaagaaaaacggttataaatacctctgtcttgtggctgaatggggttgggcctgtggttgttgggtggggcagaaagtaaagagacgctttttctggagaaggggctcagacccctatctaagaaatgtggcctcaccacatagttcttcctggggtttccttccacactcatctctccaagacctcaggaaggctgctcattgctgtccatggacacttgtttgcaatttcacataggttagggtcctttccatagagaggcacctggggactcctgtgtgttccattgttaatggtttgaggaacagggagtagggcacctaggataactgtttttgactttatagagtaggatgaaaaagcttccacttcactttaatatggtaatcatataaacaccataccatttatcccaaataacactttggagatattggatattgaatataaagacagacattaagggtctaatttcatgatgtgtcatgctgaattgcaagatggcaggactataattttagaggaagaagagatcaggaggactcccctaagtgaggagtgtggggaaaatgtaaaagatccaggttagaagaaagagacacacatcatgagattttcggaatcatgctggaactatggaccatgtcactttccagaaaataaaggaaacaaatgcttgaaagtaggagcatgagcttgagcatggagcttttttcattagagagagattcttaaaatgccagaatgaatagagttgtaaaactttagcgagcccctacttaaaatccctcctccccaccaccactattttaaactttaagtgactccttggtagtcacacaggtaacatttcaaaatggtgatctggaatccaagcgacccttcctttggggaatttgtttgtttgtttgtttttagtttgggaggtggtttcaatctgaagagtcctttctggaataaacgaatctttctgttgcataggaaggctctgggtcaggaaggatatttaaaaacctaattactgttctaaacagtgttaaaatagaacaagaaccaaagctcagtacggggcatttccctcataggctgaaggtgcgcccaacataatttggagtacagactcagaggcacctgaacacgcgccagctcaaggtgctccggctgagaaggacggatgaagatgaacgctcagggcctactaaattcaaagtctgtacgtgaaaatcccctttggcctggtgagattggttggaaccttctatttaggagagcccggctcgctcgcctaaaactggagcttgcatggaagagggcactttttttttttttagacgaagtctcactcttgtcgcccaggctggagtgcaatgacccgatctcggctcactgaaacctctgcctcctgagttcaagcgattcccctgcctcagcctcccgagtagctgggattacaggcgtccgccaccacgccctggctaatttttgtatttttagtagagacagggtttcaccatgttggccaggctggtctcgaacccctgacctcaggcgatccgcccgcctcggcctcccaaagtgctgtgattacaggcgtgagccaccgcgccggaccagaaagaaggcacttcttaatagtaggctcagagcttgaagtagtaactttgagaaaattcagtgattctccaattacaaagcattctccaattacaaagcaaggacaacagataaagttgcccttgagacaactgtattttacttaatgataaagaaacatttttgcagttttatatcccagagtaaccgccactaaaggcgagtgagactcattgcaggcctgtacagtgcgaaccagagttcgggctccagttccgctgtctgcgggtctcgcgcgccccctcccggcggcccagcccagaatgaaggccttggctggggaagcgaaagcgaaagctgcccgagccctgacgcccgccctggccgagcgtagctggcggaccagagccggtagcgaggttgggagagacggagcggacctcagcgctgaagcagaagtccccggagctgcggtctccccgccgcggctggtgagttggtgcggaggggaacctggagcgccaacagggacgcagcccaagtgactacccactccacgctcctgcttcccagtccctctgcacccggcgataggagggagcggagcccggaccacttagctcgccgcggcaggcgggggtgggggtgggggtccggggattttttttttttttttttttaagcacgaggctcctgatggtcatgcttccagctccccagaaggccgaaagctgtctgtcgtaggaggggtgtacggatgagcaccggttactcaggagagctctcagggttgaataggataaaatgagaagccgatggacgggttaggcggagccgggcgggtaggagggcagggacaaggattgggactccacccccatgatttctcatctcgtatccgttgacagagccatgcggctccctgacctgagaccctggacctccctgctgctggtggacgcggctttactgtggctgcttcagggccctctggggactttgcttcctcaagggctgccaggactatggctggaggggaccctgcggctgggagggctgtgggggctgctaaagctaagagggctgctgggatttgtggggacactgctgctcccgctctgtctggccacccccctgactgtctccctgagagccctggtcgcgggggcctcacgtgctcccccagccagagtcgcttcagccccttggagctggctgctggtggggtacggggctgcggggctcagctggtcactgtgggctgttctgagccctcctggagcccaggagaaggagcaggaccaggtgaacaacaaagtcttgatgtggaggctgctgaagctctccaggccggacctgcctctcctcgttgccgccttcttcttccttgtccttgctgttttgggtgagtcaggagaggacgttgtgagttggaggtggtaaaagggcctgggcaccagcacattcttgtgttatttttcatgcctctttcaggtgagacattaatccctcactattctggtcgtgtgattgacatcctgggaggtgattttgacccccatgcctttgccagtgccatcttcttcatgtgcctcttctcctttggcaggtaggtggtgggcagctgggtccatttgctagccccaaatctttataggggtcttcacttccctaactccatttctaggccctttcaggcgcaaaacacaaaaatacttaaactaaaatatggtgaatgtagtcaccattctgtttcatctatccattcatttcttccttcgttcatattcatccaatatcttcaaagtttatctgatcttattataggaacaagttatgagtgaaggtagtacaaaaggaatttaagtctcagatggaatgtctctcagttgtctctcaacattcctaggtccatgaaattccatttctttctgcctcctacctcctacccctaagtctgtctccaaagtatctctccagggtcactctctcaggatgggtatgcttctccctctcactcttctttcccagctcatcttgctaatccctgaagatcttactctgaggcttatcacctttctttccagaatcattactcttttcccttcacttgctttcctttctctttctagacatactcaaacaaacaaactgtttgataaggctgggactgggatgaggtgagcgaggcacctggggtgcaaagtttaaggaggtgtgcactcaccttacccaaatcccagccggcctgattgtctctatttttatggtcatacttaatttagagtaccctcgaaaaccatttcattgtgccttcattccatcctggctgctttctgctgaaactacagtcgtgcactgcataacgatgtttaggtcaatgatgggccacatataagatggtggacccacaagattataataccatatttttactgtaccttttctatgtttagatacacaaatacttacttctgtgttacagtcgcccacagtgttaggtgcagtcatatgttgtacagatttgtagcctaggagcaataggctaaactacatggcctaggtgtgcagtaggctatgacatctaggtttgtgtaagtacactctatgatgttcatacaacgatgaaaccatctaacgacacatttctcagaacacatccctgtcattaaagtacaaaccctcattatatcatgtctgactattccaaacgcctcttcaatatggtaactaaatttgtattagaaacatatattttgtaaaatacatgcttttatgctttatattttttcctctaagtgttactgtagcatgtagttggtctaagagggattttccaactcgaaggatgacagatgggaatcacatgactctggggctccagagaattgtgggggcagggaatttattattgcagttcccatgatgaagtatctatgatgacagagaagggctttgggtatggggcaggaaggagaccaaggcggaggagacgcacagagggacaagcctgagggacgctgggacagaagcaagcactgggatacttgttttcacaatatcttttcccttctattgtagtcttctattgtgtctagtacagagtgcactccataaatacttgtaaatttgtacatgttatgattttgttctcacatctagctcaccatgtctcctctttcttcttcctctgtgtattccttacctcttctctctctgtgtgtctgtctctcatttctttctcttttgcccctcctggcatgctttcccctgactttgcgcttctctgcactcctggcttgctcctctgtttcacccgctggcttgctccttctctgcatctccctcccctcttattctcctaccccacagctcactgtctgcaggctgccgaggaggctgcttcacctacaccatgtctcgaatcaacttgcggatccgggagcagcttttctcctccctgctgcgccaggacctcggtttcttccaggagactaagacaggtggggcctggagtccaggtctgagattcccatggacatcccttgcccctcagtgaccttccacccacagcctctcctcctgccttcacccgtatgccaggacctggggatgcttttctcttgtttgggacagggtggagaagcagcctccactgtccctctgcaagtgaaggaggatgttcagaggagggggctgtgtcagagggaacggtcaggagggagtttctgggggccctgcagtacacatggtttcctttttcctcacctgctctgtccttcttaggggagctgaactcacggctgagctcggataccaccctgatgagtaactggcttcctttaaatgccaatgtgctcttgcgaagcctggtgaaagtggtggggctgtatggcttcatgctcagcatatcgcctcgactcaccctcctttctctgctgcacatgcccttcacaatagcagcggagaaggtgtacaacacccgccatcaggtgagcgtgcatgtaagggaaccccaaagggagaataaaactgacaggtgaggaggcttccacatttgtggctagaggatcccctagagagagatgttctcttctcagccattaggggagaaggtatattgtagtatatactacattttgtttgtccagccatccaacaatggatatttgacttcagaagattcatgattctccagaactgtaaacaaaaatgtaaagtgtatgtgaaggtatgggggagggaataggaaggggagatgataggcgatgataacttttcattagcttctcaaaggagtctgtacatcccccgcccccactgcgaagattaaaaatggtttcttagaggcttttaggcagggagattttccctttaaaatcagcagaagaagtctggatgcagcatagggaaaggaggcgtcatca

SEQ ID NO: 17597 - DNA, 28786 bp, Homo sapiens
  misc_feature (1)...(28786): n = A,T,C or G, or insertion/deletion polymorphism (see Tables 1-2)
tatgaatataaaaaggaagaaggtaagaggtcaaaggaaggacatatggggaagaagaaggagcaacaccataaaggaaataatacagagcagatgagcagttataaaaagaaaggagcaaagaacaaaatgaaaagtttatcactgataagtcaagctgcttcctggtctttgaaagtctgggcatcctgaccctacacaatagtaatagtaacaatgacagctaacatttgttgagcacttacttgtgccaggcatccttctaaatactttacatatttcactcgctgaattgtcacaataaccctatgaagcaaatacatatcatacattttacaggtaaggaaatgcagggaagttacatattaataacttgctaaggtcatacggctactggcggaactagtagagaggttttctctcccattaagatcttaatttttctatgacacagatgtaaaattgtttttagagtcatgggggtgggggaatggacattttctttttcttattatagaaaaggtagaaaaaaatacaaaattgagaggaagaagaaaatatccttcaaattttagggctcttgacagttttaaagtttctgtcttagtttatgaacatgaaactgtagaatgtatagctttgttgataatatttttcatttggggcatataaattcaaaagtacagtacagttattttggcatttgttccaaacttttgtttcctttttaaaaatatttcaacatttattttatgttcaggagtacatgtgcaggtttgttgtataggtaaactcatgacttgggggtttagtgtacagattatttcatcacacaggtactaagcattctaaacttttcttacatttatattttgatttttgttttagaggccaactagaaattattgctgagtttggaacacctgtaggatttaatttattttgtttcttagtctttattagtttgtaagaattagcaaagataagaggataaaagcaactattatcatgaaagaaaacgatgaatgtgtatgtgaaagtctgggtttagaatgataaatgcatcagagtgagaaggaactacgggactcttctgctctcacctcccaactcacagatttccctgtgagttttcagccctgacatgtggggacccagtctgtgcttggccacttacagtgacaggagaatgactccttgccactgtaattgtaagtgtctagagggtatgacctgtgtcttatttttcactgagaatgactccctgacacagtaagtggccaagcaaagagtggtatttgaaactaaacaaaacaaatcctataggtatttcactaggaaacttagcttgctcctcagtttaaaggactcaaaggactcatcaggaaaaagagggtaaaataaaaagacacaaagtcctctagcagttattggaaactcatcttcttaatacatgaatgtcccttgtactttttaaaatgctttttaaaaaacactttcacaagttctgcagtccaaagatcagccagctatggaacagattatttttcttcaaaatatcatttccattcagacaaaaatatgtattaaaagactactatatgtcaaacactgttagatgctaaatacccaaataaaaataatacatacgtcctgttctgcagacgcgtataagtcacagaaggaaacacaagtgacaggacaacagcaggttcagaaggataagtgcagatacgtaggtatacacaagatgcgaccaaacagcacatcagggaaggcttcctggggaacagatggcttcaatgtaggcattcagaaaacagggcaaaagccacttctctcagggaagacagcctgaccgggagaagatactgagtttactgtggggctattgcacttagaagacctgaaagtcatctaaggagaaataatacatagatatttgtggattatgggtggtctcaggagaggaatttaggccatagaactgagagtcattagtggcaggtgcaggttaaataagattttccaggaagagtgccaaaaatcagaattgccgagatctcagggtataatgagagaacatgatagttaagaggtggtttaaaagatgataaggaggatccaggtaaacaggagaaaaataaggacagggtagttcatcagaaagaagtggattatagtgcaaatgttattagtaactcaagtcagaggcactgagaagaacccactgaatttgaccttctgtagaggttcctgatggccaagatgagaggatcctcagggatgtaccagagacaagtcagaagcttagctccacgtgtgaggacacaaagaaagtgtctctgggacaggatgcagactgaaggcaaggttgttttttatcagttggtttgcacttatgtttttaaggtaaatgacatgtttaaatgttaagagactgggcagggaagccctgaagagacagctgagctcattaggaatttctaccaagaatactaaaaagtatttgcatctatgaagagaagcctattgtggtgtttattataacataacattagaaataactcaggtgaccgcgaacagggcaatagatacttctggttctacccagcctgacctcctctttattctacacatcttaaataaaactgtctgaagccagtgtgcatcttgtacgttatggattctaaccttccccatcactagattttggaatgacagcatcatgcacaggcttgatgtcattctccctgatttcagctacaggaaaaaggagcattcactacggtccatctctggctgagtccttgcagctatcaaaagtctaggcctcccttgcagtcctgaatctctcagaacccgaatcacaaggctatcaagaccatgcaaccctgctgtcttgagagaggaaagcttgtgaccacccacaaagacccaggaagagccctagggtcctagaagagagggaggatacagaaacactctttgcacttcgtctcctaatgcagagtccatagctcggagttcctgtaaagcagccacaaaagatagaggctggggatcccagagagataggagggccctgatagtaggtcactgtgtgcaggaatctggggaaggcagtgtatgaccctcagagctgggtctggacttcaaacttggctcgttgatctgctgtgtaaccttggaaaacttattcatctttttgagcttcagttttttcaaaataatttctaaataaaaggaataatttctaaatgaatggaatattatcttcattgaagattcctgtgagatgtaaatggggaaagaaactatgcaggagtctcataaattctggctgttattgctgttattattatgagggccagagggaacatagactatgaggaccagatagatcaatgagcccctaaaatctgtgatccctgaagcagcaattgatgtgaaccaccccatcactcaccccgacgctcctgcgtcctcctgagcactcacccttgatggccccagctcctcggagactcagcaggaaagccaaggagagggctctcaagatcacagctctgatatggaacattctgtcttcagggcgcatgttgtggggtctataattgatgactgtgagcacaggaacagtgatgaggaactgaggccgagtggaggcagatgagactgaaactgtgggcctctagcactggaaatgggtggagaggaatcagcatggctgggattcacctatcagagaaatcatagagctgacattctctgttgctgggtaaagaggacgctggaaggtgctggggaagagatgggagaattttaggtaccagcgtggtcaagagagctccagttcacagttcattttcagagttagagaaagagatgtaaaaagataagttacaccttcttctgacggcaaatgttttccattatgttccttctcccgagccccacccccatcccagacagtcagatgatctttgatgttttttggtcactatattttaaatcatgttttatgttatgttgtcaatattttacaaaaatattctgctgataattaagaatgaatgtgctatctaataaaatatataattaatctttctttcaggtccacctccctgagatacctcctttttatttaatcatttctgcagaagtgttataatttctatttagaggttttaattaacttgaatgaagttgatctttaattgtttatctattcctggttacctttgttagtgaaatttctagataatttttatttttcagatttcttagtatttgatttttcctggtatttaaacagtgtaataacatttttatctttaaattactagtcttgttatttcattttcatataagaatacccaggacagcattacctgtggtaacaatgtgcgcccatattttgatcttgtttttaagaagggtttctctaatgtttttctgttacaggtaatgttaattttttattttatattctctttaccatatttaagaaatacttttctagtctcattttaaatatttcaattttgagctatttatttgatactcatagagaaggtcacaaaacatttactatttaatgtaatgatgaagtacatatattacgttaatattttatcttatttgtggtagccttaccttgcataaataataattactaacagattaggacatgagagattctgttattagtgctttgcatgcattacctcatttaaacctcatattaaacctgagggaggtattattaatgtctactgtaaaaataaattacctgagacatcgaggaagtatttgtctaattatctatggcaggtaaatgacaaggagaaaagtcccacccaggcagttactaaaaaaactgagtttttctccacaatcctctcctggccccttaatcctactagacaccttctactacataattattttcttctcttgcattttacatgctagccttctatttacattttaatattgatttaaagaaatgatgccaatttgattttttttgaaattagaattggtggtccaacaggatcacatttataagtgtctaaagtaagaagtaatgttctttgaaagtttgtaaaaatattcactctaaacaaaatagaatcagatgctttgaaggaggtggggtctttgatgattttttttcactttcttccttatttaccagtcaatttatattctctatggactttatttttccaaagcaatttcagacctattgatctcatttgatcttaagagctttgctataaggcaggttatatcatccccatattgaagacaaggaatcgaagtccaagagaggcagtgtcgttaaagctgcatatttacatggtagggtaggtggtgtgtccacgctcccagtgtaaggtccctagactgagccctcctgaccctgatgacagtcctgtggaagaacctggtaactcctgcacatcgcaggactcacagacctctgggagaaagtaaatatgaatgggtgctaatcttaaacacacccttggacaaaggcaagacagacagactcagacctcatttgagttctgagatgggtactctaatccctctaagtcatgccactgaatgaccttttacacactaagatagcactttttccacaacagaccatgtcctgtgggtgtgtgaggtgtggcagaattggggaaatgataatccctgtagatgggccagcagaatatttgagatcaccttcagagcaaagaaaacgcataatctccccaaacatcatgacttatctgactggttaaaatgagtatcactgtctttcctccgtcatcttaagtgcatcacaggctttatattttcagacctttcatactaactttctgcctagtgagcaatgactcatacaaagctcagtgtccattggttcttttctcagactctgtccaatcccagggtcacagaagactacttgggttcatggtctctaatatttcaaacaggagctccctttagcgagtccttcttttcctgactgcagctctttycattttgccatccttttccagctccatgatggttctgcaggtttctgcggccccccggacagtggctctgacggcgttactgatggtgctgctcacatctgtggtccagggcagggccactccaggtaagagccgarctgccattcttggagggtctrgctcagggaacaattcctaggggacgttatctttaagggatcaaattctgagacaggctgcgggggctcctgccctaaggcagtgtcctctcttcccagctagagaaagaggttcatcccctataggatagcttgctaccctactggcctattctctctccaaggacatgggtacagtaaacagagagaggtgcccagtggtcagtgcttgtctttggggaaaatgggaccaagaggtccwggataaccttggacagacaaggtttgcasagagagaagttggcaagtgcaggctcctgggcgtgttcayrtctgcatccagcctggaggggactcaggcagagagccctaagctggagtgtccaggctctgaggatcactgaggattcagtgctcacgaagaatgcctcttattccccagggtggagcaggagcccacaycccttggacaattaaggagagaagggagggagggggataggttttagcccctgaaggcattctcattaaaggtacttctcccagcctccccagaacttggttagggtactagagtgggttgcgacttgtaggaagaatgagatgaggttgtgtgggtgcatgacagggattgagtgtaggttatcagacagccaaggaagcagtaaccaagtgaaaaatctcttcttcctgctgcctccctgtggctggtgtaatattatggcatctatgatccattgtttttctctcaggatactctcaggatatttctttttatatatatatatactttaagttctagggtacatgtgcacaacgtgcaggtttgttacatatgtatacatgtgccatgttggtgtgctgcacccattaactcgtcatttacattaggtatatttcctaatgctatccctcccccctccccccaccccacaacaggccccggtgtatgatgttccccttcctgtgtccatgtgttctcattgttcagttcccacctatgagtgagaacatgtggtctttggttttttgtccttgcaatagtttgctgtgaatgatgrtttccagcttcctccatgtccctacaaaggacatgaactcatccttttttatgrctgcacagtattccatggtgtatatgtgtgcattttcttaatccagtctatcactgatggacagttgggttggttccaagtctttgctattgtgaatagtgccgcwataaacatatgtgtgcatgtgtctttatagcagcatgatttataatcctttgggtatatayccagtaatgggatggctgggtcaaatggtatttctagttctagatcyttgaggaattgccacactgtcttgagataccatctcacaccagttaaaatggcgatcattaaaaagtcaggaaacaacaggtgctggagaggatgtggagaaataggaacacttttactctgttggtgggactgtaaactagttcaaccattgtactctcaggacatttctagtccaaatttacaccaacactctgagaggaaggactgcaaagtaggtaccttagttttccactgacttccacytttcctgcttacacccttcctcctagacctctccacacccctcctaggacacacctaraaggtactgacatcatgtcacctcctcatctttcagggtagcaaggttggaatctcctgaatacagcccctcaagccctaaaacctcttatctattaccttgggttcattgtccaggaaggggaggagaacttgaacttrtagtcacagaagggtgctgagaactaaccagcaggacggctcagccctgggaactgcagaggggtgaggctggggagagaggaggctggagcagcactggtgacactgaacagtgtcaggaggargtgacggatgcrgcryccccatcccataggcagagctgtcatgtgggatgagggacagtgttgggagccaccaaggaaacccagaggtgggggagcagagagcagaagggrgcatgtgatgctggrcagtgaaagggaggacrggcaaaggctgggttgaggtttgtagggggaatgagatgaggcagtggagccatgtgacagggactgagggtagattactggagctccctgcgtagaatgaatgttcaatcaaaayytgctggagggagagctggagccataggggagtgggtaaagtgggcagggctgattccacaattccctgcatgctcccccaactccacacacatccccaacctcaaacagggcacaagaccaaagggctgaggagccaggctatagcttaaagaggctgggggagaaaagcttggctgagacaacccatagggagctagaggtttttaatatatcctattctgaataagagacgaattcattcagatcagtggtttcaaaccgtgctctgggcaactcaattgctaagggttccacaaacaggataaagtttcttatatacaaaaaaaaatgaaggtttcaaattacaccataaaacccctcattgcttatgtctacttggcaggtaaaattccatttcaaaagttaaatgtacttaaaaaattacctaagactgggtaaattaaaaaaattaaatgttgcaaagaaaaaattcaaaattcttattcttgaatgaaaaacgttctcttactggtgattgaggaggagaaacaaagactaacaaatgaaaatgggagaatccacactcagagtggggcaaytgaacaggcaggggcggatggatggcagaggaggaggaatctggactcaaggagctggggggcyctgggcctggaatttyagggtctggsgcccaasgcaccaggagaagaggcaggtcaggatatctgagtcaagacctgggatcttgccttagcaatgacactggagactaaaggtggactccatggtgcccttgagcccagccctaccccatctccactatcctctgccaccagctgtgcaacttctgcwaggggtgaggttaataaactggagaagttaatttgtggagcatgaaacagatgagcagaacaatcacagcaccttaatttccccagtgtgcccaagaacagagcaggcctgaagayactcaaacagaaacaaacatgtgccgtgtcactgataattctgtgtagacacacacctgccagacactgctcatggcactccctaggaagaacagcatgtgggaaaggctgccaaaattgttcatgtaaaaattacatcaatgctgtcttcctcggtgctgcctatgcagctggcagccatctcttcctccacatcatggcctccctcagactcctcatgaaggataagatcctcaaaaagaggaccaacaagttcatgaggcaccaatcagactgaaatgtcaaaattaagcataactggcggaaacccagaggtcttaacagtagggttcgtagaaggtccaagggccagatcttgatgcccaacattgcttatgggagcaacaacaacaacaaaaaamacatgctgcccagtggcttccagaagtttctggtccacagcctcaaggagctgaaagtgctgctgatgtgcaacaaatcttactgtgctgagatcgctcacaaaatttcctccagaactgcaaagtcatcatggaaagagtcacccagccggccatcagagtcaccaaccccagtaccasggtgcacagctaagaaaatgagtagaaagttcatgtccacgttttgtgtgtaaataaaaccataaaaactgccaaaaaaaattacatcaatgcctctaaacccaaaggactctacccccacaggtccctggttgttgtggtgattttcattgtgtaaaatacttyccacatcttttgacaccaagtctttctgcagccatgtttgaaaattaactttcaggctacagagtctttcttataccaaagttgaagaaagttttaagaaatatatttctacatytcctamatgcaaaacaacaggagcaagttgaggaattctcaagaaactggtcgagaagagagagcgcttagctatggaaaagagaragaaggaagggagggcttcctggaggaggtggcatttgaaccaggactgacatcaggatggaaatgtcagtcagggagttaagtagggggagcagctccgccctccacgtccccagctcctcccgcccctgttttttctcccagtgaccccamgtgaaacgtctccgcctcctccagccaccagcagaagggactgccttcccctcagtgctcgcccctccctagtgatcactcagtgcccctgagctcattcttttcagtaaattctctctctgcrtggtgagaaaacaggcctggagaggctctgcgacccgcttaggaccacagaactcgrtactaggaaaactcctattttaaaatcyagccctgrgtgggwagatttgggaagaatcsttaatattragagagagagggagaaagaggattagatgagagtggcgcctccgctcatgtccgccccctccccgcagagaattacstktwccagkkacggcaggaatgctacgcgtttaatgggacacagcgcttcctggagagatacatctacaaccggsaggagywcgygcgcttcgacagcgacgtgggrgagttccgggcggtgacggagctggggcggcctgmtgmggastactggaacagccagaaggacmtcctggaggagrrgcgggcagtgccggacaggrtrtgcagacacaactacgagctggdcgrgscsrtgaccctgcagcgccgaggtgagtgagggctttgggccggsggtcccagggcagccccgygggcccgtgcccagggcgcaggagcagccgggttggcctaagggaccttagtgccgggcggaaaggggactttgggttggggattcatggggggagcccatctggagcttgtcaggggagcgagcgcggggacctggactgggctgagcatggagtgaggaggacgagagcagagagacccccgggacttcatcaggcctggcagctgactgcatgtggggtgaaaaaaggaagccacaggacagcgcacaagggtatggtgtggagatggaggtggagatggcacagcaggccacacagagaagaaacctacagggaggtagctgggtttgaggtgcttgaggggcagatgggtggtctgatgggcaggtagacagaagggtctgcagccggggaggagactgrgatacatgagaccatccagggagagrggacccagggggaagagcaaaggacyggatcctgggaactggacagttgtgatttggccaagacagaaaagcctgtgaaagagaccaawaaaacccaagtgcagtgtgaggagaggcccgcagagaagagtcttggaagctgaggggaggtgacctcagcagcacagtggacagcggtgccagtgacttgggaaggtcagaaaacagaagatggaaagtgggtttggaaaccagggagacctggggagagcaggttggccgcagcggcaggagctggaatgggagggggtgcatgaggctgagtgtggcgcatcctcctcggggctgagatggattttacttgtcttgggttccccacggctgkcacagggcagtgtctsagttcattcrtctttttccttcaggaagtctgggtgtaaagggatggagagaggtgaggtgtgtgcagtaagaggatttctcaaggatgggacaggaaggccttggagctttggcttcctcctgtgaacttgtggggtggggagcctggtgcaccaacctgagggacytgagggagtagtatcaggatgtgggattgagccctggaccttttttctagaaagaggaaaaaaatgaagggaggaggaggaggaagctggggagatcacacctttgattttcttgttcctggaaagtgaaaggaagttcacctgctatgagtgagaaggtggacacactgggtggggatgaggtgagtgacatgagcttaggaaagttgctgaggtaattggttgagagaggtgttcaaataaaaataacgcaattggcaaaaactgttactaagactttgtagaggcaccaatcagtgacatggcagcattttctttcacagtaatcaactgccagattgcagacagccctgatgccagcctaaggagtgtgggtttctcctccaggcccgcaggtccccaacctcactcctctgaagactcttctggagatcctctgtgatgcacagatctccagactcagtgcccccagactcagattccctgggtggggaggtctggggatctctgcttgtaatcagctccctagaggttcccatgtagccagataagtattgtcagaacactgaagatttttgaaaaatgaaaaagagaaggttggagatgtgtcttcagaagactactaagggtgctggctagaggagggaccagaggcagggagatgaggtaggaaactgctattatttgtcagggaaattgcaatcaaggcatgagttagaacagggaaaacacagaggcaagggagaggtggaagggggaggaaagaagtagtgacaattccagggtggatgtccacccaaatctagaagtaattgagcaaatgttttctgggcattagagaaggcaactagaacaaacaggaatccttgccttggtgaaatgtatttgaactgggtcagaaatgaggccattgggtatcargccttaactccagcgcmccctggaggtcrctgatgtggctccaggctgacctgctcctgtcaaagaatattgagcaagatgcctctcrtggaatgttctgggaccttaaaacagatacccaagtattccccctgatttcatggttcccagaagctctatggggaagaaattgtaggtaattcacaactgagatttagacataagttgaatagtgtaatggacattgagttaaccgaggtaatgaagtagtgagacacaggtgcccctgaaataaactcacattgagggaagaggctgacaatgtggatcagtctgaaaacaaggcaaaaatacaatagggagtaagggttgtgtgtcagttcaagactgtacttttacctggcccagcgccatgttagggtatttgtgttctccaggaagtagaaaggaaagaactgagtgattagggacctagaagactaatttgagacattcctcttgatgagctgttctctagggtagtcctctgaaagagctgttctctagtggatctccctgaatgaactgttctctaggagcacttgacccttttctgtgtttgttttttgttttgtgtttgtgtttgtttttgagacaggttctcactttgtctcccaggctggagtgctgtggcaccatcatggctcactgcagcctcaacctcctgggctcaagtgatcctcctgcctcagcctcccatgtagctagaactacagatacacgtaccaccatgtctggctaatttatttttctttttagagatgggttctcactatgttgcccaggccggtctcaaaaccctgggctcaagtgatcctcatgcctcaacctcccaaagtgctaagattataggcatgaccaccatgcctggccttttctgctttctgaggaggaaaaaggtactggtggcagagatccaaaagaaaagttgccagtggcagtgtggaaattcacctgagaacaacaggacaagctggggcacaaatgcaaagatgcagagggaggcaacacctggtcatctgtgagaccttcatgggacctgaagacgcagcacagaggaggaacttgaaaaaggacgggatttctactactcaagcatgtaggagctcaggatattctgtaaatatgaagattttgagtttttgtaggtgaggtaaaaaaatacataggttttttacagaataagacatgtaaagctctcttcattttctttgtattttcatgaagttattagattcacaggccaccataatgccattgtctgtatatcttaatttcaagatattatttgagtaaattttgcttcctttgtatcaagatagaactttgaaaaggtaggtaatttcacagttgatcaaatattctttgcccaaattacttttggttaaaatttctcctaaatgtgctacagagtgcaaactctgtctccctgccattccgctatatacttactaactattattttattcaagatcatgcatgctctacttgaaggtctatttctatcttttcaatgctacccttacccactagcctaatcacattattcctattttcaacatctaggaatcaattacatagtgaacatgcctaagaaataataatctgggcagatgcagtggctcaggcccgtaatcccagccctttgagaggccgagcgggtggatcacttgaggtcaggcgttggtcaagtgctcctagagaaccagsctgaccaacatggagaaaccttgtctctactaataatacaaaaattagccaggtgaagtggcaggcacctataatcccagctattcgggaggctgaggaaggagaattggttgaagcccggaggtggaggttgcagtgagccaatattgcgccactgcattccagacttggcaacagagtgacactccatctcaacaaaaagaaagaatgaaagaaagaaagagcgagattatgtctcaaaaaaaaggaaggaaggaaggaaggaaggaaggaaggaaggaaggaaggaaggaaagaaggacaatctcaaattctatttcattatttttcttccacgctcctagtccagcctarggtgaaygtttccccctccaagaaggrgcccytgcagcaccacaacctgcttgtctrccacgtgacrgatttctacccagrcagcattcaagtccgatgsttcctgaatggacaggaggaaacagctggggtcgtgtccaccaacctgatccgtaatggagactggaccttccagatcctggwgatgctggaaatgaccccccagcagggagaygtctacayctgccaagtggagcacaccagcmtggayagtcctgtcaccgtggagtggagtgagtctctgatgaccvtctagaccccacctctgaagagcaggggactctctggctctggggtccactcatcttatcttctgcatctataccctggggccatgtccaaaccccatctttcttctataccagctcctgagcatagtttgaagccagggmaatggagacttcctgaccttggcttrggggttcctgaagattcatagttctcccccttgtcagagaatctagggacactgactggtctcgaaaccctcacacttaggaactgacctcacacataggaacagttctcttccttcagcattttagcctcttctcaggcattttgagaggcaacttccagaatcagcatttgccaccttgttgaggtcacacccctgttccagatatgagggtggctctttctgaatttcctcttagcaagctttttccgctgcactgtcctcatcccgatatkctgcatcaggctccagaatctcagacaggacatgagtagggatgcagctggtggaggtgacactaaacctgggtctgtccttcccagaggcacagtctgattctgcccggagtaagacattgacgggagctgggggcttcgtgctggggctcatcatctgtggagtgggcatcttcatgcacaggaggagcaagaaaggtgagaaaagcctgcagggtgagcggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaggtcatgagaatagcagaaagtcttcaaatcgagatcattatgaaatcctcagacccagagcacataaatcctaccctcagagtcactgagcagttaacattacaaattacaaaccatatccagtcagagtcattctctttcctgcttgtctcctgtactcatgttacaggttagggcagtaccccgagtggagtgaacaatctctggactaacacttgtcaggatcagaagctgaggtatctgcacccacattacaggaacaggatatgtgctcctagggaactgagggtgtcaggagatgaggaawgtccctggagtcacagaaagaaggtatcagatgtgtctcactctgacatatgcaggtgtttatgaaactctgggatttctaaggaaggatgcagtgcagagacaggtcccagaggagacargagctgagagaccatccaaactgggaccaccttgtcactagacttcaaattttcaatattkatagagtgttttctaagagtcaggccctttgctgagtgctatgtgcagcaggatcaaaggcagccaggaggtagaggagtcttgaggtacatcagtcattggagttgaagagcagagattcaaaggaaagttggaactggagctttaaaggagatgtgaagtgggtgactcaacctctgactcagaaaaattgatacctgcagaagaaaaaacccggcgggcttaggactcccagctgagtgttgtatcctccatccctttccacctggtcccttcattttctacccctcacagttccctaacgagaaggtggtccacccaacagacaacrctgcctcagatggttatcaaggggtaccctaagaagaaatcatctcaccctctctttgtccccatttgtcaagtagcagtgaggccgagccaggggatggtgaaagtggaaggaggtgggagttgggcattgggtgtgaagatgctctttaaaggggttttaataaccacttgctaccaggccagtgaacacttaycatagttgatgccttttgagcatgttgcattgtaaactgtccctgaaattcctgtgcacttggcttatgggatgaaacatcctcctagttctcttgtctctcagcttctctgaagtctcattgagcaccttctcttcaatttcttttacacagtaagaataggatcagctgtgctaaactaacaaatacccagatatccaggtttggctcatgytacacgtccaaagtaagtcatscaggaagctctgctyatcatcgtactcaggaagycaggctgacagkctttctcctgcacatctgctcccagaacctccccagcagaatgaagggaacctaagaatttattcactggcttttaatgatccctcctagaaagaacacacttctcgcatttcattttccaatgtaaatcatatggctgcaactaacttcaaataagtgggaatacttgaaggtggaaaacatttaagaagtacacactaaataaataataaaatacttctacaagagatatttatggaggacctactgtgtaccaggagcaatgctaggcattatggatatcagcagcctttggctcctgaaaagcttacacactacctcctggcctaaggaggggcacagggatgctggcaacagtctatttcttcacccgggtactagttacatgggtgcttgcggtgataaccattcaacrtacattctattggtttgtgtgtttcttccaaatgtcccctagttcacaataraaagggcttaaatagagaagtaaaggagaatttgggaatttgaagcaaaagcaagaagccactgaatcaagcacaaatattgagctttgataaagattggaataagaaacataataaatgagayaagaaataggacttttgcaactgaagtgtaattaataaacaaaaagccaaactgagaaactgtcccaaggacaatatgatcgagtaaacaatagaaaatgtaaaggacaagtgaagagaaatgaaggatagaaacagacatctgacatcttaataattagacgtctagaaagtcagggaaatagtggaggaagaggaaataactgaaaacataatagatgtttagtctttatagaaagatgaaataagttcattcaaaatgctgcatagaatgtcagaytgttaaacaattttgttagagtaaaatgactgtaaacaaatgagctaattatgtgaattaagaggatggaaaagcagaaaaacagcaaaaagaaaatacatgtaaataataaggacaaaagctgaattcaatgaaatataaaaatagagaagayaaaatcaaattttgaggcaatgaaaactttaatgagacctctggcaagactcctaaggaaaatacaggagattcagaacgaaaagggtaaatgacatttatacacattttaaaatgcaaaatcttacgaccaactctatacatataaatttgaaaatttagataaaamggatacgtttctagaaagatataaaggtcaaaactacaggaagaaatagaaaactaaaatagagtagagaatatcaaagaaattgtcatgggaagcaaagaatcgccttccaaagggccctgtcctgatcttattgcagatgagggygtcctcccacatttccaggagcagatcatgcctcttacacgtgtgattctagaacatagaatggaacagaatttttgagatcattttatgaggttggttcatttrtatttccagagccagctaagaatagtacargagaacaggattgtggactaattttagccatgtcactgaatccaacagtacattayaaaaacaatacgttttgaccaattttagatttattctaggaatgcaatgattcttcagtgtcagaaaatatataatgtggttaacacattagtggactcygcaaaattcatattaatttaaactgaattcagctcaagacatagacagaatttaatcaatttcatgacatgttaaaggtagtgaaccaaaaatctatagcatatatatttcaaagaaatgaggtggattgcctttgagattgtgcaaaagataggatgtccttcgttgctggaaatgtttaacatagcattggaagttctgaacatcactctgcgggcagaagaaaattaaggctgtgtaaaatgtaggaagacagatagtgactgcagatgaaataatctaaatactggacaagactgcagccactgcaggcccaaagcctgggtttaaatccaagctttgcactttgaagctgtgtggtcttcacctctcccggtgtctgattccygctctgtaacatgaaataaataagaaccaacctccagatgtaaataagtgaacacatgagaagcacttagaatagtgcctagaacatagtaagcaactcaatgaatgtcatttctcattacatttgttaatnnnnnnnnnnnnnnnnnnnnccttggcttaggggttcctgaagattcatagttctcccccttgtcagagaatctagggacactgactggtctcgaaaccctcacacttaggaactgacctcacacataggaacagttctcttccttcagcattttagcctcttctcaggcattttgagaggcaacttccagaatcagcatttgccaccttgttgaggtcacacccctgttccagatatgagggtggctctttctgaatttcctcttagcaagctttttccgctgcactgtcctcatcccgatatgctgcatcaggctccagaatctcagacaggacatgagtagggatgcagctggtggaggtgacactaaacctgggtctgtccttcccagaggcacagtctgattctgcccggagtaagacattgacgggagctgggggcttcgtgctggggctcatcatctgtggagtgggcatcttcatgcacaggaggagcaagaaaggtgagaaagcctgcagggtgagcgggacttaccttcccctggcatattcacacttattccacgatgaggggtywgacagaaaagaaatgtcagaaagctctagaggccactgawatcagatartcggggaacaaacatgacctatrgcgagagdgggatcccaggctgggatcttaatgcagccagatgcatgaggtcccaagtactcaggctcctgcggagcgtccattgagtgatgggcaatggaatttggtgggatggaaatgtttctctaattatctgaggtggtttcaatggctgattatataacctttcgtctttcatttcagttcaacgaggatctgcataaacaggtaatattcctgctttgatttccttgtggggtgggttgcaggaggatatgagtcctttctgtgcattgtaacactgaggctcctccaggaagggaatctcaggcatgaacccctctttcaatgtcagccttcaggcaagtggggaaagagcattgcttggctccattgctgaaggaagcagagatcaactctgttatttatcagcctgagacgcatcctctcaccataatttttctctcctggacttacaggaaggaggctggcaacctgggataacttgtcttttacccccacagggttcctgasctcacygaaaagactawtgtgccttaggaaaagcatttgctgtgtttygttarcayctggytccaggacagaccytcarcttccmaakwggatactgctgccaagaagttgctctgaagtcagtttctatcrttctgctctttgattcaaagcactgtttctctcactgggcctccaaccatgttcccttcttcttagcaccacaaataatcaaaacccaacatrastgtttgytttcctttaaaaatatgcaycaaatcrtctctcatyacttttctctgagggttttagtagacagtaggagttaataaagaagttcattttggtttaaacataggaaagaagagaaccatgaaaatggggatatgttaactattgtataatggggcctgttacacatgacactcttctgaattgactgtatttcagtgagctgcccccaaatcaagtttagtgccctcatccatttatgtctcagaccactattcttaactattcaatggtgagcagactgcaaatctgcctgataggacccatattcccacagcactaattcaacatataccttactgagagcatgttttatcattaccattaakaagttaaatgaacatcagaatttaaaatcataaatataatctaatacactttaaccattttctttgtgtgccatcacaaatactccttaaccaaatacggcttggacttttgaatgcatccaatagacgtcatttgtcgtctaagtctgcattcatccaccagcctaggcctcctgtcttaattttcatacagacagaaatgactccccactggggaaagagcaaagcaatacatgtagcactctttttcaaacactggtctttttttttttcttaacaatccaacattgttatgtgttttgcgtctcatattgacaccttttggtcaaggtagaggacatgtttgttgtaagctttctttttcgtgtagaggatggattcttcactcctgatacacacaatcagtgcacagcagctctcttatacatccagttgatgccttcagtctccctggcttcttacaagcatcttctgggccttgtgtgtccctgggcacctgtccctggtcaattcccgaaagctactgtgctcctcttgcccatctccccttgcaaataatatcttccatcgggggaccggcttcctccaatttcaggagaggtggggctgaaggcacagacttgggcgtcactggcacagatataagtaaatacagctggagtctgcagagaggctggactgagtcagggagtcaggaaagagaagccacacacaaggacaaccaatcatgtttctcataatcttcttaacctagggaataggacacaatcattttttctttttaaaacatctttatccctgatcagcctcatttcctcaaaaactataaaggaaaatgctgctgacttgtttttgcgtagtaatttcagctgtcacataataagctaaggaagacagtatatagtaaataaggaccctttatctgtcttattttcccttttggcttcacaggaaacttgtgagaaacctatgcagcataaaattaatatgatttcaatccagggattcaacgatggaaggaggtcatgagaatagcagaaagtcttcaaatcgagatcattatgaaatcctcagacccagagcacataaatcctaccctcagagtcactgagcagttaacattacaaattacaaaccatatccagtcagagtcattctctttcctgcttgtctcctgtactcatgttacaggttagggcagtaccccgagtggagtgaacaatctctggactaacacttgtcaggatcagaagctgaggtatctgcacccacattacaggaacaggatatgtgctcctagggaactgagggtgtcaggagatgaggaatgtccctggagtcacagaaagaaggtatcagatgtgtctcactctgacatatgcaggtgtttatgaaactctgggatttctaaggaaggatgcagtgcagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagtaatgctcaaagagcccctggtgaagtgtttctctttcccactcttcacccctaacttgttacctcgtcttttccactctgtccctaatacacctataggatgactcataggagcccctggacccggggatgctgtcagatcgcttggtctttgagacaatggtgccattaaggacccccgccaggcccaccagcaggccgagggcacagaccagcatctccatggtctcaggcacctggattagttcatggacctctggggcaccaagggaagacagagttataaggtacagagagcaggggctggccttggatgtgggaggtgttgggtattcgaaaccatgagatggtgaaatttggataaagtgaccataaaacatgggattgaggaaggcaggtgctgaggggcgatgggcccaggaaataaaggtggtgccaaggccgtgagggcagagggagggcgctccataccccagtgcctgaggagaggctggtgcaggccccagtgctccccctggaggtcacaggtgtcctcggccatgggaacgagggtcagatagtggaacctgtgtaatctgagtttcttgctgggcaggaagatggtctctgcaataccctcaatgactggctccccattgcgcagccacgtgatgttcagcactggtgggaagaacttgtcaacatggcagacgagggtgttgggctggcccagatccacaggctccttgggaaagacgcttacctcggtgggggctccaaaaggggatagaacccaaggagcctactgccattggctgattcttaaaggttccaccaccccaagtcctatattcaccagattaggggccacctctcccaggcccatcctcctgctcccctagggctcctggacagggtcacagcttctcgtgctcctgacctggccccctcagcccagcctttctcttgagtaagaagaaaatgcctcctcctctgctgtcctaagaacccagctgtgtggacccaagatttctcgctctcagggaaggggctcattcatgagtgggcatcatggcctctagttctatgtgtggcagagaggccctcccatccctccagctggactctagaggaacaggcagctataggcagtgccatttgtggcccaagtctgtttggaccattgatccgggtgttcaagtgcttccttgccatgacgatgccagcaatacccctctgagaggaacaggcagctataggcagtgccatttgtggcccaagtctgtttggaccattgatccgggtgttcaagtgcttccttgccatgacgatgccagcaatacccctctgagcaccaaagtcaaaggtgtgaataaactctggtagaggccagaccatctccttctcatccaggttcacgtagaactgctcctcctcatcaaattcaaacatatactccccagagggtctgtgcgtctgcacaaactccgcatatgttgacacatggtctgctgcatgaaggagaagatggagaatgggtgaatacgtaggatgctacacagaatgcaggaagcaaacaggtaacaggaaggttattgggaacatgaaggaataacacagaaaatgagaaatgcaaatgaaagaaaagaaaaggagtgagaagaaacaaagacagaaatgacccatggacgatataggttgtttcccttgtccctgaagacttaacatccgtctatgataatggtaatgctgaatacagtaagataatatttattgggcacttactatgtgctaaacttactcattgaatcttcacacccccatgtagaagaacttattttccatagtagggaactgaccccagaggtaaagtaacttgtccaagtcacacaactcctggtagaaacaatattgagtagtcctcctacctcattcctgtaggatctcagaaaccctacaggacaatacattaaaaattactgatatagccataaagcaaggcagggaagtggaaggatggaataaatatttcagagtggaacaaaatcgtgaaggacatgaaaatacctccagagtcttagtgacatttatagacttcaagttacattcttacttttagaagaaaaatgataccttctataattttatccacaacacttacattttaggcagagtaaatttaaaagtattatcattcacataacattcacaaaattgtcttgtggagtgtagttttcaagtgtagtttcacctggaaatacaagttgttggcatttgaaagacctatgggatagtatcttagctttacctgatacataagaagcagcaactggttgataacaaaaagtgaattattattacagtgaattacagagagtttagggttcggcctggaagaggaagtgaagccaaatgacactgcatggttggtggtccctaagtgaggatttcccctcccagcccagcatggggagaaccagtcctctacttagatgcatagtgtgacagcaggttcagtgccgcacacggatggtgagggtcccccactgagtttagggtctagaggattactcacctacagaaatgaatcccaaaggaaaaagaaaaatacatggtgtatagactgggctacacagatgtaattggttcagcttaggttactttgtatttattatatttacaaaatctgaaaactaaaggttggcacattttgaagcaaattccacacttcaaatgttaattttcattcagttaataaatgctttttgtgaactttcactctctaggtaataaggatgaaactctaaagatgggaactttgtccttaatctacttgaaattcaagaataaaacagacaaagaaaagatgattgctacatgtgtggtttgatcaccactgagtatcacaaggtatacacaagagctactcaggagcaaaattaaaatacgatttaggaaaggttcctagggacagtgttcacctgcagatagcaaaacagagaaaggggaaatggcatttccagcaggagaagcaggctcaggagcagagaggcatgaagttgcaaggagaactgcagttcttcagtgtgactgaagccaggggagatgtgggccaggcagcactgtaacctgccttgtgtgctgatggcaagtgtttgcattttatcccacaggacataggaagttgtgaagtatcttaagcaggagagtaacacggtcagatttgtgtttggatggggcacctgtaggaaggatgggctggaggaggcgggactcaaggcaagaccagtagcacttttaagccctctggtgggaagtaatgaaggcgtaggccagggcaggaacatggggtgaggaggacagcagatggatttgatggcagtaatgacatgagaggccacaggaatcactaaatcacatgccagaagtagggatatgaagaagtcgagaataaccacgcaacgtggagaattgtggcatccgtgcctgcaaaggtgataattaagtgattgagagaaggt

SEQ ID NO: 17598 - DNA, 16526 bp, Homo sapiens
caattgtccacacttgtcctgcatcccattttctagaataatccattttcttatattttatatgagaaaatttcctgtttcttatattttatatactcagaagcatactactcttttgtgcatcactttcttttactttctcagacactctttcatctcatcagcatatcagaagtattttattctttttagtggtgaatttttgcattatcattttgctgggcttgcctcactcccctgtctctccattatctttgctgtatctcaatgctaaatgctaaatattataaaaacaatcttctctaaaagtgtctccttgactttctccctctgcctctaacaatttccttgggaatcctaaaatccagatgcctggctgtccactccttaggctgggttccttttcacttgctgtagtagttattatgggctaacttgccttgtaatgtttgactcactaggtcataagtttttatttacttatctatctgcaccagtgatggtaagccctgtgtcttgtttacttgtatagccaagcactcacaaggtacctgacacaatataggcattcagtaggtaattattaaataaatgaataaacattaattaataaataggttgatgtaggtgcattcccaaggtgtttactgcaaactacaccatctaactataagatcccctataggggattccctgtaggggatgggaattgcacctcttctctttcttccttctagcttgtgactcatcttttactggaaggataccttcttttaatatctcctacctgatttcccatatgcaaatcaacactctcagctttcatgtgttcacaccatgagtaccatctgccagactctatctctttattagagtatttctcctctatatgtgctttaactgatgagagtgctctagaaacaagagcccctcccccatcattccttcatatgcacttgaaaagaatatgactgtgtaaaagtgtatattgtgtaaatttttgtgtaatgtttatatatgtcaattaggccaaatattaataacatgctcaggtctagacacttactgacttttttctttgttctgttactgtgagaggtattagaagtctcctactatgattgtagactggtcttttctccttttagttctggcaatttttgctttccatattttgtagctatgttcatgagtacatagagattaagagtttttatatctccctgttagattgacacttattgttataaaatgtctttatctctaggaatgcttcttgttttaaaatctactttgtctgatatcaatatagctatacctactttcttttggttagtgattgcatagcatactttttccatccttttattttaatcttgctgtgtcactgtcatatttttcttaaaagtagcatttacttgaatatttttaaaaaagaaaacacatcagtaatctttgactaataaatggagtatttagcccatttatatttaatgtaactactggtatatttctggtatatttaagtaactttcccaaagccacagcatgttagtgggagagtgcacactaggcatttcctgactttcaagtccaggatgctttctcattcattacctcagacttgggttaaaggctgtatttcccaccctcacatctgcttctgccactgctgtaatatttagtccttcaagttccttcagagatataggcggcaccgctctggaatcttagcctgattccagaataaaggaatgttaatagccctctgtgagctttccaggagcccacacaataaggttggtaggctttcaaagaaatcagttccattagtgaagtagcacaaacaattgtgaatttccttgaactcacctgaaagccttaagatccaggagtaaattcagggtcaggaccttgatgccatactacaggttgagaacccaaaacatatctaaggtaggactgaatctaggacccacagccaccagcaaagaactacctatgctatattgctagcactccctagctcacctattttacttttttttttttttttttttgagaccgagtctcactctgtcacccagactggagtgcagtggcgttatctcagctcactgcaacctctgcctcctgggttcaagtgattctcatgcctcagcctcccaagtagttgggactacaggcatgagccatcacacccagctaatttttgtattttcggtagagacgggatttcaccatgttggccaggctggtcttgaactcctgacctcaggtgatccacccgcctcggcctcccaaagtgctgggattataggcatgagccactgcgcctggcctattttacttttaagaacaaggaaggctttaagcattctaaaacacaactagggaggcacaggagaaaacagtggtgatctgggaaagctggagtacaagatgaatgaaaccacttaccttcctgcaggtgctcctaacgtacacagtgcctcagtgcctctgtcttatggctatgagctttacagcaatctttctcaaactgcaaaaaggcctaactaaaatccatcttgcaattcctagcacttgcgttaaggtaggcagcatgtctacacatccttctgtaggatgtaggtttaaaaatatcagaagattttttacccaaaagatgcccttgtgccagcctgctttttcatgtgtaaaatacaacaattactgctactaaaattaatttatttggtgctcagtgaatgtttatttagaagccctattttgcataggaaatagactttaggtacaacatgggaattaacatgggtttgagtagtattgggtttttttggaggactggtattcttaaggaatttttaaacagaagataaggcacatgtgcaaatagtctataatgattattatttgtggagtgtttattatgcacctgattctttacaaatatttcatttaatgcttacaactgccatgcaaagtaggcatttgtatcccaattttacaaattaggaaactgagattaaggaactgtcccaatttctcaaaccaaatgaacaatggaaagaatttgaacctcaatggtagaaagaatttgaactccaatatgtgtggctttttccactggttccacatttcttccctaccaatggttcataaaaagaagtagtgagttttccaaatggtacaaacaaaataccagagaagtagaggtgaggaaggtagtcacttccaggtgtgatgattggggaaggggtcatgggggaaagccactgaggtgggcctttaatggagtgggaggtgggtacaggaggacaatattctatattctagacagagggaatggcctcagcaggagggtgaagatgagaccatttttgagtgtggagaacagtataacttaatatgcaagatttatattgagaggctagcagaaggcaaggcggaaagttaaattgaggcaagattgcagagtcgatgacaggcgaaggagaaagaactctatgaggcaataaggagctgttaaactctgccccccaactccagggatttggagccatatacagaaaagatctagaagaaaaagaagggagctacagtgcactgtcacagtgctgaactctgacagaagtggcggcggggaatggaattgatgattccaaggagaaggggaactctaagaccaaagagaagaggactatagatttcagtgaccaatgggttttggagagtagaagaaatgtatgaatcacaaaaactatagtggtgagagcctgggtgatcaagagaactttggaaccacacacggaaatgtgggcaacaggaagaggtgctggcttaggggaaagaaccacctggaaagtgtcagccacacagggtctgtggtcaggtatgttacaccgggggccctggggcaggctgaatccgaggaagtatcacaaaggaaaggagcttcctgagaagagaagaaccaagtgaaggccacttcaggggtagagggctgggaaagggtaggagaaataggagtagaaaaatcaacagaaggaaaagaggtaatgaatttggggtcaaaaagacagagtaggtaatgaccctctatagactttgcttaaggaggaaactttgttcttacaatgagtgaatgaatgactgcaaagaataaatgaatgcaaagttactcaatgcttccatctgacaaagagtgcgtgaaatagccaatcagttgcttcactatccaaatggagaatatagcccactatacataagccattttgaattatataagctactccataatggagcttattagtgtggttcccgggcttgagcccaatcttttcttcttgtgaaacgaaatcaagatagtattgtttccctgtcaataatgggttcttaaatgggcttgagctttgtgagcactgccaatatcaacacttactttagaggcaatcttgataaaggagaatctgataaggcacaagagagggcaaagagggtataaatggcaggttggatgagggacactaccactgaggcaacatggccaagctcacccttctcactggtaagagatcgtctcatctctgtacctctgaatgactctctccatcttgtttttctgcccctttaaaactcttttaccttcaaatttaaaccagatcaactgagatttttgctttcggcaaaagtatggggatgtactgaacagggggacagccccaaattgcctggtgataggtttctcactgccctgctgtccccctcccttcaccaagcctcaaaggctcatggtactttaatggtcttttgaatggaaatagaggggagtgggtttccaggacaaatccaaaggctttgccagcctcagtaggttggtcatctacagaggatcttaagagaatgaaaaatagaaaaagcttcctactgcttaagtgaggtgactaatgtataaaggctactctactcacattcctccagttcattattctctctgttgctttaaggtctgctccttgtgctgacagctgaaataggtaggtatatttcttgggatgaaccactatattgttcctctttttcttattcataatttggaaactcagtactgccctgtgtccttccacatcagacaaagaatattaactactctctacagagtttgaaattccctaaccaagtttaaaggattgataccattggcctaaaaatcccaaagcagaaaccaactagatggcagtcttaaagaatacgtgctaacaataaaaactaatgtggtgaggcagctacacagtgtcctctgctcttaaaacattttaaaatctgtcatcttactgagttttaaaacaactcttctttgagaggtgtacaggaaaggcattaccactccatctcacagaccagttaaccagggcagagataagacatatgacctgacctaggtaatacagagagttcatggcagaatctgaaccagtagccagggcccttgtctcttggtggaagactcatttccccctgggtggaattactcagggagatatccaaaagggctaaataggcttatactatcatcctttctgtgtctcagtttccaaatgggttaaaatgagaaaataataatacctctctcaaagggttttggtgaggattcatgagtaaatataagtaaatttctcagagcaatgcttggtacgtaagctgccacataagggagctagaatacatctaaatcatagttcactaagctttaaaattctatttcagctaaaggcactggtttctaaggttatttaattctctcttggaggaacagagctatctctaagagatatcttcagccctgaattgcctgctcattattgcctgcaaattatataattataggtttgctgcaacataaagttcttacattgacttttcccctttcctttgagacttcaaatagggaaatcatttggaaatctgtggtttttaaagaaatctgtgactcactagggagcttgtctctcaccttctttctctgggtaacaggctctgcctaccagctgacatgttacttcaccaactrggcccagaaccagccaggcctggggtgcttcaagcctgatgacatygacccctgcctctgtacccacttgatctacgcctttgctggaatgcagaacaacgagatcaccaccatcgaatgggatgacatgactctctaccaagctttcaatggcctgaaaaacaagtaaatgacggaaaacctgagtttcaaatcttttaacctttaaggacagtttaaacaagatcttccacagcagacttcaggctgaaattccaaacaggccaacaagcaggtaaattcagctttcttattatttcaagtgcaagaatgactctaattttaaggggaatggctggctcacagaagctagctgctaactaaagcccagctcagttgccaagggaagcttataagtccaactactggtggactcagttgagaacaatcttccacttagaagcaatccaaagctggcattgataaagcattcaktctccttggtcaggagattcactcctasggaaataattggaactgtggagacattggggtrcagcaaaccaacatggcacatgtatacctatgtaacaaacctgcacattgtgcacatgtaccctggaacttaaagtatatttaaaaaaaaaactgtggagacattgaaacataccaatcatagtcacctactccaacattcataagtaggaaataaggataagaacaaagataaaccaggatgagaggctgcatgacactttcctggcttcttgctcactattgcagctaaatgttgaaatggcttccctttcttttcatttgttctggtaaaacactttgtttcttttccctcagaaatagtcaactgaaaactctcttggctattggtggctggaactttggcactgctccgtaagttctttttggtgatgacttcctaggttgattttactctaaggtgttgggaccaccaaggtctcaccctgccttctttgggtctccctcagtttcactgccatggtttccactcctgagaaccaycagactttcatcaactcagtcatcaaattcctgcrccagtatgagtttgacgggctggactttgactgggagtaccccggctctcgtgtgagccctcctcaggacaagcatctcttcactgtcctggtgcargtgagctaagttccagatcattttcactggaaagcatacacccatctcatatgaaagatcactgggaccttaaaccyagtttcctagaattttatttggggtgaaggacctgaaaatcctattccagtaaggatgctgaggaatgaatggaaggatggaagaggttaatttaattcagtgtcatgaacctcatgaaagtaaacttaaagttactattcacagactttctcctgctcctgtacaggaaatgcgtgaagcttttgagcaggaggccaagcacattaataagcccaggctgatggtcactgctgcagtagctgctggcatctccaacatccagtctggctatgasatcccccaactgtcacagtgagtgatgtgccttatcttcaaacycctggaggtatcactcaggcagactagacttgtctttggtctgtcttgctattcagggaccttgtttaggaggctatggaagtggtgccttgtgcccgcacaggtatgggaaatgaccatcagaatgaytttaaatcctctaccccacctcaggtacccggactacatccatgtcatgacctatgacctccatggctcctgggagggctacactggagagaacagccccctctacaaatacccgactgacacyggcagcaacgcctacstcaatgtggtgagtccctgtacagatgcaagrgcagaccagagatgatgatgaaaatcacatagagattcaggcacaaaaggyatcataagtttagtrkttttctcaaatgagaaattaggctgccataatcaattaaatattctcatttaytaaaaaacttgcctatttattaacaccatactgataattttacctaatatgaaagaagattaataacaagtgcattgttttttaataaaagaaaatgatatgccactgctcctatttcaataaattataaaaggctttttccaccttcccccttttgctgtttcccttttgccttacccattttctactgttctaatcccttgcctatgtatatcatatagaatttcggacattaactaatgaatcataccaggaatatcattttaaaatctctgctcttctatcatattttttttatccaaagggtatatgtaaagcctgcttgttattaaaagaatttagttgagaattagacctatcactttaacagatatatgtcagtgatgctctaaaatatgttgcaagtactttgtacagtgggcacaaccaaatcraaaaaagtttagctaataattaatcactaggccatcagctgtgggtgagaactctagctaacccactgccattgcaggattatgtcatgaactactggaaggacaacagggccccagctgagaagctcatgttggattcccagcctatggacactccttccttctgagcaacccctccaaccatggaattgatgcccctaccactggtcctggccctgctggaccctataccaggcagtctgggttctgggcctactatgaggtatacactcagaaatgttagaggaaatgtggctttctcttggtccatgtagctaataatatgagcaatatgcaacagttcttggattggagctgaaagtggatgtttgtggctatctagaagggaggcaagataaaccctcctgttgcaccactttaattgggccttcactaggtccctttgaggctagattccaaacacagagagtgtaggaaagtaggctaccattagtgagagtatatcaatctgtagacacttctgactgccagggtattccttgatttaagagtttctccccacattgaaaataaattactcaaaaggagtaaacaaacagaatcccaaataactaagaaatttgctggtaaagcaatagaccttcattttcaaggagtttttatgcaacactcctctacttccccttccccatgtccttttacctctgccaccacaaggacactgcctacctcttgacctgtaccttatattctgttagatctgtaccttcctgaagaatggagctactgaagtatgggaggcttctgaggatgttccctatgcctacaaaggaaatgagtggcttggatacgataayaccaagagtttccaaatcaaggtagactgtgttctatgggttgttgttgcctgtgagcatgttcccattatagccctggagccacagctcagccttggtgtctgtacataactgacttcctttctaattaccacaggcagattggctaaagaagaacaastttggaggtgccatggtctgggccattgacctggatgatttcacaggcactttctgcaaccaaggaaaattccctctgatcaccaccctgaaggatgctctgggcctgcagagtacaagtgakttagggagtgagaagggacactaagcctcagacttaagagaaattccaaaggttccttggaagtcatggagctgttgcacaagtaattgtctgacattgtccattcctatctggtaacaattgattaatggtgggaagaacaaacagggctyttcaccatttcttccttccttcattcatttcacaagaaatttattgaacatctattacatatacagtgctctgtaggtaccacaggtgatctaaatgcataaatatccatatctactctatggaaatttacaatctagtgagagaaattggatttacaaaaactgcaaagctagacaacaatacagaagatattatgtgatactgtgccccctaaaagaataagtaaccttcttgtgagttcatgataatgaaaaatttcaatcagtaagatgtaaggaggaaaaaatgcactgtgacttgaaggatgaggaaggagttggtaagcaaaggggtgagtggagcaggaaggatatatcagatcagaagactgaaatatgtggagacatagaaggaggagccaagaacaaaatccaggtactagctctcacacatcaggtatcactggctaaaagcaaggaggttcaggatttgttttcytttttcttctcaggttgyaaagctccagcccaacccattgctcycattgccgaggcaaacatcacatgcggtgtcagccacagtsgtagctctgrgggcygctctggcaggagctctgggggcagccccagaggtagtggattctgtgctgacagggccagtggcctgtaccctgaccccactgacaagaatgcctcctacagttgtgtgaatggaaagactttcactcagcactgccagcctggtggtgtctttgataccttctgctcctgctgcagctggtgataacatttttcagatatcacctcacccagcctcagaagttgttgtgcaataaaaggttgagcattactgtacaatcgcttctgcttctttactgtaggatcttagatgtaattgatccctatttcccaatgatatacagttgctccaccagcmcccaagcctgcagcatgcactgctagtcctggatgttgggtagcggaagcagggggattaaaggaaaatacatggtcccttcattctcaaaacatgtattcagatgaaggctggggagcccaagaatgtaagactcagataacaatgacccataagcaaatgtcattttaaagtgattgatttgcccttttggctgagaatgcacaattaggaggctattgcagtgattcaggggagaggtgcaggctcagaacaaagtagtagcagtagaagtggtcagaggtgattgaatttcagctgtattcttaagatttgttaagccagcaggtttctttatgggttgcatgtagaacgtgggagacaaaaaggggagccaaggataatttcaacattttggcttaagaaattgcaaatatgaaattatcatcaactgaaatggagaaagctaaaagtagagtagattatgaaggaagagcagaagttcaactttggacatgttgaatttaagattgttattgggtttctaattggagatgtggagtagatagttggacataacatttttagaggtagttggtatttatagttggacataacatttttagaggtagttggtatttaaagtcaatagattagatgagatcattaagggagacagagaaaggaaagcattcaaggactaagccctgagcatttcagcattcagagggaggctggagagaagagtaggaacaagtaatgaagaccaaaaaaggagggctaagtgaggtagaaggaaaaccaagtgtcaagtatcctgaaagccaaggaaagaaccatattaaggaggagaaagtgatcaagtttgtcaaatactacttaggtcaggtcagatgaagtctgagaattgaccattatgtttaacaacctgtagatcattgacaaacttgacagaagtggggttggtaaacatcttggtggcaaatgcctgagtgcagtaagtttcagagagaatggaaaggtaagaattgaagacagtaaggatacaaaaacctgtcttatatgtgttaaagggaagcaaaaaatgggattaagaataaaagattatggaaaacagaagctgaatttatgttttcaaacccacatttacttatttagagatatgggagataaaaatctaacattctttccatacctctcactttcttatttttattattattttcacagagtcaaaaatttttttaacttaaaaattttttttttttgagacaaggtctcattctgttccccacgctgcagtacaaaggcacgaacatggctcagtgcaccctcgacctcctggactcaagcaattctctagcctcagcctcctaaagtgctgggattacaggcatgagccaccacatccagccccaaatttttaatatcactttgttttataacagaactgaagtcctatatttaaatcaatgcaatattcatcccctatacttacactacagcttatccaatattcatttctttaattatcttgttgtttgttttgtttttgtttgccaagaaggacttggagtatcttccattttcttgcatgtatgaaagtgcctgactgttgcctttatacttgattggtaactttttggacatagatattggctcactcttttactcaaaattttgtaaatattactgctttttattctggcattgaatattgagctagtgtttttcctatggctctttcatttactttttcaggtttggatgttttgtagttgaacagttttttcaagtagttctgtggctgccacaggccttaagttcttttatatgtgagaatatctgcctgtctccttggttcttgaaaagtatacttcaagaatattatacttggtagagtataatacgataggcttgtactttcttttcctcagaactcttcagatgtagacaaaacttcttaacattatttcaaatcatctctgccttaccttttaattccagttgaagctacagccaccaattctgcataagccttaatggtcttcatggcgttatggaatcttacctcagatctgtgttgtgtacttcttgctacccttcctagggcttctgagatacaggtttccactcaagcaggtacaatctagacacgcagaggggttactgtcacttacaaacatcagggaaacgtaatgtttccacctttcctcccctgatgttctagaagcacattttgtaagacttttaacaccgttccaaagggatagagcatttagttgtttctaccagtggctaatatgataaaagcatgattttattggccctcccttcttccctgtttcactcccctgtctcttacttattctttgcattccactcccaaattactctcacatgagctacttccaggtgaacttagccttagatagtaggcattgctccactgtgtcctggcattgaatattgttgtagggatgtttgaagacagtggataatcactaccctttctttaatccacacttttaaagttatttgatttttttcctgtgagtgcctgaagaattcatgatttattcttgaagttcaataacttaacaaggttataccttgattatgatggtttttgtcaatttctcctataaaacagttgagaggtaagatttaacttgcctgagttaacagacctgcaggcggcctcctggaaaagaaagttggcctgttgcctctggaaaccagctataatctatagcctaggtcctaatgcaatccatcctggcagagagctgaccatggtgaatgagaacttcagccaagtttacaccaagcagttgtgcataatcacggggttggattacaccagaagaaagccaagtgttctcccaacagatgaatgctaaggtagtagataagactgaaagccaaggttctgctatatcatactgctattagatcccatatcctaatctcactaaagaagagttttgttaagaagcttaaaagtcccaacatccaaagcccagagcctctttctcagagctagatatgtgctatgttagattgttgtatgctgcctgagaataaaataaacaccagaggatcactcatctgccatcgcttctgtctctgactttttacccagaagtactattccagaaagcccagtgtgcatgctgcttggctactcaccctgaatcacttgacaactggtgtagagagctggatgtcagactaggggcacctaccatggccttctagaagtgaaccaagggacttgggatttaaaaagtgtttctcagatgatcccatcgctttcaaagattggtatggcagtcatggggactagtccactaaattcctgaagatacagagtgataaaagtgatactgcgtagttaagatcatcgagcctagcattccatgattgttattattggccttggaagaattagctctaaggaggcagaccgaggggaacttgactcagcatcttgaatgaaattacaatttgaaaactttggtgaatgtgaaatgatttatatatggtcttatccaagcaggatcaaacaaattccatcctctgaccctcttcctatgactgataggatcagttcaagatggcacaggttgtcatgttattagggtgttatgagctccagttaaatgggtgcaaagggaaggaaagacaaagtatgtgacttatgaggttagttccctcataacaagtgaagaagataatctgaaataggctgattgaactaaccgaacttctgggtagactcccactatagctccgtcttagaaagtctatgtgattactgcttctatataaagggttaaacatgataaaattgatgatggtccctatctttgtctatggaaaaaaatatccagtgagttttgggggaactcatgacccaagtcataataggaatttcaggcttcataaagacatcatggttgaagcagaggtgctctgtttccagcaaagcccaacaggaagctaacttttgctttttgaaaggaggattccccaccagactgggaagcaacagcctaggctccagagtcggacactggacttaagttgttatcagatgaatttgctcagctgcgtactgttgtgttacaaaatcaaatggcattagatacgcttacctcagcccaaggagggttttgcaccttactgcatactgaatgttctgtgtatagccctaacaattctcacaatattactcacaaagccatgttgggtgtggtttttattaattgtgcttttaattctgctgtacttaacctgtatctgtaaactatatcaaatatcccttccccatgtatctgtaagggtattttcctgcaattgagtatcagattgaggccaaatgtggaggaaaagttaaacattaaatttgaactcaactgaacatggacacaaacaatggtcaccaagtcccgcaacaggttgtgtgagtcccttgaggcgttcatccagcactgttttggaaaaatctctatttcaatctagtcctatatgttagttattgaaaaaaatagacagtctcaaaaaacaagctgacctttttatgttccttgaacctagttgtgaagggcccttgttactgggcctcatgccaaacaactcrttacaaaaacagctagagtcccagacggtgccaaagcttcatgaaacctctcctcgtctgtgcacgaacaggtggccaactctggagcccaggctgttgctttccagtctggtggtgaatcctccatagtctggtgagtgtaaatatatatatatcttttcccttctccctttcccattgcaatttgattgttatatcaatttgcttattatatcaagttgtttattatatcgtttgcttattacatctgcattgccatttatgtgagataaaggttgtttacccttaaaggtattgtgtgtgtgtcttttctcctcccctcacacatctctcacacagatcattttatacccaaagggatataaatcattctactataaagacacatgcacacgtatggttattgcagcactatttacaatagcaaagacatggaaccaactcaaatgcccatcaatgatagactggataaagaaaatgtggtacatatacatcacggaatactatgcagccataaacaggaatgagatcatgtctttgcagggacatggatgaagctggaagctatcatcctcagcaaactaacacagaaacagaaaactaaacactgcatgttctcactcataagatggagttggaacaatgagaacacatggacaccgggaagggaacaagaaacactggagccagctgaggggttgggrgcaagssggggagagcattaggacaaatacctaatgcatgtggggattaaaacctagatgacgggttgataggtgcagcaaaccatcatggcacacgtatacctatgtaacaaacctacacattctgcacttgtatcctggaacttaaagtaaaattttttttaaaaaggggggaaaaatatatagcaaaatgcaactggaatttccaaatgaattagtattttatttaaacatctatattttaaaaataattgtaataatgagaatacatagacacagggaggggagcaacacacactggggcctgtcggggggsggtgggggtagggaaagcatcaggataaagagctaaagcatgtggggcttcatacctaggtgatgggttgataggtgcagcaagccaccatggcacatgtttacctatgtaagaaacctgcacgtcctgcacatgtatcacggaacttaaaataaaatagaattaaattaaatcttaaaaatagtaattgtaataaattta

SEQ ID NO: 17599 - DNA, 15932 bp, Homo sapiens
ttaaggccaacctaggcaacataacaagaccccgataaatttctgctagagaaaactgtttccagaagttgtccatgacttcaccagcgtttatgaaaaagccaatcaagaaaataatgaaagagattgtagatattgcaaaaaaagtgaataactttaagatatggatcttataaaaattcaagagctaattgcacattagagaaattaacagatgaaaacttgatagagatgtgtgcttctgaaccagttccaaatgatgaggaagaagatgtagaagaagtagtgccagagcacaaattggcattataatttggcagaaagattctgatttttcaaagcagcttttgacctgttttacaacaaagaccattctatgatatgagcactgaaactaagggaaatggtgaaagaaagattcatactgtctagaaaaaattttagggaaatggaaaagcaaaaatgtcagacagaaataactatgcatttccacaaatataaatgcagtgtgccttcttctcctgtgtcctgttccacctcttcttctgcttctgccacccgtgagactgcaagactaagccatccccttcctccatctcttcagcttactcaatgtgaagacgaggaggatgaagaccttatgatgatccactctcactgagtcaatagtagatatattttctcttccttatgattttcttaacaactttttttactttagcttactttatattacagtatataatacatataaaatacaaaatatttgttaatcagtggtttttgttactggtaaggcttctcttcaatagcaggccattagaagttaagtttggaaggagtcaaaagttatatgcagattttcttttcttttttttttttttttgcgaccgagtctcgctttgtctcccaggctggagtgcagtggtgcgtactcagctcactgcaagctccacctcctgggttcaagccattctcctgcctcagccttctgagtagctgggacaacaggcacccgccaccatgacgggctatttttttgtatttttagtagagatggggtttcaccgtgttagccaggatagtctcgatctcctgacctcctgatgcgcccgcctttgcctcccaaagtgctgggattacaggcgtgagccaccgcaaccggccacagattttcaactgaatataggggtcagtgcctctaagtatttcattgtttaaaggtcaactgtacatctctgtatcttccacattatatacattttcgcagatttgtgtgtctgccttttaatctgtccattattaaatataactaatttttgtatttatacatgctctatttttattgtttctcaaattattgcttattatagaataattactttttgctccctttatttacatccttctatatttgatatagaatgatttcattctatatttgatatttgatttgtccaatatctcaatgtccttcaagatttaaatttatagtctcttctttctgctgatatatccttatagtggcttgctttctagtgtatttatatacttcatctgtcagtgtagtttatattctgagtgggctgaaggaaaagaatggcttctgtttctgctgctaggcaacacaccacatccaagaccatgtctatccctccttggggatttggctctatctggttccaagatgagactctaacttgtagaggttccatgggtcagttattatctatgctgttggtgtagaaatctgacacaaggagaccacacccctcctggccacttgcctgtccaggcaagctctttactgcttcatcttcgctccttcctactcttctgcagcttctttctgtagtcagcaccaactcccagacattcttaccccttctcctgtctccaacactcagtccaatcaggacccagctcctggttcacatggtaccagcaatgcctcaaagaacatgtcctattaaattctggatgtggcagtgcatgaagtctcaagggtgagggtcaggatgagattttggtttcataatctggggttattccaagtaccaatatttttaaacggttcgacaagaggaaccaatatagatgaagtatctattacagagcctgggccttattaagcactcaatatgaaatagttactttagaagcatgttaacgtgactctcctacttaggaagctgcaatggtttcctattgcccatctcatcatttaaatagtttactggggctgactgttataaattatcatagtctagatgcatttaactcagaatttatttcccactgacacaaaaaagcaccttttatctgcttatctacttcctatttcccagtgtagttagtacccagttgaagaggagtgcatcacatacagcaagtaatgagtgaggtggtgggctggcttctcacccagttctccagcttgggcttaccaaggccttgaagcaattttttacctgatcttcctatcataaaatgaaattaatgcttattcaacatactgaagtgaagcatatgaaaaatttagaagtacttaaccaaaaagtacatttgtacatgaccttgcttctgctctataggtcatgactaccataaatgagaggtactatggcatgatctctacacctggcattgcatcctagaaggtaagaatgattaggaggccccttctatacacgagaacacagaggctgagagatgttaaataacttgtccaaaatctaatagctcataaacagaagttgacctcaggactgttagatacccaagtccacactgataagctgtgcagaaaaggggaaggttttagacaaagaaaacataaaataacatgttatagttgattagtgttctgaattgtattactcaaaatgtgctaatggtccacaaatataaataagaagaggagttggataaactgaaagggtatatgatgttctaaagcttggaaatgggatggtcaaaacccaagcacaggaattttctgtcttctatgtcagaggttcttatagtacctactctgtcatttaaaataatattgtttcacagacttcacactgatagaaggatttttaaatcattatgcagattttaaatatcacttacagtagaattgctacattcatttattttaagataattttacttacgtaatgctattttccaggtacatatttcagtcaataaattggttcctgtaggttatctcccctctgtctacctatccccctccaatgtgggtggcgggtaattacatttcagccactatgagaactgcttcctcttaccagaattatgggtaatttttggaggcttgattgtgtcctgaaatcaagaaaaaaaatgtttttccaaattagtctgttattactaccattgacctttttcatttcaaattttaacattattttagtataatttacataaaagaaaatgtaccccttttaagaatataaattgattattaattacacaagaatatttagtataatatcccatttaatagacaaaccgatattgtcaccccaaaaaattttgtcttgccctttgttctcaatttccttccatttcctcctctgataagcagtgattgaatttctaccactacacattagatttttctaatctagaactttatataattggaatcacagggtatgtgctccttcctatatggcttcttccactcataatgaaagtataagtttttcatccatgttattgcatatattagtaattttttccttttatgactgaatagtatttcagtgtatgtgtctagcacaaattgtttacttatgctcctgaattggaatttgagttgtttccagtttttgacatcttcctttttgaggaaatagcgagcctttgcactctaatggctcagtgtttacattcccaggacatgactcaaagctcatgattctacatccccagacacatggtctaatcattgtttctgtgtcctggatgccactttggcatgcataaactccgtggttcttggctctggctggtggggagaaaccctcatgtgaaacccttaagcagcagaaaaaataaatgagtcagtacataaatttaaaagtaaataaactaaagagaagtggtgcacagacaatttctgctttcttccatgctacaaatccttccagcggcaaggagctcaagattttgctgcaatcggattaggtcattggcagagtaaagataaaaacaccatgaaaaacaccttagattaaaagccacgtcattgtcctcctacacagtccgttctacttaaccaatgacatttaactcttagcctggagcacaggaagtaaaactggtagcccacatgtcaaaccgtaaatatttttgtaaatctggtcattatcctccaaaggtaataacgtaacagcccaagaaaatttttggtaaaaaaaaaaaaaaatgataaatgaaatgtaccgtgtgcattttgctattagtccatcttccatcaagtttattcatgaaataaattagccacattgagtttatttctgggataatcaattcagcatgtactgacaaaggcagagacctcttctggccttccctggctcctctgtgtacaattttcatgagtcctgcaatactttgtctcccacttctccaattaatttcttattcttctcatcgcttggcatattttcacattctaaatattccagttacatattacataccaggtttcatgtgtatctttccctcttgaatgtgcgagcaagagggaaaggatcataatatatgttttgatggaacccctgacaccgagaaccatgttgtccacatatatttgctaaatgaatgactggaggcactgcttgaggattctaacaaaagataaacttagctaaaaaatctgcaaataatcatccttgattatttttctaaactgaaatatttctattaattatagtaatatccctcattatctgcttaccatttgccaggcaatgttccattcatttttcacatttttatctcaatactgctcaaaactgtgtagatgtgtatgtactattaataatattattttacagacagaggaaccaatgtataaagaagtttaatatcttgcccaggaaggtgagtttaacttgctaggttcaacattctgagttcagagtctatgctttgggcctctgtgatgcaatgtccctcaaaagaaagccatccaagatgagtgagtggctcatggctcatgcctgtaatcccagctctttgggaggccaagatgggcggatcgcttgagcgctggaattcaaaatcagccaaggaaacatagggagagcccgtctcaacaaaaaatacaaaaattaaccagccctgatgggatttgcctgtaattttaactactcaggaaactgaagtgggagaatcatctcagcctagggaagtggaggctgcagtgagccgtggtcatgccactgcactccaacctgggcaacagagtgacatcatgtatcagaagacaaaacaaaacaaaaaagccatcaggaaaggaagaacattaaataagaaaagctttaatattggtgaaaaatgtttacatttcttaaagcaaaattgcttcacagggacatatatttcccacaaactttccccaaagctgtgaggtggggtcaagggaacagtggttcacattctccaaaggttgtgttaattttttcggtcaagttttcgaatgaatgggaaactcttcactgtgtgaatttaactgtacacatactttctcaatcctggggcttattctctaagccccattcccctcctaccctgatctatccaagggctggagaaaaaagaattcccttggatacactctctgatgcaggctacagttctgattctttctctgggaagaaaaataaagatatgcatatgaatgtgcagtgggtgtttcccaatatgtgtacacgccctgccaaaaaggaaggcgaaacatactttcagtttcagcccacacaagaagggtaggagagaaaagccatggccggtgagtcttttactgttccaagaacaggtccctgggaagaaagagttgtggaaagggctggctcttctggaagccataattagtatctgtggaagtttaggtgagcagaagtgagggagagggaggagtgggaggagagaaggaactagaagatttttgcaggctttagaaagaaaaggcaagcccagaaaggaacagagactttaggggtagcctgctgtcattttgcaatcttaattaaacccttgcttacctgtcgtaagtctgacagagggtacagaattggcacaggaggagtactagcagcagtggttcctaaatgaaatgggctatttctgcttcattactttattattcagagttaaataaacatgggacacaagaggatgatctctgctttccagggactgatgtggaaatggtaaactcagtcttcaggtcactccatgcacatatatggggactactgagggaaacaagtaggacagcaatacagtaagaagagggattacccaactgtgaggagggggacatttcactgatgaaatctaaatgaggtcactttctgttgatkacrtgagargaatatgaggctgttttcatgatgtgagaaatccttgtgctccaaacagacaaggtcctgaaggagaagagaaagctgtttatccrttccatgggtgaaggtacaataaatggcttactggatgaattattacagacaagggtgctgaaccaggaagagatggagaaagtaaaacgtgaaaatgctacagttatggataagacccgagmtttgattgactccgttattccgaaaggggcacrggcatgccaaatttgcatcacatacatttgtgaagaagacagktacctggcagrgacgctgggactctcagcaggtaagggtcagtgactcacactcaagttcacctagggcctgtcttcgtgcctaacatktgatttctttactagtcatgttaatctgcagaatatcttcttatctctgcctttgggccatatttctgtagcagaggccctattgcatgtcccttgactcttttttgtgttccttcatcctcagtgccctcttctgattaaagttcattttctgttctgagtacatggtagctaatttccttaaggtcatgagaactatctagaaagcttcatacaatatgttccagtgttcctggcaaggcacgatatttattgattgatttattattttgtgtccagggtgtccctaagcccttatgtagttgtttgacatgagctttagggtctgtattcaaatactttttataaattcttttcaaacttttgccctcagagaagaataaagtatatttaagtgacgatgatacgttcaggaaatacattcaatgattacagaatagtaaagatttcaacagggctctttcctcccrttgcycccatgcattttcttttgagtaagatctgcttgtctgttgccaagctgcagatcatactgggaggcctggacttccatcatctgcagccctcctagggcctgatacagtgctcaggaaatgagcttgcccattcttataatcccttgaacctacagcatggtgaggatgggagttttggtgcacttgaacattatttattgtcatttagtcagrgttgtgggaggaatttgcagtgaggagtggcttatgcattgctgtaaagttttccagagatgataagtggctatttcaatgttcttcatctttttataggtccgatacctggaaattagcttagtacacaagactcccaattactattttcttccttcccaggtaatgttgtttttcaatgaagagcattctttgaaccccatcttctttaacattaatttagtggaatgagctctgcttgaaggggctatggagaattcccatagactgatcatataattttcttttttaatctattctgtttttgcagaaactgttcccaaagctttactactcttatttatactaacaaaatctgaatttgtatctcaaattctgattacccaaataagtaccaaacttcatcatttaagactactgaaatattccctcacatcttccagagacacatttatgtaaacaatttcagagctgaacatgccattcttccccaccctgcttctcttmcagttttgtgtaacttggtttttgatgccaccatcaccagttgttcaatccaggaacttgaaactcatcttggcccccttcctctcatgcacctccaatattcaagccatggccaagttttatgcattcttctctcaaatttggaaatgtctcttcattcttacttctattattttattaaagaactcttattccttaagtgccccccttaaaataaaagaaacttatatttgaaagcaatttagaggctagaaatgcatgtttttatcaagttcagatattactctactgaatttattaaggatgattacctcatgaatgttttcttaaatgtttcacagcatgggataytcactatataaccaaatactgtattctcaaaaataactcaaatgcttttctttagtttttytctattgctttcacaaatccttacaaagaaaccaaacatttcttctactaaattattattttatagttttctccaatataatcattctaattagttcttctccatgtcaacacacttcatgctgcctttgtttatctgattgtatagcagtttttcaaatttgtttgcaaaattaaatattattattttgccttaatagtttctaaaagatcctctggatatctagaaacctcagttctatcttgaaacaaacatcacattaattttttaacaagtgcatcacattgtcagattgtgttgatcttgtgatgaaataaaagcctcaaagattttctcacataaactctgtgaaaacatttcctcatatgttcgtgaaagcaatgtttagtgctatgaatccatctagagcacaccatgattttagcattcatcrttctattttatatttattctagtttaygtattcaatattcttgtcctcccatatgtatacattgtaggaggagatrctgaaggacaggaaaagggatcattaaaaaaatawtcccrytstttactaccatgtctatkaggtaaatraataaaaggataaacacatattttaaaaattaattagtgtwaattaagacctyctcccmttaaatttratcctaggrtwtgaatcctttgaaaacaaatcatattttaactattttmtatcactcattgactgtttcctgagtgttttatcatgcatggccttgaaaagcttcctctctgtttttatctaagatgcttgtagaaatacttatgctcaaatatgaaagtagatcctccctgtaatgcatacctagaaatctctggcttgaaatgtgctccattagcagcaaacgcactcaactatgttaatgactagattargattgtcctctaggaatgtatttcctcttttgtagcttcctccataggtgaggctataagaacaaagagggataccactgttcatgatattcctkgtctcttgcagctcttcaggcagtgcaggacaacccagctatgcccacatgctcaagcccagaaggcagaatcaagctttgctttctagaagacgctcaaaggatatggaaacaaaagttgcagaggtgccatgttcagaatacaataataaagtggagtgaaagatatacttcaggcagttttgaaatgcagtggctttttcttagaaccaattttattgagcggttctggaggawcatacttctgctccccttgcataaaggatctctatatcctagaatcccaggtttaggtaaagagttgcaaactggaactcataaattatcatagtcttcacccagtctgtctcttagaatttatttcccactgacacaaacaagccattttgtctgcttgtataacccagattttccagtgtagtgcccagttggaaaaaagcacatcccattgagcaagtattgaagtggactcttgcttctcacccaattctccaacttgtgtttaccaagaattggagtcagttttttacctgttgttcctattcataaaatgaaattaatgtttatttaacatattgaaatgaagcatatgaataatttagaagcactttaccaaaaagtacattttaacattaccttgcttctgggctatagcttatgactactataaatgagaggtatagtggcatgctctctacaccaggcattgcatcttagaaggtaagaatgataatgaggcccctcctatacatgagaacacggaggatgggagatgttaaataacttggttaagatctacagctcataaatagaagttgaccctagggctattagatgccaaagtccacactgataaaccgggcagaaagaaagaggcttttagacaaagaaaaaataaaataacatgtaatagttgattagtgctctaagttgtattacacaaaatgtgctgatagtccaaaaatataactaagaagagttggataaactgaaagtgtccatgaacttctaaggcttggaaatgggatggccaaaacccaagcacagaattgtctgccttctatgtcagagatttttacagtacctactctgtcatttaaaattatattgtttcccagacttcacactgacaggattttataacattatgcacatttaaaatattacttataatagaattgttacattcatttattttgagatgattttacctttgtaattctattttccaagtacacatttaagtcaacaatttggttcctataaattatatccactctgtctacaattccccatccaacttgggtggttggtaattacaactcagtcactataagaacaacttcctcttaccaaaatttttacaaatttgtggagtgtgtccagccagaaatcaacaaaaaaatatatattattacaaccactgaccattttcgcttcaaaattttaatgttatttttgtataatttacgtcaaagaaaatgtactccttttaagaatacaagttgataactaatgatacatggctattctagtataataatatcctagtgaataggcaaaccgattttgtcaccccagaaagttttgtcacgcccattgttatcaatctccttccacttcctcctcagataagtagtcatcgaatttctatcactgtacgttagtttttcctaatctagaactttatataattggaatcacagggtatgtgttccttcctatatggcttctttcactcataattgaaacatatttttttcatccatgttattgcatatattagtaatttttccctttcatgactgaatagcatttcagtgtacatgtatagcacaaattgttattttatgctctggaattggatatttatttgtttccagtttttgacatcttcatttttgaggaaacagtgggcccttgcaatctagtggctcagtgtttagctttccatgacatgagactcaaggcttatggttctacattcccagatatatggtctagtcatggcttctgtttctgggatgtcactctgacatgcttcaactcagtggttcatggctctggctgtgggcgaaaccctcatgtgaaatactttagttaatagaaaaaaaattgaatcatttaaaagtacatgatgggaagataagtaatacacaggcaatttctgctttcttccatgctacaaatcctcccagtggcaaggagcacaagtttgtgctgccatcggattaagtcattggcaaagtaaagataaaacaccatgagaggttgggcatggtggctcacatctataatcccagcactttgggaggccaaggtggccagattacgaggtcaggagtttgagaccagtctggtgaacatagtgaaaccccatctctagtaaaaatacaaaaaattagccaggtgtggtggtgcctgtaattccagctacttgggaggctgaggcaggagaatcacatgaacccgggaggcggagatggcaccattgcactccagtggggtgacagtgcgagactctgtcaaaaaataaaaaataaaaaaaaaaaacgatgtcctcctacacagtgagttctagtcaaacccaaacacatttaacccttcacctagagcacagaaaataaaactggtagcccacatgtcaaaaggtggatgtttttctaactctgggtctttaatctccaaaaatattaaggtaacaaatcaggagaatttttggtaaagaatttgataaacgtaacataccgtgtgcattttgcaattagcccacctttcatcaaatagatttataaaataaattagccacattgagtttgtttctgggataagcaattgaacatgtgattgcaaaggcagagaccttttctggccttccctggctcctctgtctaaagttcatgagtcctgcaatattttgtctcctactttgccaattttttttttatcattctcatcacttgctacatttgaacagtctgaatattccagttacatattacataccaggtgtattagtctgttctcatgctgctaataaagacatacccaagactgggtatttataaagaaaaaaagaggtttaatgggctcatagttccacatggctggggaagcctcacaatcatggtggaaggcaaaagaggagcaaggacacatcttccatggaagcagacaaaaaggcatgtgcaggggaactcccctttatgaagccatcagatctcatgagactttttcactatcatgagaacaacatgggaaaaacccacctccatgattcaattacctcccaccaggtgcctcccatgacaccaggggattattacaatttaaggtgaggttttggtggggacacagagccaaactctgtcattctgcccctggcctctcctaaatgtcatgtgctcacatttcaaaaccaatcctgccttccaactgttcctcaaagtcttcactcattccagcattaacccaaaagtccaagtccaaagtcttctctaagacaaggcaagtcccttccacctatgagcctgtaaaatcaaaagcaagttagttacttcctagatacaacggggatacaggcattgggtaaatacacccattccaaatgggagaaattggccaaaggaaggggctacattccccatgcgagtccaatatccagtagggcagccaaatcttaaagcttcaaaatgatctttgactccatgtctcatatctcggtcatgctgatgcaagagtcggggtcccatggccttgggcagctccaccctcgtggctttgcagtgtacagcatccctcctagctgctttcatgggttggcattgagtgcctgagtattccaggtgcatggtgcaagccgtttgtggatctaccattttaggatctggaggatggtggcccttttctcatggctccactaggcagtgccccagtgaggactctgtgtgggagctcacaccccacatttcccttctgcattgccctagtagaagttcttcatgagggtcccacccctgcagcaaacttctgcctggacatacaagcatttccatacatcctctgaaatctagacagaggttcccaaacctcaattcttgacttctgtgcccctacaggctccacaccacatggaagctgccaaggcttggggcttgcaccctttgaagtcacagcccaagctatttcttggccccttttagccatggcttcagtggcccgggaagaagggcactaagcctttaggctgcatacagcagaagggccctcggcttacctcatgaaaacatttttttccctcttaggtctccagtcctgtgataggaggggctgcctggaaggtctctgacatactctggagacatattccccattgtcttggagattaatgtcttagagattaacatttggctcctcgttacttctgcaaatttctacagttggcttgaatttctccttagaaagtgggttttgctttcccagcacatcatctggctgcgaatgtttcaaacttttatgctctgcttcccttttaaacataagttccaattccaaaccatatctttgcaaatacataaaaatgaatgcttttaacagcacccaaatcacttctggaatgctttgctgcttagaaatttcttctgccagatgccctaaatcatctctctcaagttcaaagttccacagatctctagggcaggggcaagatgccaccactctcttcactaaaacgcagcaacagtcacttttattccacttcccaacaagttcctatcttcattcgagatgagcagcatttagtcaaagccattcaacaagtctctagaaagttccagattctattttcctatctttctctaagccctaagaactgttccaacctctgcattttacccagttccaacatcgcttccacatttttggagatctttacagcagcactccattactcagtataaatttactgcattagtcatttctcacactgctaataaagacatactcaaggctgggtaattatatagaacaaaaaagatatttaatagactcacagttccacatggctggggaggcctcagaatcatagcaaaaggcaaaagaggagcaaggacacgtcttacatgggtgcaggcaagagggtatgagcagaggaattcccttttataaaaccatcggatctcatgagacattcattatcaagagaacagcatggaaaaaaaacagcacccatgattcaattacatcccaccagatacctcccataacacatgaggattattacaattcaaggtgagatttgagtagggaaacagagacagaccatatcaccagccttcatgtttgtctttccctcttgaatgtgagaccaaaggggaaaggaccatgatatgttttgactgaacctctggcacctagagcaatgtcgtccgtatatgtttgctaaatgaatgactagatgcactgcttgaggattctaacaaaagataaacttagctaaataatctgcaaataatcatccttgattatttttctaaccttaaacatttgtattaattataataatatcactcattatttgcttaccatttgccaggctatgttccatgcattttccacattttctctcacttaatgctcaaaactgtgtaggtacatactattaataaaattatttcacatacagaggaaccaatgcatagggaagttcattatcttgccaaggaagggaagtttaaaatgctaagttcgacattctcattccagagcctatgctctgggcctctacaatgcaatttccctcaaaaataaaccctccaggatgggtgggtggctcatgcctgtaatcctagcaatttgggagaccaaggtgggcacattgcttgagcctgggagctgaagacaagcctaggaaacacaaggagaccctgtctttacaagagatacaaatattagctggccatggtggcatgtgccagtaattgcagctactcgggaggctgagttggaagaatcatctgagcctgggaagtggaggctgcagtgagccaaggtcaaataactgcattccggcctgcacgacagaatgataccctgtatcagaaaaaaaaaaaaaaaaaaaaacagaaagaaaaaagcaatgtgaaaagaaggacattaaataagaaaagctttaattctggtgaaaaatgtttctatttcttaaagcaaaaatgtttcacagggacatacattacccacaactttcccaagagctatgaggtggggtcaggggaacagtggttcacatactccaaaggttgtgttacttttctccgtcaagctttctaatgattgag

SEQ ID NO: 17600 - DNA, 36578 bp, Homo sapiens
caggcaatctgcctgcctcgtcctcccaaagtcctgggattacaggcgtgagccaccatgcctggccagagagagctctttcctatgcattcttttgtatttgtgggaatctgcctagtatctttatttccaaatgacatcttggctgggtataatattcttggatcatacttttgttctttcagaattccgtagccagtgctccattggcttctgtctctggaatgttgctgttgagaaatgtaaggatagcctgagtttttttccttgtaggcattctactttttctgcctggttatctgaagttcaataagttaattacaatatttttcaggacagaatattctgtatcaaagtgctttctgtcttgacctttcaagctgtagattagtacttcattttggggcaaacttttgtttttatatttttgaatacttctgttccatttaatgagttctcaatttcagggacaccaataacttctgtcttccatatctatagatttctatctgattgttttaatatctttgtgttttcatctaccattattttgattatttaaaaccattttccatatcaatagttccatttctaggagtgtaaaagtctttaaaaaagaaaagaaaaaactaattccactcctagccatgtctatttggttccttgttttcaggtatttattagtctttggattctcaaatgtgcaacttccctattcatctccttcmgttgttttattatcttggttttgagttcttattctattgagctcattttcttgtcttttttttagagacaaggtcttgctctgttgcccaggctggagtacagtggcacaatcatagctcactgtaaccttgaactcctgggctcaagaaattctcctgcctcagggtcccaagtagctaggattacaggtgcccagcaccatgcctggttaaatttttttattcttgtagagacaaggtgttgctatgttgcccagactggtcttaaactcctggcctcaagcaatccattcaccttgacctcacaaagcactaggattacgtaagtgttagccaccacacctgacctgaggtcattttcttaataaattgttctacagctcaaagcacttggggtgaagttttttgtttttctatttgtctccagaattgctttccactttatttgaaacttatttgtttttcctactgaactgcagttagaagagtgttattttatgcagtatgcagtttttctatgatttttatgcttgtctgaagaggggagagggctgctcatgtgcagcctttgttagaatacctaagttctgcaatcacttctgaggttttgttaagtgtctattccaaagttcaccccactaatggctggtgtagtccatttccatggaaaagatagcttcactttttggaacttctctcagttcagcatgttttcctgagtcttcactgccatcttaaagatttggtctattccatacttcccatttcaagtttttctccccagtagccattttcaattttccagagatgggaggggaaagagaaggaaagcgtttacttttcttctctcttgtaatgtatgtggatatgtttgtgttaattgtcaggattttgtggatctaattgtatgagttttgatggaatgaaggcagaactggaagccttgacatgctccagcccagaatcttctatttatttccttgaccaccacttactgacatttaagatactgacgtttttttgccgtggatacaattttaactttttaaactttcctagatattggttgaaacagagtctgtgagatagctttactccattttcttaatctagaagtctaataatttttaatgtgtgtatattttccatttttattataaaaattgtatatccttgctgtaaaatttcaaaccaaacacaagtatataaagtaaaaagtgaaagttccttgtaatactgccctcaagaatattacttttaacggtctccagatctttttaaatatttattttctttcttttttctttctttcttttttttttttttaagatggggtctcgctctgtcgcccaggctggagtgcagtggctcgatcttggctcactgcaagctccgcctcccgggctcacgccattctcctgcctcagcctcccgagtagctgggactacaggtgcctgccaccacgcccggctaattttttgtattttttagtagagacggggtttcaccgtgttagccaggatggtctcgatctcctgacctcgtgatccacccgcctcagcctcccaaagtgctgggattacaggcgtgagccaccgcacccagcctcttttttcttggcaatgctttgacctttcagtgataatgtacaaatatataaatacacagatgtcttctttaaaaaaagaacagctttattgaaatatattccacatgccataaaagtcacccattttatgtgtacaaaccaatgatttttagtaaatttatagagttgtacaaccatcatatatgtatgtacataaatacatagttattttcttatgccctgtttaacttactctcccagttctaaaatgtacttacctacttacctatgcccacagcatgcccacatggctagaggctgcttttcagaactcttgggtagttctgttcctgtcaattgagctacttgcttactaaatgcctttgggcttattttatttatttattaatatatcggtgatatttgctatcataatttagttaaatttttgaaaacatgaaatatgagcataaagagaaaagagatgtttctgtgaaaactaagttgaatgcattggaaaagcttgttaaaggcaagttgttaaaaaaaattgttaaagtaactctgggtcggaaatctgagagtggaaagtcttccatctagaataatttcacatccaaacactgtggctcacacctgtaatcccagcactttgagaggctgaggcgggaggatcccttgagcccaggagttccaggctgcagtaagctatgattgtgtcactgcagtccaacttggggaatagagcaagaccctgtcgcaaaaaaaaaaaaaaaaaaaaaagtcatcatagcactattcataatagcaaagacatggaattaacctaagtatccatcaacagtagactggataaagaaaatgtggtaggtatacaccatagcatactacacagccaaaaaaggaatgagataatgtcctttgcagcaacatagatggaactgcttaggtcattatcctaagcaaactaatgcaggaaaacaaaaccaaataccacatgttctcacttataagtgggaggtaaacattaagtacagatggacacaaagaagggaacaacagacactggggcctacatgagggtggaaatgaaaagttacctattgggtactatgttcattacggcagtgacaaaataaaacgtacacccaacctccttgacatacaacttacctatatagcaaacttgcatatgtgaccctgaatcaaaaataaaaaacaaaaagaatgttggtctggcacaatggctcacagctgtgatcctagaactttgggaggctgaggggggcggattgcctgagctcaggagttcgagaccagcctgggcaacatggcgaaaccctgtctctacaaaaaacacaaaaaattagcggggcatgttggtggtgtgtctgtaatcccagctactcgggaggcagaggcacgagaatcgcttgaacccgggaggtggaggttacagtgagccaagatcacgccactgcactccagtctgggggacagaacaagaccctgtctcaaaaaaaaaaaaaaattgcattcagattgcttcacaagtgtctttcagttattgctccagtttaaagaaacctttaaagaaattataaatagttcattaaaggcaggaaacttcattgagcgggctatattcacagaaaaatcctgaaactacttcaatttgtaagtcttaagttaaaataaaatgcttatacaataagcttatttttcttaaaacaaaactgtatactgtactgtataatgctttatgattctgcatttttttttctttgagacagagtttcactcttgttgcccaggctggagtgcagtagctcaatcttggctcactgcaccctctgcctcctgggttcaagtgattctcctgtctcagcctcctgagtagctgggattacaggcacccaccaccatgcccggctaattttttgtatttttagtagagatggggtttcatcatgttggccaggctggtctcaaactcccaacctcaggtgatccacctgcctcagcctcccaaagtgcgcccagtggattctgcattttaatcgacttttcaactaacaacttacctctagtcccaatggcatggaatagaagagattacagaccgtgggtttgtaatcgacttttcttttacaacatattaagggcatttttcatgtcactttatgtaaatttacctcatttttcttttttgagagagacagggtctcactgttgcccagggcaacagcgagatcatagctcagtgcaatggcgagatcatagctcaatgcagccttgaactcctgggctcaagtgatcctcccaccttagcctccccagtagctaggattacaggcacataccaccacccctggctaattaaaaaaaaattttttttttgtagagatggggtcttgctatgctgcctgggctgtactctctttttatttattttttattcttattttttgagacagagttttgctcttgttgcccaggctggagtacaatggtatgatctcagcttaccgcaacctctgcctcccgggttcaagagattctcctgcctcagcctcctgagtagctgggattacaagtatgcgccaccacacccggctaattttgtaattttagtagagacgggatttctccatgttggtcaggctggtctcgaactcgctaccttagatgatctgcccacctcagcctcccaaagtgctgggattacaggagtgagccaccgcgcccggccctatactcattttttataaaactggcctcatattattccattgtatagtggatacactctaatttctttataaattatttaaactattttttgatgttttgttgaaaaaaaacttgagcagggaactgatattatgaaggtggattgagggatgaatgtggcaatagagcataaaatgaattaaagaggagagaatggaaaaggaaatggttgatgagagacccttgaaataatccagctgagattaggccagttagtggccatgggtttccccctcactcttatgcatccaacatatgctttcgtccgtcttgaagtcccgacatttctagaaaacacagttgtctttctcctctctaccttagctcatctcagtccttctgaatttcatctttgcttgttgaaatcctacctctccttcaatatccagaacaaaccccacaccctgccatgattggtcctggctggaaaccgtccctccttctttcttccttcctctgtgcatgtttcttgcaaaggcagtacagggcagtggtgaagagcaacgactttggaaccaccaatttgctatctctgtgaccttgggcaccttactcagtgccaattcgcagtgcctcagtgtcctcacctgtcagggggagaagtgcatacagcattgttatgaagagtgaattagttaaaggttgtaagaatagtgcctgatagcatctgatcagcactgaatatatgttagcaattattttgattcaccgcagagggcggtctacgagagcgcagagccccactcggccagcggggtctggcgggggacctgtcgcgctgaaagctccagggtagggccgacgcccatcaggctgggcatccgttcgggatgcgcaggttgcggtctgcaaccggcggcgccacgcccaggcgggcggagcgcggttcccggagtctcgcgcccgcggtcatgtgacacagcgaagatggcgtcgcccggctgcctgtggctcttggctgtggctctcctgccatggacctgcgcttctcgggcrctgcagcatctggacccgccggcgccgctgccgttggtgatctggcatgggatgggtgagtgagtgagaaatttaaaagggtttggcgattctctctcttcctagcctgggttcgcatctgcaaaatgcgggtgtagagggcgaggacgtggtcccacagcacgcggctgcctcgacattttaggatttgaaggatctgcattggaaagagagaaggggaaggagccgtccccttcactggaaagagagaaggggaaggaaagagagagccgcgcacggcgttgaagttttacatgctgtccttgattaatccttacagtagtggcgtcaggatvgcagcatctctcacttggtcaggctaggtgagctgcggctggctatatgactggcgcatctacccttttatttattccttcacacrttgaacagagatttgttaggcacctacagttcatttacaaattgagtaacccttatctgaaatgcttgggactgggaagcatttcggatttttttttttttaatatttgcatatatacaagagatctggggggtgggacccaagtgtaaacaggaaatttatttatttttcatatacaccttatacacatagctggaaggtaattttatgcaatattttaaataattttgtgcaacccatcacatgaggtcaggtgtggaattttccacttgtggcatcatgtctgcgctgaaaaactttcagattttgggtttcccattttcagattaggatgctcaacctatattcatttaacacagttattgagcacctactaggtgctgaggatacagkagggaactaaacagactaaattctttgttcttttggaacctactctccagtaggagaagcagattataaagaaattaacaagtaaaacataacatatcaaatggtgatatgtgcaacrgagaaaaatatagtagggtgtaggataaaaactggaggtgggggcttgcacttttaataaagcaaagttgggaaagaattcattgaaaaagtgacatctgagtacaaaactgaggtagatgaggacagttgccatttggctgtctggtagaaggaacagtaaatgggaaagccctgatgtggaagtatgtctggtgtgttcaagggacagcattcagatcagcgtggctggaaatgagtaagcaaggggaagaagttaggagtttagtttggaagggaggggcaggtacagaagttattgggcctagtaagactaatgcagggactttggctagagtgtcatggggaactttttgagcagatgagtgacatgatctgacacatttttaaagaatcactttagttgctgtattaagaatagatcgtagggcgtcatggatagtcacagggagacaggttaggaaactattgcaataatttaaacaagagatgatgacttggaactgtagagtaacagtagaggtgttgagaagtggtcaaagtttggatagattttgaaggtggattgctaacagatcagacttggaataagagagaaagaaaggagccaaagatgactccacaggttttggcctgaacaattggaagggtgaagttttcattttaccaagatggggaagcctgtaggacaagctgacttagggtgggggaaagatcaagagtctgcttttgggcttactaaacttgagatcctcatgagacacccaggagatgttgtagaggcatttggagtgtggagtctaggacagagatacgggttggagatttaagtagggagtcttcggcatacagctagtagttaaaggctaggtgagaccacctaggaaatgagcgtacacagaggactaagccctgaggcactccattccatttggaggtggaggaaatgaggagaaactagcaaaggaggctgtaaccaaatagccggtgaagtggaggggtcaggaaagcgcagtgtccttgaagccaagtgaagaaaatgtttcaggaagaagggcatgatcaactgcatcaaatgttrataggtcatgatcaactgtatcaaatgttaatgggtcaaggaagataaaggctgacaactgattattggatttagcaatataaagatgattaatcttgacaaaagcagttttgggagagtcgtgatagtgagatctttattgggatgggttacagaaaaatattcaragtaattagagtcagcaaatacaaacacttgcaaggttctccaacaggccctggggctactacagtggggtcaaaagaggacacagggtaggagctttgtgttttcccagagctcacagtcagttacaggggaggcagaggcagttaagtaacctacaattacagctcagtgtggagaacgttgttttcagagaaataaaaggaatagacaattctctaggcagtagccttttcttgttctaaaattggtgcttaagctttctcacaggttgmaaatggaataagtaagttcaaaatgggaaatgatctcagtccacttctactcagtagccagtttgcttcccgttcctagttctagttccctgaaatagaagaaacaagtctggggctaggacaagatgaagaggctcctgaagtgcaaatttaacggggcactcactctcaaattcagggtcaacacttacataaacctgagaatgagtgcctccttaaattttgtgccctagagcgggggtcccaaactccctgggtctgtgacctgttaggaactaggccacacagcaggaggtgagtgagcctgcagccttaccaccatgagctctacctcctgtcagatcagcagtggcattagattctcaaagagctcaaatgctgttgtgaactgcgcatgtgagggatctggattgggtgctccttatgagaatctagcaaatgcctgatgatctgaggtggaacagttttgaaaaattgtcttccacaaacctggtccctggtgccaaaaaggttgaagaccgctgtcctagatgcttaatttgcctcaccctagtcctggccctgaagagaaaactttgcatctgttcaccccaaatatcccctgtgataggggaagggaatgtgtacctctgcttatttttcatttgtaaatttggtgtcttaattatcctatatgggctttttggtttttttgagacagggtctcgttatgttgcccaaactggtctcgaactcttggcctcaagcaatcctcctgcctcgtcttaccaaagcgctgggatgataggtatgagcccatgcttggcctatatggatttttttttttttttttttttgagatggagccttgttctgttgcccaggctggagtgcagtggcatgatcttggctcactgaaacctccacctttcaggttcaagcgattctcctgcctcagccccccaagtagctgggactacagacatgtgccaccacacccggstaatttttgtatatttagtagagatggggtttcaccatgttgcccaggctggtctcgagctcctgaccttgtgatccacccacctcggcctcccaaactgctgggattacagacgtgagccacgacacccagctcctgtatggacttttgaagcttgttattccttgataaacaggagctaagcaaaaaatgttctttcttctattttttaaaattgaggtaaaaattcatgtaaagttaaccatttaaaatggtacaattcagtggcatttagtgtatttgcaatgttgtgcaactaacacttctctctttttcaacaccccagaaaaacacacatagccattaagcaatcactctgccccctcctactacttcttgataatctccagcttagttttctgtatctcagtggatttgcctgttctttatttatcctatgaaaggaatcatgcattatgtggctttttgagtctggcttctttcacttagtataatgtttctgaggttcattcaagttgtaacatgtgtcagcactttgttccttttttataactcagtaatattccattgtgtgaatataccacattttattcattcattcattgatggactgctggattgtttctcccttttgactattacaaacactgctgctgttaacatctatatgcaagtttctgcatggacgtgtgtttttatttctttggggtgtataactaggagttgaattgctgagtcatttagtaatcgtatgtttaactttttgagaaaccaccaaactgtttttcacagtggctgcttattacattcccaccagcaatgtccaaggggtcccatttttctacatcgttgacaatacttgttattttctattaaaaaattattattaaagacatccyagtctgtgtgaaatggtatctcatcgtggttttggtttgcatttcacatgcttttcacatgccagtggttagccatttgtatatcttctttggaaaaatatctgtttaatttcttttcccatttttaaattaggttatctttttgttgagttgtaagtgagttatagattccttgtttattctggatattaagcccttatcagataactgttttgcaaatattttcttccattctatacattgttttcacatccttgataatgctctttgaggcctcagagtttttaaacaataaacaatatttggactcatgagtttccatcattgtgttttgttggctaggagacagctgttgcaatcccttaagcatgggtgctattaaaaaaatggtggagaagaaaatacctggaatttacgtcttatctttagagattgggaagaccctgatggaggtaaggcgcttcacagctgttcctttgaagggttgctgactgatttcatagcatatactgttaaaatgctttgccttgtgttttcagcagcagatcatacagtgatactttcacccttgagtggctcatgtgaggataccaacctaaatgagtttacctcttagagaagatgtcagtggttgttttcagtcccatcctctcacttctctctggcttcttttttaggacgtggagaacagcttcttcttgaatgtcaattcccaagtaacaacagtgtgtcaggcacttgctaaggatcctaaattgcagcaaggctacaatgctatgggattctcccagggaggccaatttctgtacgttcctttttgttatattgtaccacttatatggaattgatttttgtttcttttattyagataaatccactcctccaattcaagattgtcacctatcttggaagggaaatttcctaaaatgttcctgtgtaagaagctttatggaacttaatttcttttcttttttttttttttttgagacagaatttctctcttgttgcccaggctggagtgcagtggcgcgatctcagctcactgcaacctccacgtcccaggttcaagtgattctcctgcctcagcctcccgagtagctgggactataggtgctcaccaccacacctagctaattttttgtatttttagtagagatggggttttaccatgttgtctaggctggtctcgaactcctgacctcaggtagtccacccacctcagcctcccaaagtgctgagattacaggtgtgagccaccatgcctggctggagcttaatttattttctatgaaagttgaaagaaatatttgcatttgcccatatcaggaaaatcctgaaactctgcgggtttggggagtcacagaggatgactagcttaatctgtgatgctgattgtggatgatacatttccatctgacagtcggagctaaaactcccttttattccgtaggagggcagtggctcagagatgcccttcacctcccatgaycaatctgatctcggttgggggacaacatcaaggtaactttgcctctttgctttcttttttctgtattctaacccacatgaccacctgatttaaaaaaaaatctaggaactgtatttgcacaagacatcagccattcttgcaaaatcctgtttctctagcttttaacaaactagccagcattgctggagacataggaagagacttaggattccagaggcctggatcactaggttggcatctacttctctccaatttcattgacacgattgcatggaagtaagatggttatagccacgtggcaggtggtggttgaggagttaggaaaattgagtgaccttttctgttctctgatttggtggtatcctcttgaatttaggcttaggcaaagaatagtgtgtaagctcttgtgtctataaatttaaactctttgagaaacagcaggttttctattttgacggaattccatactattggggaaggatgtgtcattagaatggaatttcatctctgttgtgatgggtatagctattagctggtataatgtgggagcagaatgattctccgtgtaatcaggaaacctggactcacccaattaactattactcctaggcaagtaatttggtatcttaggttccactcacagatggaagaaaccaaaatatggccctgcctgtcctatgggaatttttcagaggataaagtgaaataataggtaggaaaatactttttaaaagtataaggattatacaaacgcaarttggtaaaaacagctttattattcattcatttaacaaatatttattgaaaacctattatatgccaggaacaagacagacaaggttcttgcattcatgaaatatatatatatacacacacacatgtgcacatrtatgcacatacatacatagacatatatatatacacatatgcacctatatacacacatacatagacatatatagacatatatatacacacatatgcacttatatacacatatatacacacacayayatatatatatacacgataaaatggaggatagctgggcacatggtggtgtacacctgtagtccctgctacttgggaggctgaggctggaggatcatttgaagccaggagttcaagacactgtggtgtgctgtaattgtgcctgtgaatagccattgcactttagtctaggcaacatagcaagacccaatctcttggaaaaaaacaacaggatactgtttgaaggacacactagtggttgtagtgcttaaaggagtgggctctggggccaaactgcctgtgtctgaatcctggcttatmccttattgtctaaccttggacaaggtatttaacctcatttttacagttttctatctgtgatatagggcaaataatgaaatctactccacagggtggttgtgaggattaaattaattattgccaatattttgcttagaactatttgtgttactcaaaacaatgttattgatgaggatgctaaggatgaagtataactgggggaggggaaggaaatgggggtgggtactatttgagataaggtggtcagatgtgacttgtgtaggaccaagacctgagagctgaaaatgcgtccagccatgtgatgcaacacatcctccagggatgagcaggtaaaaagatccttaggcaggaaagagtgtagcagcaccaggaggaagctggtgatagtattagttctctgcactttattttcatgaggaataagtgaatgaaatcagagtttggtcctgttcattttgtttctcacagtgccttgtgcatagtgggtattcgatacatcattattgaaggagtggatatttgtcatctaccactgtaggtgtttttggactccctcgatgcccaggagagagctctcacatctgtgacttcatccgaaaaacactgaatgctggggcgtactccaaagttgttcaggaacggtatgtatggttagctgaaaagattacagacctgtcaccgtgtgaaaatatcatgctgactttcatgctcacagtgattccagcagtagttccttgtgatattcaaatgagatctttttttttgagatggagtttcgctcttgttgcccaggctggagggcagtggcgtgattttgtctcactgcaacctctgcctcccaggttcaagcgagtctcctgcctccgcctccgagtagctgggattacaggcatgcgccactacgcctggctaattttgtattttcagaagagactgggtttctccatgttgtttaggctggtctccaacttcccgagctcaggtgacccacccaccttggcctcccaaagtgctgggattacaggcgtgagccaccacacccggccttcaaatgagatctttttgtactatctgctcaatttcattgtaaacctaaacttgctccaaaaagtctattaactaaaaaacaaagaaagaaaaacaagggcatttttctatgtaagaagaatgtaattataacagaataaatttccatccttaaaaaacaaacagaaagcctttagaaagtactaagctcaaggaattattgttggtatttagaggacagattctttatgtcattagctactccctatatcactgtccctgactactcaaatgtatttgggtatttagcatggccagcctggcataatggctcacacttgtaatcccagctctttgagaggccaaggcaggaggattgcttgaagccagaagttcacaaccagtctgaacaacatagtgagacccctgtctctgttaaaatctattttttaaaaaaaaaagatgcagaattacttttgtagtatgtgcttgttcagttggttccaaacttaattgtatatcagaaccacagggaaattcattaaaaatggattcctgggctttatccttagaagttgtgggccgggcatggtggctcacgcctgtaatcccagcactttgggaggtggaggcaggtggatcatgaggtcaagagttcaagaccagcctaaccaacatggtgaaatcccgtctctattaaaaatgcaaaaattaactgggcgtggtggcgcacgcctgtaatctcagctagtcaggaggctgaggcaggagaatcacttaaaaaacccgggaggcggagcttgcagtgagccgagattgcgccactgcactctagcctaggcaacagagggagactccgtctcaaaaaaaaaaaaaaaaaagttttgatggtaggtctgacgtgctcttgatgatagctggagtttgggatcaactaatatcctgtgggttttccaagtgtctcattcttgtcaaataacaactttttattacagtatattcttgaagccattttccaagatacagccttgtgactgactcatgttgtaaccacctacagctaatagctgtcttttcttttcccactcgttggctacacaaatagccacaaagctgttttgggtcagcagtaccacctgatggttattatagaaaactaagatactctgtacctctagctccttttttttaccctcaggctacaccaagctttcccctttgcctggtttgattggctgtggctaattacaacttaattatttatattctacatattctctgttctcatggatttgcatggtatttaaacttcattcttcttcctttactctttattctcactcttgcccagttgcctccaaaamgcctatacttttctttctttgtgtgaaccaaaacaacccttggcgatcagaattctgttagtgatgctaagtgagcagtccgtcggggggtgacaagtgacacctaaatactgattaaggcggggcgcagtggctcatgcctgttatcccagcactttgggaggccttggtaggcagatcacttgaggcctggagttcaagaccagcctggccaacatggcaaaaccccatctctactaaaaatacaaaaattaggcaggcgtggtggtgcacacctgtagtctcagccactccggaggctgaggctagagaattgcttgyacccagaaggcggaggttgcrgtgagctgagatcgcaccactgcaccccaacctagatgacagagtgagactctgtctcaaaaaataaaaataaaaaatactgattaaaagctatagattgatgtgtttatcttcacttcctccttaaactttaattaagtggtagcagaagaataaaaagtgataaacccacaagggcagagagaacagggagagaggaggtaagagatcataaaaaatggcaacatgtttttgaaagcaagcaagcagatgaatgagtgtgagaactgttttagcagagcagatggtgaaggcttaaagtaataaagagaaatcattttgtctttgtgatactgtcccaggttgcccctggtattagggaggattaattctggttgcaagaagaaacccatatcaagccaaagtaaattttaaaagaaagtaatactctgttggtgcctaaagcctcatagggcctagaatcaagaattgggagccatgaggagccagggtattctctctccagtgccattgttgcttctctctctgtgtcgctgcttctttctctccatgcagaccagcttcccctgccacccacatgatggaaggtggcctcgcacggcttccaaatgtttaattttctgttaggagattgtctcagtctgaggctagactctctttgtcccgattcagattcttcaggaagggaccatgccccagctcaggtcaggtctccacctctgctctcattagctgtggccagagaagtgggaccgtgcttactaaccataccccacctccctgtaaaccagtaggccgggcaggaagagtgcaagagaggcagagaccccaaaagatgtcttccacattcttcagataacttaaccttagcaaagcaaacgtgatatcctaatacgcacagtaactggtggggaagcccccggcttggcatggtgagggcaacgaggaatggtataatagttctctctctccttcctggatgtaaaactaccctctagttcccttttgcctttgcagatgctgtcagcccttcctagccttctccttcctccggtttgctccctgccatcccctgccccacgctctaccctcctacctctacactccctgccacaatgaatgcttcagtgttgccctggccttggcctccgtcttcccccgtaccagctcagaggaagctagagctttacatatcctgtttaattttcatagcaacttgccttccccaggtctgctctgggccccgctcccagtttgcaccccaccctcagtggatctcagagtgcttttcctcaattgtccagttttcccatgtctttgccctcagccgatgaacttgcaacttggttttctggaaatattaaggcatctactcaggctctctcagagactttcagccattcaaaaaagttagagagtaatgtaacgaactacaggcatacctcagagaaactgaggatttggttctagaccaccacaataaagcaaatattgttaatacagcaagtcacacaaagttgttggtttcccagcgcatataaaagctatgtttacactatactgaagtctattaagtgtgcagtagcatcatgcctaaaaaaagtacatgccttaattagaaaatactttattgctaaaaaatgctaatcatttgagtcttcagcaagtcatctttttgctggtggagggtcttgcctcggtgttgatggctgctgactgatcagggtggtggttgctgaaggttgggatgtagggtccagccccacagggtcggtgggtttttctccctgtgtgcggagatgagagattgtagaaataaagacacaagacaaagagataaaagacagctgggcccgggggaccactaccaccaagacgtggagactggtagcggcccygaatgccaggctgcgctgatatttattggatacaagacaaggggggcagggtaaggagtgtgagccatctcccatgataggtaaagtcacatgggtcacgtgtccactggacagggggcccttccctgtttggcagccgaggtggggagagagagagagaaagacagcttaggccattatttctgcatatcagagacttttagtactttcactaattttgctactgctatctaaaaggcagagccaggtgtacaggatggaacatgaaagcaggctaggaacatgaccactgaagcacagcatcacagggagatggttaggcctccggataactgcaggcgggcctgactgatgtcacgccctccacaagaggtggaggagtagaggcttctctaaactcccccggggaaagggagactccctttcccagtctgctaagtagtgggtgtttttccttggcactgacgctaccactagaccacggtccgcttggcaacggacatcttcccagacgctggcattaccgctagaccaaggagccctctagtggccctgtccgggcatgacagagggctcacactattgtcttctggtcacttctcagcatgtcccttcagctcctatctctgtatggcctggcttttcctaggttatgattgtagggcaaggattattataatattggaataaagaataattgctacaaactaatgatgaatggtattcatatataatcatgtttatgatctaggtctaggataactcttgttgttttatatattttattataccggaacagctcatgccctcggtctcttgcctcggcacctgggtggcctgctgcccacattggggtggctgtgctaatttcttaaagtgagacaatgatgaactttgtatcagttgactcttcctttcatgaaagatttctttgtagcatgcgatgctatttggtagcattttggccacaatagaacatctttcagaactggagtcaatcctcaaaccctgccgctgcttttatgtaagcttatgtaatatttattctaaatcctttgttgtcgtttcatcagtgttcacagcatcttcaccaggagtagattccatctcaagaagccactgttttgctcatccgtaagaagcaattccttatctgttttttkagattgcaacaattcagtcacatcgtcaggttccacttctaattctagttctcctgctatttccacatctgcagttacttccttcattgaagtcttgaatccctcagccattcatgagggttggaatcaacttcttttaaattcctgataatactgatattttgacctcttcccrtgaatcatgaatttttgtttgtttgtttttgagacagagtctcactctgtcacccaagttggagtgcagtggtgccattacrgcttactgcaacatagcctcaacctcccaggctcaagcaatcctcccacctcagcgtcctgagcagctgggactacaggtgtgagccactacaccccactaattttttamtttttttgtagagataggatctcatttatgttgcccaggctagtctcacactcctgggctccactgattttccctcctcaccctcccaaagtgcatggtacccagcccgttaatgttcttaatggcatctagaatgataaatcctttccatcaggttttccgtttactttgcccagatgcatcaaagggatcactgtctatgcagctacaaccttgtaaatgtatttcttaaataataagacttgaaaattgaaattactacttgatccatgggctgtagaatggatgtgctgtggcaggcatgaagacaacattaatctctttgtacatctccatcagagcgcttgggtgaccaggtgctttttaatgagctgtaatatttgtttgttttttgagtttgtttttaaactttttttaattaaaaaaaatagtttttgagacagggttgtgytctcttgcccagactagagtgcagtggtgtgatcacagctcactgcagccttcacctcctggactcaagccatcctcccacttcagcctcctgagtagctaggactacaggcatgcaccgccatgctcggctacttttaaaaagaattttcttttctagaggtggggtcttgctatgttgcccaagctagtcttgaactcctggcctcaaayggtcctcctaccttggcctcccaaagtgctggcattgtaggtatgagccaccatgcccagctgcgtggtaatgttttgaaaggaatctttttttctgagcaataggtctcaacagtgggcttaaaatagtcagcaaaccacactgtaaacagatctgctgtcatccaggctttgtgttccatttgtagagcacaggcagagtaatttagygtagttcttaagggccctaggatttaaaaaatggtaacccagcattggcttcagcttcaagtcatcagctccatgaggcactcacaagagagtcagcctgtcctttgaagttttgaagccaggcattgacttctcctctatagctgtgaaagtcctagatggcatcttcttccaatttaagactgtttcacctacactgaaaatttgttgtttatggtcgccaccttcattaagtatcttagctagatctcctggataacttactgcagcttctacatcagcacttgctgccccatcttgcactcctgtgttatggagatggtttctttccttgaaccttacaaaccaacctctgctagcttcacrctttttttctgcagcttcctcacctctctcagccttcattgaattgaagagagttaggacgttgctctgrattaggctttggcttaagggaatgttgtggctggtttggtcttctatctagaccactcagattttctccatagcagcaataagactgttttgcttccttattatttgtgtgttcactgaaatarcacttctaattttcctcaggaactttttttttttttgcattctataaatgttcagagttctaaacctttaaaaggtttcaaatacaygtataaacacattctagaatgtcactctgactgttgcttcctttaacttcagtctcatctgctcctgggagggagagctccatctctgacgtarctggctctgttgggctttagcgccagcctgctccacygagtggsgttttcaggaccactgcctctgggcagctcttccactctggctacggagcgtatgttgtagaaattttgatttctctccctgccaacctgggatagagtttgttcgaatttccccatgtgaggccktggggtaaccgtgcccattttgaggaggtgggggctggaagggaagaggaagtggagagagattggaaagaaagtataaagagtcccctttgctccagttcccagcaagttcctcatctccatctgagactacctcagcctggaccttattgtctatatcactatcaggcttttggtcaaagccattcaacaagtctctagaaagttccaagctttcccacattttcctgtcttcttctgaggcctccaaactgtgccagcctctgcctgttacccagttccaaagtcacttccacattttgggtaacttttcagcagcaccccactctactggtacttatttactgtattagtctgttttcatgctaccgataaagacatacccgagactgggcaaatagaggtttataatggacttacagttccatgtggctggggaagcctcacaatcatggcggaaggcgaaaggcacatctcacatgacggtagacagaagaagagagcttgggcagggaaactcccctcttaattttattttttatttatttatttatttatttattttttgagatggattctcgctctgtctcccaggctggagtgcaatggcgtgatcttggctcactgcaacctcagcttcccaggttcaagcgattctccctccctctgcctcccaagtagctgggattacaggcacatgccaccgtgcctggctaatttttgtatttttagtagagacggggtttcctcatgttggccaggttggtttcgaactcctgacctcaggcgatctgcccgccttggcctcccaaagtgctgggattataagcatgagccacagaatctggcccaactcccctctttgaaaccatcagatctcatgagacttattcactgtcacgagaacagcacaggaaagacccacccctgtaattcagtcacctcccatgacatatgggaattgtgggagttacaattcaagatgagatttgggtgaggacacagccaaaccatatcagcatgataagtatgataaaccccagtgtcacaggagaagcaaatattgatgagtcctttgcctgaatcttttataatttctgtactatgctgaacagtctgtctcaacaaggtgtcttgttgacagactgtttcctaggtgcaagtcttgtcttctgtattaaagggtaaggcctgggacttgagggctttggccttttgtccttgttttttgagacagagtctcactctgtcgcacaggctgaagtgcagtgctgcgatctcagctcactgcaacctctgccgccggggttctagcagttctcctgcctcagcctcccaagtagctaggattacaggcgcctgccgccgcgcctggctaatttttgtagttttagtagagacggggtttcaccatcttggctaggctggtcttgaactcctgacctcgtgatccacctgcctcagcctcccaaagtgctgggattacaggtgtgagccactgtgcctggctggccttttgtccttttaaagtctcttggtggcctttgcactgagcatgccctgggcgtactgactgacctgtagcttgatcacctcattctttttttttcctacagcctcgtgcaagccgaatactggcatgaccccataaaggaggatgtgtatcgcaaccacagcatcttcttggcagatataaatcaggagcgggtaagcacccaaaccgggctcccatagatgtgcgttctttttcctgtttaggtcttcataaacaaatcagcagtgactgtttacccaaactgtcctgggcagacmctaggaaagagaagttctgttttttttgggaggcagggcctttgagattcagttccctttagggaggttgaaattcatttgcctttcttcccttaagttctttccctctcctagtgttgaaacacacaggataagctcggcaggttgctgactgggcgaggtggaaattcacagctgctgtcttaatgagggaagctttcctgatggatcagtctgggggtggatttttctctagagatttacctaaaagagagatacagtaggcactgagtatgtcccagacacaaacatggtttggtaggttctggtaaactagatggctcagtttatatttgactcatctggagagtcttttggttttttgttttgaaacagtttgaagggaaaaacaaaccaaacaaaaaacaacacagaatagtatatagcagaacgacccagaatttgcagtttcttattttgtcttggctttctctgactagaagcctctcacctatgtgatggacacctatggagtgtggtgtaaactcatagttgtacctgtatgccatgctcagtggcatgtcagtcagataggatggtaagaaaagcctatagaaggccgggcgtggtggctcacgcctgtaatcccagcactttgggaggccgaggtgggcagatcacttgaggtcaggagttcgagaccagcctggccagcatagtgaaaccctgtctctactaaaaatacaaaattagctggatgtggtggcgatcacctgtaatcccagctactctggaggctgaggcaggagaatcgcttgaacctgggaggcagaggttacagtgagctgagatggtgccactgcactctggcctcggtgacagagcgagactccatctcaaaaaaaaaaaaaaaaaaaaaaaggaaaagaaaaggctgtgtaagcaatcccgtgactgggtatatacccaaaggaaaacaaattgtcctgccaaaaagacacttgcactcgtgtttattgcagcactgttcaccatagcaaagacatgaaatcaacctaggtgcccatcagcggtagactggatagagaaaatgtggtacatatacaccatggaatattacacagtcataaaaaagaatgaaatcctgttctttgcagcaacatggatgcagctggaggccgttatcctaagcaaatgaacacagaaacagaagaccaaatatcacatgttctcacttataagtgggagctaaacattgggtacacgtgaatataaagatgggaacaatagacactggagactccaaaagctgggagggagaggctagggctgaaaaacttcctgttgggcactgtgttcactatctgggtgaaaggatcaacagaaccccaaacctcagcatcacacaatatacccttataacaaaactacacatgtacccccctgaatctaaaataaaatattttgttttttagaaaaaaagaaaaaaaaaagctgtacaggtatatcctggtcaggaagctggaaaacagcccatacccatggggaagaaacacagtggcacagggtcagggagaccagaaaacaggaaggctttactccctctgctggtgtctgatggtaatgaccttaggtgttgctggcctttctttcagggtatcaatgagtcctacaagaaaaacctgatggccctgaagaagtttgtgatggtgaaattcctcaatgattccattgtggaccctgtagattcggaggtgagacactacttaggccacatgccaggagagtaaatggcattaaaatagggctgctggccgggcacggtggctcatgcctgtaatcccagcactctgggaggccaaggcgggtggatcacctgaggtcaggagttcaagaccagcctggccaacttggtgaaaccccatcgctactcaaaatacaaaaagaaattagccgggtatggtgacagccatctgtaatcccagctgcttgggaagctgaggcaggagaattacttgaacccaggaggcagagcttgcagtgagccaagatcgtgccactgcrccccagcctgggtgacagagcgagactctgtctcaaaaagaacataaaatgaaattgaaatgaaatgaaaaaatacagctgcctgctggggaaaaaaccttcagtcccttccaccaacttttgtataaaacagttcttcacctgaggtccataaatgggacactgaagattgtaatcaatcccccaaccccaaaattctatgcaaaattatgtaattacattctctggggaaggatctataattttaatccattttccagagatcagagacccaaaaaatgttcagaatcactagcccaaaatatataaattcctaagcttggcctccaaggtctgccttgatctggcttcaccccattttccagcctaatctgccttgtctgcacgcttcatacactcttgatcaagccatattgtactacttgtgctttttctctcgtatgccttggttcatatatttctgtctctagaatgcccttccttggcttctccacctaacaatttctattcgtctgtcaaggcaaggatgccatccccattccaagcagaatgtgatcgcttttttagaatcatcagcctctgttaaaacactcatcacgttatgtcacaccaccagggattggccgattgtggcccacaggcccagtccatcctgctacccgttttggtgctacccacgagtaacaccaaacactaacataaaagaatgtttttaacattttttaatggttgggggaaagaattggacatataaagattatgtaaaatttatttagacatatcaagtatttggacatataaagattatgtaaaatttaaatttcagtgtccttattggaacagttttagttactttttacatactgtctgtggctgcatttgttacagtggcagcaatgagtrgttacaaccatatggcccttaaagcctaaaatattttgtatctggcctttacaaaaacgtttgctgacctctgtactcaagagtgaattgtttccgtgccttgcaagactgggagctytttggaaacagattatgtattcatccttgaatgtctagagctcagcacaggaatttttcacatttattgcttaataattttaggaagcagaaattctggggaagtggaaagcggcctctcagaaagattaactcatccctcgggctccacccttaagaagagatgactcagacgcaccctatccatttttccttcttcctacagctttatgatgttcactttgttggcagttttagcttctaaccagtctcaaattattttggcagtatgtgctgtgtgtcatatctgagcttctttcctttgcttcttctgcagtggtttggattttacagaagtggccaagccaaggaaaccattcccttacaggagacctccctgtacacacaggtaactggcagggagtctatcttgggaggttggtgttttttcagctcccagttcctgaagctgctatgttctttggtgctggagccctttcctttacacctcagagcactaggtactcctgaaacacctgactcatgtccaatatgggtgaagcttgttaggctcttgattatgtgctctagcttattaggcactgggttacaaaaatccactacatcctgaaaccttatggtttccaaacaacaagagaaacctcatgtctgattcccttcttttgataaaaaggttttaaaactagctgccttggctgaggtacagtctgctacaaatccaggaagcctccatgcatgatgaggggcattcctttttttttctttgagacggggtctcgctctgtcacccaggctggagtgcagtggagcaatcttggctcactgcaacccctgcctcccagattcaagcaattctcctgcctcagcccccttagtagctgggattacaggtgtgtgccatcacacctggctaatttttgtatttttaggagagatggagtttcaccatgttggccaggctggtcttgaactcctgacctcaggtgatccacccacctcagcctcccaaagtgctgggattacaggcgtgagccagtgcgcctggccaagggacattacttttaaacattaatagatgtgaaatcctgtttctaaattacgcactgacaagggaggctcctgcaggaggttgagtgggactagagttttgaattttgtttagcagtaggtcctgtatcttaagcagaagttgcagtaatttgccacctccagttctggggccttctacactttaaggatttttttttttttttttttttttttttttttttgagacagtcttgctttgtcacccaggctggagtgcaatggtgtgatctcagctcactgcagcctccacctcctgggttcaagcgattatcctgcctcagcctcactagtagctgggattacaggcacacgccaccatgcctaatactttgttttgttagtagagacggggtttcaccatgttggccaggctggtcttcaactcctgacctcaggtgatccacctgcctcagccttcaagagtgctgggattacaggtgtgagccaccacgcccagccctaaggattttatattggagacagactctccaaaatgctaagtactacatctgaaccaatcaccgtctactagaattcctccatgttatttcagaggtcatttgtctcctcttggcttggcttttcttttgcactgggtgcctcaacttgggtggtgaggtaaaaagggaagctagaatctgatttgagaaaaaaaaaaaaaaaaggcttcaraaattacagctaagaacttccttactgtgaaaactcaaaatgatgttggccacggcagaagcaccattctggcactgtcgtaactgcttatcttcccaaccagaggttgttctccagcatctaggctatgggtaatgacattttcaactccagaatatgaaagtgtccagggtttgttacctaacggttggatatggtttttctgttttgttcttttgagacagttttgctcattgcccaggctggagtgcaatggcatgatctcagctcactgcaacctccgcctcccgggttcaagcgaattctcctgtctcagcctcccaagtagctaggattacaggtgcccgccaccatgcccagctaatttttgtatttttagtagagacaaagtgtcatcatattggtcaggctggtcttgaactcctgaccacaggtgatccgcctgccttggccatccaaagtgctgggattataggcgtgagccaccgcgcctgtcctgggttggatgttttttaagttacctagctaatgttctgtctttggctcagtcccacttacctatggcattctgaggcagtgtcgtctatggcttgcccacctataggtagtcctctgactctgagcttttcaaaaatcagaatctagaacactgtatagagcaatctcaattgcatatctatttttaatacttagaaaaaactggccgggtgtggtggctcacgcctgtaatcccagcactttgggaggccgaggcacgtggatcacctgaggtcaggagatcaagaccatcctagctaacacagtgaaaccccatctctactaaaaatacaagaaattacccaggcatggtggcatgcgcctgtaattccagctactcatgaggcagaggcaggagaatcgcttgagccagagaagtggaggttgcagtgagccgagatcgcaccactgcactccagcctaagcaaccgagcaagactccgtcttgaaagaaagaaagagaaagagagacagagagagagagaggaagaagaagaagaagggggggggacaggaggagggggaggagagaagaaagaaaagaaaggaagaaagagaaagaaagaaaaagaaaaaagagaaagaaaaagaagtaggagatattctttttggcatttttgaaaatacacctcaattttaatactcaggacaaactgcattttgaaaatatatctcaagttaacgtacttaccattttactccaaaacttcattaagctttttaattaattatggcctttccttctgcaggaccgcctggggctaaaggaaatggacaatgcaggacagctagtgtttctggctacagaaggggaccatcttcagttgtctgaagaatggttttatgcccacatcataccattccttggatgaaacccgtatagttcacaatagagctcagggagcccctaactcttccaaaccacatgggagacagtttccttcatgcccaagcctgagctcagatccagcttgcaactaatccttctatcatctaacatgccctacttggaaagatctaagatctgaatcttatcctttgccatcttctgttaccatatggtgttgaatgcaagtttaattaccatggagattgttttacaaacttttgatgtggtcaagttcagttttagaaaagggagtctgttccagatcagtgccagaactgtgcccaggcccaaaggagacaactaactaaagtagtgagatagattctaagggcaaacatttttccaagtcttgccatatttcaagcaaagaggtgcccaggcctgaggtactcacataaatgctttgttttgctggtgatttaaccagtgcttggaaaaatcttgcttggctatttctgcatcatttcttaaggctgccttcctctctsagtacgttgccctctgtgctatcatcttatcatcaattattagacaaatcccactggcctacagtcttgcttctgcagcacccactttgtctcctcaggtagtgatgaattagttgctgtcacaaaaggagggaagtagcacccaaattaarttgcttaagagaggaaatgtacatcttgtataacttagggagcgaagaaaatgtaggcgcgaaagtgaaaagtgaggcagctagttcttcctattccattctcgaccaacctgccctttcttaatatgactagtggtcttgatgctagagtcaacttactctgttgctggctttagcagagaataggaggaaccatatgaaaaagatcaggctttctgacttccatccccaaaacacatttaccagcatactccaaactgtttctgatgtgttccatgagaaaaggattgtttgctcaaaaagcttggaaaatactacacactccctttctccttctggagatcaacccacattagagtgtctaaggactcctgagaattcctgttacagtaaacaaaactaacgtaatctaccatttcctacactatttgagcatggaaatcatagtccccactctgtgaaaacttaacgctttttggaagacatttctgtagcatgtcagtttggagaaatgatgagctacgccttgatgaaagaaccgtgttggtgctgctaagtttagccattatggtttttcctttctctctcttaagccttattcttcaactaaaagatgaggattaagagcaagaagttgggggggatgtgaaaataattttatgaggttgtctaaaataaagagtagtttcttatccttggtgttttcagtattttttgcatttctgtacagccaatatcacaggtaaacaactaagcaagtttggtattaactttattctattttctgtataactttaagtacataaaggtttatttccacaggcctcaggaaatgggtagaaatcacaggacaatctctcttcccaccaaaaaaaagttgcatattttggtaagtgtttgtcctagagggaaaaacaactgaaatttacattagcagtgctgtgcaagattcttacataattcaagacctaaaaccagcctgcagtggaggtttcagtcctctgttcaggtgcttagacagaagccataagctgatgagcatgacagggaaaaggaggcagtgaagacaggtgacaggcacctggcagggaagaaggattcaggaatgccagactccttgaaatcatgtgggtttgttttttttttttttttccttttaaagtcatctctataggaaggtgctgggcagggatcccagagaaagaaagggtccaagactccattaactgccctggatgaagggcactgctacagcagctagtaccagagactctcctatctcacggttgaggcagacccaggatagaatagagaataaaaggaatgcttataggaaacaattttgtatggaatgctagatggccaagcctcagcctttggtccagtgcaacccttgcctcgcttgtcaacagtgaaaaattagtttggttagaagaaccatctggaaacacaccagcttctgctaccttcatgctcattgttaaaaaaagattaaccagtgtgaacattctgatctgttaattccagggactgttttctttccaatggactgtttgttggtagaataacccccaaaagctcaaagctaaaatgcatcatcagtcctagtcggcagttccttaagaatggactggcggcgtggttgagctgatatggaaaagctgcaccttcctgcagaagatcaactgacctgctatcccaccccaaatttcagcctgaggtatatttcagtgaaggcaggtagctgtgcttctcagagcagagaagcagttttaagagcaaaaaggtagaggaaatctagaaaagaaccgtcttgatacagatttatcccatggtgtgaagggagggcaaagaacccagtggcacttcgcttatccagcaatttctgtcactgtggtgaccaacttctgcccgttccatagggtcttgaactgctcaggaactgggaattcattctgcaaataaagaagagacagcaggtttaaatctgagctaaagaacagctggggctaaatctcacacatttctcccaatgcttgcttccacttaaccccaggagcacggtacaatgtagcaagagacaaacccacagagccatgctatgttctagtgttcagcgatcttggacagactattaagtctatggggtgtaaataacagtacatatggctttatagcaccagcctgacaaggtgccatggctcatccccattattttttgctaccttgagctccacttaggcagaaagcacctacctttggggctccactacatgggactacctcatttctgtgtacttttggtgtgcattattgggtttttacctgctcagtgcagaatgttcataaaatagctttcttcaatgccagaaatcttcagtcccttctgtttttaacatcatactaaagagatcaagaaacttacaaagtcaccgccttctgtaggaatgaggacattcatctcggaagatttggcactgactatttcacaatccagggaattcttgctcaggtaagcatggcagccatctgttttgttgatggatatggttggcactttacccattacctgcagagtaaacaaagagaactgagtcccagtggttgggaaggacaacagtaagtcgcaggaaaaggtttcctgtttcacgtgactcagcaactacatgaaaagctcacagatgcgcaagacactggatactcgggtgggttgggatgggtcctgaaaagaacttgcttgaagagccaacccttcttctgccacgtccaaagcagctcagcttacagactttgtagaatcagattcccaccaaagcaacatctgtgggtctaccatgtctctttgaattaattcctcagggacaaaaagaaggagccaaaatatcgagttacctgaactttgacatccttactgttgattatctccacaatgcccaccacgtcatcgaataccaggccaagtttcttacagttatctaggagaagaaagggagtgtgtcaacagtgtaactttaaaggaaagtaatatacatttaggaatctttaaggatagggtaggtaaaatggtattagccttctcgggctctgggacggggcttgcgtgggacagcgacaaagactcacctactgtaatggagttaattttgcccttgatttgcaatgtcgtgttgacacacttgtatatgtaagccacctgtttcagctctgtgtcctcaatcaccaggttggaaacattttcctgattttcctgttagagagagatcccaggattctcatcacaaagcacacaccgaacaaaaaataaccaggctatcccaaactttttgttcttgcaattgaagccagaactctgccctcatctagctaagctccatttaacctcctgttcctactccttttccccgggaggcggaggttgcggtaagccgaaatcgcgccactgcactccagcctgggcgacaaagtgaaactccatctcaaaaaaataaaataataaaaatacctgcccctgtctaggtatttttaactcaccactctccacttcttgccctccagttcaagtacagctggctccttctttgtggctcgtttgggggatgggctggtttggggtttaggtgcagagaatggtttggggccactgygtactggaccactctgagccttcagggcagggttcttgtgagtcttcatgtcatcagatacatgtttcagggctgtaagaacaacagctaccttgttcctgtccttcataccagacctttgagctgctatcgtcatgttaaacatccttaacagaaaattcaaagccaaaaccagagcctttgagatgttctcttgcaagcagttttggaaaagtacttttatcatttctcttctccccaagattaaattatatggttccattaacaacaacatggaatgtgtgtatattgtgggtgaggataaggatatgtaaatccttatcctctatgtctagaaagacatatcaaatgtatgtgcacaaatatgtaatttttaaagcaataaagaaaaatgagtggtagtaaagaaaatttggtaaaaggaaaagaaaaaaataccctcactccccacagctaaccctacttcccccacctcctcagtcagtgttggcatttgcaactctacaatattgttttctacatatatttggttttgttggttataatcatacagattgttaacaaatttagttcaactattgacacttaaaaactttctcatgttaacctgtagtttaatatctttctaggccaggcgctgtggctcatgcctgtaatcccacactctgggaggccaaggcaggcggatcacctgaagttaggagttcaaaaccagcctggctaccatggtgtatttttagtctctactaaaagtacaaaaaaattagccgggtgtggtggcaggtgctgtagtcccagctatttaggaggctgaggcaggagaactgcttgaacctgggaggcagagattgcagtgagccaagatcacgccactgcactccagcctgagcaacaaagtgagactcccatctcaaaaaaaataaaataaaataaaaaataaaagtaaaaatatatttcttttatgttttaagggaaaaataattcatcatctcccacagcaggctgacacacgcctcgctttgaacatggccagatctatgttaactgtataacaaatactgaatggcctttttatctccaccattccttgtggttgtaatttacatactagattttttttttcttaaacattacatggttcactgtagaaaaacatgtaatggtggcacaacatttcatcaagaggccgggcgtggtggctcacacctgtaatcccagcactttgggaggccgaggtgggcagatcacctgaggtcaggagtttgagaccaggctgaccaacatggagaaaccccatctctactaaaaatacaaaaaaaaaaaattagccaggcatggtgacgcatggctgtaatcccaggtactcgggaggctgaggcaggagaattgcttgaacctgggaggtggaggttgcggtgagccgagatcgcgccattgcactccaggctgggaaacgagcaaaactccgtctcaaaaaaaataaaaaaataaaaaacatttcatcaagaggacatgtggtagttagccatttctcttacagttggatttaggttgttacaccatttttagctactatgatcatagattcctagaagtggctggacaactcagacttccaccagctgtgttaagggtatctactttataccaacattaggtcactctcatgcaaattttccatgtaaccagtatgcatcttctgaggaagttaactccctaacacaatgccttcccagaggccatgtggtgccacggaaaaagctctggggaaaaccgccagctctgtgccttggcacaagagggtcctctatatatgctacctaatattaagtcactttcccatggggcagatggcttcctccaactgtgatcatcattttcaatttccatttaagccagctttgccgtcccttaaaggaacaggacacaccaaacgagtctccaccacacaagccagggttgtagtttacagacggttctggttggtggsgtctggcccacacaacttgttgtacctactgttcgtgtccaagtgctcactcaccatgtgtaatgctctccccctgattaatctgygcgaacagtgctgagcgggaagcagactcatctgagcctgaactggtagagactgggggaggaggggggcctggtggagggggaggaggacctgatccggcagagggtccagatggcagtccgctcagttcttttgccacaggcccctggaacaataagtgcaggtaacatcatcatcctctctgctcccctctgtaccattcccagtagtgccctacatgggccagtgcacatggggtccccaccacagcctttgaggcaatgattaatgtgtcctacccatacccaacttggctttatgccttctcaccctttcccaaggatccagctctcagttctatttcttgaccatcacattttgcctttgaactcacctgattccagctctaaaaactatttccacaaatctacttgacatcttccttagtgtgttaccagtacctctgattcaacagattcaaaactgatttcatcatttcctgccgctcctctccctgtacaatcatccccttgtccctatttcagtgaaagatgttactatccaagactgactattcaatcttctttgaggattccaacttcttcgaccttatcaaatctctattatcttggtgctatctcctgcaaatgtttttctactatcccccaaacaccatgaccactttcataatctgagcatgagtccttatccctaacctatacactgagactcttttaaagacaaattgaatcattatcactcccttgctcaaatacctcatcccaaagtctcagcctaccttcctttccagccttttctcctaaaattctgatcatttccccttattgaagccagagatgaccaatctctacatttactctgcatgtattttgtttaagctgtgccttttgtagtatcccacttctcactgccctatactactttcaagtctcacagaagagtatataccttcaaagtacaatctcttctagt

SEQ ID NO: 17601 - DNA, 16509 bp, Homo sapiens
agcggaaagacccaccaaggccaaactccgagatctacatttggaattttccccctttgattagttaaagacataaaaggtcaaattatcaatatttaatttgagtgaaatgcatttgttataaaggaaagaagacattttatttaaagaaggtgagactccagggatgaattctttaatcaaaaatgattatatttctcattacagtgaagtgtgaataatacttgataaggattctgtttactaataataatgatgttttgaaaattacatcaataagtgtgtggtgggggagggggatatggtgtatatatttctcagatgttcaaagtaccaaaggagctttctcttctcagttatgtctttactagacttttccagtatatgctggataagttatgactactcattatgyaatattttagatctggcatgatttagctaattgtgtggctcactgaatctgagtgaataatgccatttaacttctgttggcttattttttcatgaatttaccagaaattgtttacagtatgaaataactgaaatgttgataaagtggtggtgaaaaagattttatattttcaataaaacttatactccataaaacacaagcaaaatcaaaaacatttttagagatattttattatttctatggacagtaaacaagaaattcattttggttttgaagctgtgtggcaaataagtgcaaatattggaataatgactatctttttgaaagctattcaatttatgatttctgtctttgtttcagactagccagctcaaattatagtttaagctctttccttgcccctaaatctggctacctagttttataggaaacttactgtgaatatgtgcctaattagatgcagacttacaggtctctttgactaaaagctcagtcatggcgccccatgttttttgtttgtttgtttttgtttttgaaacaaagcaaacagggaagagtggaaaggaggaagggaaagaaaggaggaagaaggggagggaggaaaggaaggaaaggaggaggaaggggagggagggaaggcaggaaggaaaggaggaagggaggaaggaaaggaggaagcaagggaggaagagagatttttgctgaatctagtaggccgaaggtcagggccgttggagtgggaattgtccacggtgctgataggttgaggaagtcattccttccacaattcgcctggggccctaaacctggtttgcccgcgttcctcccgtgcctttaggaacttgtccgggtcctctctcccaacccactgcagcaaccattgttcttgcgacgctccggcgccgtcggtgtgtctcggctctccactcctgaagctacacacagctaccgaggatttttgtttgcttgcttctttctattaaggcaaaggttggcaaatagcgtgtgcttgtcagttccctggccctgcgatcccctttggacagcaagctgttcctcgatccccgggaaacaggtgtgcgccctctgctcacgctcctcacccgaaagcaggtgcgaccgtggacatacacttaacactctcacacccatccacttatgcccactttcacatacacattcacattcattgacacacacctgcacacactcatatgttcacatacacactaacaatcacacactcattatatgcacacacgatttgcacacacattcacataatcttgcacacacacggattcacacacgtacattcaagtgcaatcacacacttttgcacacacagggcatcggacgcacgaggccttgagcaattgtgcccgtgacctacgactgccaagatactcctactgagttgattttacgttgttgattctgagtgttggatggtttaaggaaagcccctggatcctgacagggaatcagagacaagtccttccaaggcctgtgggagccgacaaaggagccaccaaagccccgtcgggaccgggagggcataaataataaataaaaaggcccaggcaggccgagctggggaagcccggcactaaatcactccctaaatcacagtcgcgtcgtgctccatccaatagctctaagcgatttgtggggttgggggttgaaatcaattttttccgttctcgcaggtgcaatatgaatcaattatcttaattaagattatgccgcaagcccaggagatttggggaggatgggttttgcgctcggggcgacggcgaggcattttaatagcgtctctcgttgctcttggctctcccgggtcgcctgcctgtcgagcctgggcagctccagcctcaggccaggacccgggagcccaactgcctcccccggggcggaggcgccgcgtcggcggtctggtcagaaccsgcatcaaccccccttcatcccccgaagctctcaagagcctccgagctacccagcctgtgcaggacctgcagctctcagccctccgttcctgcggcccctgagccccacggtctcgcgggcccctcagccacccggccccctcactccgctctcccgcgcccaggccccgacaccccactcctaggcagggcggggagaggacgcgggaacctctcgaggtcggccgggctgccctggccacacttgatcctttcattgaacgcaaacctccctttgcaagagcgagcatctgtttccctgagaaacaggtcaccgccagggacgccggcccggcccctgctctttatcttggccctgtgaatgcttcgcccccgacctcccgctccccgctttcgcctccagccacacgcttcccaccccctacgtccgggccacacgcctccatcccttccccacccccatcctcccacatgcctcccccttcccctccgcccggcccaggccacactcccctctccccacccctggccacacgcctcctcccgccccccttcccgcgggcgctccggctgccgctgtaacggccgggacgcccggcccgcgccgcgcgctcagagcggggacccgggaggcggcagatttggggcattgctcgagggcagtgagtcatgaaagaggcttttgttgtccgcgcgtgcggttcgcgtgccgctgggtagcctgcagcgcccagtagggacgggagctgggggagtacagctaacgggcagcgaggggagagacaaaaaacttagggaatcaggagggggaaaagtgtgcaaccgtccaaacaagtccaaagagaagaaaataaggaggaggagcggggccgcggagaaggtcctcagtgctaagccccgccgcgccttcagctctgtcctctccgggatccggctgactctcttctctcgccccaatttctcgcgccttcaaccccaaacaaaacgcacctcaatccaggccgtgtccaggctcctctttttagggccttactaccccgcatctcctgggagcctcgcgggcactggctgagcgtcgcgatgccggcgccccgggtcgaaattttccgcgcagaggagggtcacatcggagcgctgcgggatgggaagcccaaggacagctaccgtgagacccaacctcagccctgtctctgaaacatcctggagtggcctttcctttgtacaaatctccaggcctgagcgaacaacgcgcagtgggattagagatgaatttatcaagggtagagggaggaaacagactagtaattcccgcactttacgcatttgagtctccgtctggcaaaacactcgggcgtccctcttgctcaagaacatctgactccaccataattctcctgtattgcacaggatgtcgcgaactggaggtttctgctttctgggggtgaggacaaggatttagcagagggacctctaggctacccctgacctcgaagctagctggagtcctttctcccactccgtccccagttctcctccggaactccccaaagttggaaaaatgagagcctaggcacgagttgcatatgcctgcggcatagtgtgctgccagtcggggcagctgccgggtgaggggcagtacttaacctggccctgccgcaaacgtcgggctgtgtactatcttctaagggctagtactccgacgccctcgagttttagcccaacactgaagatacagacagtacaggggtaaatcctgggcccaggctcctgggtgaattattttatcctcccctatgcgctttgtcagccaagtgaatgtagaaaagcaagcaaaactccagaaccccacaacgattcacgccacgcttcggtggcacaactcttttcttccccttttagattagtactgtgcagggaaggctgcacctgctaccttcagacaccggggatctggctaggaccctcttcctctacccctactctctcctcccgtccccaccctctcccagatgcaccccaatccagcctctcaaccctgtcgctgtttgcaaactcgagggatgtttagtgcaattgcctttaaataagcaattcacgtaagaggtatttattgcagagggtttcaggtctgggagggggtaaggagttagttaatgaaggattagaggcaaagctgggaaagaacgagtagacaggccagtttctttctttctttttaaaatctattattctggaaaacccttgttcgaaaagagtaaagaattgctatttgggcaacaatatggctccttcagaactggtcgagaatttctgtggtctttgcttgaccttcaagttgggagtttcaaatcagaggctttgaagtctggaggagttcgcagccattaatccttccggggttgtgctaaaggcgtttctagaaagagatcggaaagacccgttcagcacaggcccattgcatcttctctttgaaaacgcttgtctgaatcaagtatcttatacagacccgagactgaggggagcaagagcgcaggtccggctgtggcgaggtgtccaccaccgtacttgtggtcaatgcctggactagagagccgaggccgtccagggcgggctggccagggaaccagaagcgtccctggactggctgagtgagggtgccctttccagcaacccagtggccatggttaaaaggcagaatacaaccgtcaaagaagtccccagctcccacataagagagcgcaaaggccaatggaaccaaggcctcctcgcgagaactagctcgctttgaggacaagatcctggggatggaggtggggactgacgtagtgagagggtctggaggaacagtcgtagctgaaggtcaggacatgaagaattgcacgtatggtagggatagaatggcaggtacaacttttctgtactgaaggaactgggagaggacgatccggttagggaggttggggaactaatctcaacgctgcgtttacagatgaagccgcttttatatggcgtatatgtttgcttagaggggccgacggagattaggagaagccatcctttggcgccaatgatcaaagcgtctgccaaggagaagaagccaagggatgggcctttcagagagggcaaggagtcatgctgctctggatgccagtgtcaggacaagaaatcgaaaggagcgaggactcttcactgcgtgcctcagtctccccgcttctgcctctttcacctctgtcctacttccggcgcgaaagcaggccactcgctctgatctagacctagttaacattagcttttcccttccttccctcaaatcccctcccccctctatccccgtcccttctgccgcctgaaagggttaatctctcctgcgggtaaaaacaggtccgcggagtctctaactggcgacagatgggccactttcttctggccacaaaggggccggaatggagcgctccgcggcatacaaatgggcaggtcacgtggttccaggctcttggctggaccgggaagaccatatggcgcatgccggggaggaaggaggaggggcgggggtaggggtggagggtgaggggagcggttgtcggaggagggcgggagacgagcaaggcgtggggagaagtggggaggaggggagaacggggagcgcacagcctggacgcgtgcgcaggcgtcaggcgcatagacctgctagcccctcagctagcggccccgcccgcgcttagcatcactaactgggctatataacctgagcgcccgcgcggccacgacacgaggaattcgcccacgcaggaggcrcggcgtccggaggccccagggttatgagactatcactgctcaggacctactaacaacaaaggtaattacagttctttcatttttttgccccagaatagaagcaataactgaagactgatgaacctacatattctgtatgtgtgcgtttgcgagagtgtgtatgtgtattgagaccagcatccccctccataattgcccataagtactcacacataatgagtcgtgtcactcaagtaccccctgcaggctttctaatttaaattttaaaaatttgggtttcttttgtggatagcataggagcttcttggattttttaaaagaatgcacgrtaactatgattatctgctagtgctgattttaaagtcccaaargsaataatgacttcactttctcacttcttacagtaagaaaaaaaaatctatgttatcaatatatattttgtgtgcatgtattttacgcacattgggagtgtcaagctgtgttttcagtgaatgaaagggacatggataccttgagtattcacaccatggaaaataaatcaggttcagagatagtttagttgagaggggggaaagtggagaaagggagagggactcactcctgctacctgttaccgctccagaggcggccaagtccccagcagccactactggagccagaaattcagttgttttactaaaggctttttattttccttactagaarcggcaacttcgcggttgccaatcgctgaccattataattactcaatcttttaaagggaggtttgaggcgaactttgaaaagccccaataaagagcgggcggccctttcaatgggctgtttattagagaggagccttccgcacctgatcccyggcgcgtgggagagcgctctgcgccgcgcccccagccctcgccctgcasstagcgcttttgtacaaggtggaaatttagcggtgggccagagatggaaggcaagaaaagaaaggcgagggaggggtggaagaccctgtccacttttgttgccaaatgttacattgatggtgaaacaatttggtggaaactatttttcctcctttctgcatttgcttttcagtatcccgtcgatgtaatcttcttaaaaatcgctgccagtattagtaaattacgcaatggctgttcaacttaaatcgctaagtatctggaagccaggacagaaatggaagtagaatgtgtgattttacagcttttttttttttttatggagttgtgagtaactttgaacacatttggataaacatgaagtcgctgaaatgtacagycatttccacacacattatcctgtcgggcaaccaccataaacacatttaagttaatcactaggatacaaacacatatgcgtgagtggtgtacacatatacatattcactaccctcccccagtcctgtcctcactcctacgtactagcggggcacacgcacgcgccattataaaacactgcatttaactttttctcagaggcattcattttgtaatgggcaggtacttttcgcaagcatttgtacaggtttagggagtggaagctgaaggcgtatctggcttttgaatatagcgtttttctgcttttctttctgtttgcctctcccttgttgaatgtaggaaatcgaaacatgaccaaatcgtacagcgagagtgggctgatgggcgagcctcagccccaaggtcctccaagctggacagacgagtgtctcagttctcaggacgaggagcacgaggcagacaagaaggaggacgacctcgaarccatgaacgcagaggaggactcactgaggaacgggggagaggaggaggacgaagatgaggacctggaagaggaggaagaagaggaagaggaggatgacgatcaaaagcccaagagacgcggccccaaaaagaagaagatgactaaggctcgcctggagcgttttaaattgagacgcatgaaggctaacgcccggragckgaaccgcatgcacggactgaacgcggcgctagacaacctgcgcaaggtggtgccttgctattctaagacgcagaagctgtccaaaatcgagactctgcgcttggccaagaactacatctgggctctgtcggagatcctgcgctcaggcaaaagcccagacctggtctccttcgttcagacgctttgcaagggcttatcccaacccaccaccaacctggttgcgggctgcctgcaactcaatcctcggacttttctgcmtgagcagaaccaggacatgcccccccacctgccgacggccagcgcttccttccctgtacacccctactcctaccagtcgcctgggctgcccagtccgccttacggtaccatggacagctcccatgtcttccacgttaagcctccgccgcacgcctacagcgcagcgctggagcccttctttgaaagccctctgactgattgcaccagcccttcctttgatggacccctcagcccgccgctcagcatcaatggcaacttctctttcaaacacgaaccgtccgccgagtttgagaaaaattatgcctttaccatgcactatcctgcagcgacactggcaggggcccaaagccacggatcaatcttctcaggcaccgctgcccctcgctgcgagatccccatagacaatattatgtccttcgatagccattcacatcatgagcgagtcatgagtgcccagctcaatgccatatttcatgattagaggcacgccagtttcaccatttccgggaaacgaacccactgtgcttacagtgactgtcgtgtttacaaaaggcagccctttgggtactactgctgcaaagtgcaaatactccaagcttcaagtgatatatgtatttattgtcattactgcctttggaagaaacaggggatcaaagttcctgttcaccttatgtattattttctatagctcttctatttaaaaaataaaaaaatacagtaaagtttaaaaaatacaccacgaatttggtgtggctgtattcagatcgtattaattatctgatcgggataacaaaatcmcaagcaataattaggatytatgcaatttttaaactagtaatgggccaattaaaatatatataaatatatatttttcaaccagcattttactacttgttacctttcccatgctgaattattttgttgtgattttgtacagaatttttaatgactttttataatgtggatttcctattttaaaaccatgcagcttcatcaatttttatacatatcagaaaagtagaattatatytaatttatacaaaataatttaactaatttaaaccagcagaaaagtgcttagaaagttattgtgttgccttagcacttctttcctctccaattgtaaaaaaaaaaaaaaaaaaaaaaaaaaaaaaaaattgcacaatttgagcaattcatttcactttaaagtctttccgtctccctaaaataaaaaccagaatcataattttcaagagaagaaaaaattaagagatacattccctatcaaaacatatcaattcaacacattacttgcacaagcttgtatatacatattataaataaatgccaacatacccttctttaaatcaaaagctgcttgactatcacatacaatttgcactgttactttttagtcttttactcctttgcattccatgattttacagagaatctgaagctattgatgtttccagaaaatataaatgcatgattttatacatagtcacaaaaatggtggtttgtcatatattcatgtaataaatctgagcctaaatctaatcaggttgttaatgttgggatttatatctatagtagtcaattagtacagtagcttaaataaattcaaaccatttaattcataattagaacaatagctattgcatgtaaaatgcagtccagaataagtgctgtttgagatgtgatgctggtaccactggaatcgatctgtactgtaattttgtttgtaatcctgtatattatggtgtaatgcacaatttagaaaacattcatccagttgcaataaaatagtattgaaagtgagagcaattgttgcatttcttcttaaagggattctgtttttatttttggggaaagtagttgcttttttgctgagttaaaaaatactaaacactatatgtagaataaaagaaaagaaaaaagtttaccttggcatatgctcttgtctgtttatcttgcacagggagtcaccagttctatgtagataatgaaaagacctaactgatatttcattatttggaatatgggactggacggcagtacaaacagtgtgtttttttctttgttttaagtggcttagcctttaggttttttatttccatttttaaaaatgattgttacatgttttcttctatttctttttttaaaaggtggattttaataattattaacaagcaagacataaacaagtatcctagcttagtttgtctatacatttaagatgtataaaacattactattttcttggtcttctgttatctgtacatttttctgaactaaacagttttatcttgcaaactagtactgtcccagaaaaatttatacacctttaggaagtaccaaagggaaatgagttaattaatttaaagaatccaagagaagtaacattttataattgttctattaacatcttgtgatgatttccatcatttttccaagaaaaagcataatggattatttgtactgaagaacacactatttgtactgtatttaggaaggtgtaattatttcctccccccaccctttggggcactattctgttgtttcatgaacacaactcactggaaaaacttatggatgattctgtctattgttaagtccacttcaaaaaaaaaaaaacagtttggcatttcttttcctctggatgtattgactgacagtcatgattcctagggaatatcattttggcacttgtgccctggctctactgtggtgctctgattactgtcattagtaactccattgtttctactctgattcgggtgccacattggatgactaccccccttcccaagcttgttcctttaatctccttctcattggtgatttaggggttccagaaagctgacctcatttagcaagctgctccagaaaaatgtgagtaatgtaatggacaggaacaattagccatactaataacattgccaatgaggctgcgtcaagctgtgacagaagcagtaaggaatacttcgacgttaaaaaaatgtttgagagcaatttaaaatatattattttaacatgttttctatcagccttcatcacatgacagaaatacttttaagttagtcccaactttatctaaaatgcagcaatctcattccaagtgaatcagagttgttattttggaatcaagctgttgctttctatatcctggattgttctcactgttcttactttaagagacataatactgatatgatacttgaatactaccagccttccagtgtaggaggtaatgaagtgagcattcagatctgatctaacctattaagtagctcaatttcacctgcaattaaaattagacatcttcatgcaaactaaaatctgttgctgtagtgaagagaagaaataaaagaatgccattttgagaattccagcttccaaaatagcaaacagggaaatctagactgtgttcttttgtaaggtagaaatgaagactaaaagttaggttttttttttttttcttcccattttgccaatacaacttcattctaaaacatagggattctttcagtcagtcaaggagtaactcacatgccaccatcttttattcaaaggcaggcacagatgttccttctgcaggggaggatttaatttatgaaaatgatattgtttatgcatgaatgaactgcatgcactctgcataacacatagcacttccatctgaycagagaaataccacagaaccagtgccaatgtcagaaacatattctacaaatttactcacttaaatgtttaatgaatatttggaaggcattttcaaaccataagaaacattttaaattatcttcttttatgaattcctacccatatttaaaagagactcttacagtttttgtaattggctaatgcttatacccagtttgtaagaaaagaacatattttactaaatgaaaaccaaccaaaaaaaaatgctggcaagtttggcttcactggaaaaaatatttcgtttagttttgctgtttaatgcttgtcatgaataatatttgggattctatctgtttcttcatcttgagccacgactattcctatcaaataagatgcttaggtatacttgtttaatgtgaaaatcctatgaatagttatttctagaaaaagctggtatgtaaaatcagggggaaatttcataaagatgaaattgggctaaatattgtaacatgcataattactattgaataggaacacttcacataacatattttactttatataaccaattgcagctatatagtatgatctatctacttttaatcattaaaacaattatatataaattaaaatgaaagattataatatcaagagtgttctactaattttaggtttataatatgttacagtaaaataccatttgaaataaattttgtgttctaatttatcttaaaatctctctgtttttacatttgaaagtccttacattcttacaaaattaatgcattttctgaaagaagctagcaattactaaaatgatatatggatcattagctaacagtttgaatcaagctgttttagttctataattatacaagaaatttaaagtgaaaatacctattaagcaattaataaaactaggtttcaaaatattggctaattttctcctaatgggaaatgtaaaatagcaaaactgcttcttaaactacacaaaaacctcctcacttctccttttctctctctctaacaccacttatttcctgaaaatcatctaaataaaatatttaattccagggtctgatgaagaataaaagagccaatgcaacatcttgtggaacaccaggactgagaactcttgttgttaccattgcaaagaggcgttctggcgtcagatgcacagtgatttgtatggtggcataatcattggctcctggccaggcattatgtttcagaggacactattgtcaagaaccattcaactagaaatctgcactgtatgcactcaaaagttgagatcatctgccttcctatgacaggaagaattctgtgctggcaattgactcatggactctcttcacatacactaaggcttggtccagtggctctgatggaattaactgtgcagccaaactagtggcattgacaagacagggccacagtctctggggacttcaggagaaattgctaattttaaaatgcagagtattatgttaatgctggattaaatcttcagatacattaaatgtggatttggccatctaagcattattatgttatttgcccagttaatttagaggtagatggatggtgacaataaccatctctacagatccacaattctaagagatggatccaattgtgaaatgatatggagagatagagtaagttcaatctagcatatatgaagtaatttggtaactgacttttcttttaacaagatcaaaagctaacctgctttacactttcatgtctaaggacagccaaccagagagatggcttcacacactagcccactgctaagtgcttttcattcactttcatatttcatcatcaaagcaccctcctgccttatttatagatggggaaacttcaggaagttgagatacctagatatttgcattcctgtcttcctttcttcattcaggtttttctttcattgccacttcctcaaagaagcttttactgattcccatttaaaatagcaactgacttcaactccaccaaaatcactgtattgcccctccctctttccagagcatttgcctatcaaatgttatcttatgtatttacttgtatagcttaattttaaactatctatctctaggtcttctgagcacctgagaaacagagacaaagttgtctcttctgtgtgttgctgttcctctggtgcttagaagacctagaggatcctcaataaatattaactttccaagggaactgaagagcactaatgtgatgctaaagcctgttgccttaaccactatgctataagtcaaatcagttgagaatggagaggaccacaaattattttcagtccagcaagtgttataaacattaattctataaaaagaaaacaattgaaactaatttcttattatattgcatggcaccaaactcyccccacttcctttttgaggatcatgagttgtctgtcattgtttctttttattgatatcaattggttaaatataatctggaattggaataaaagaaaaactattataggctttttccagaccatgtatttcaatgcatattattttttcctttctgttcattattctttcagtaattgcacttgttctatttttagtgttatgtaaaattactgtagctcataatttctattttgaagggttcagtgtataaacttagcacatcaatactatctttttagtgttcgcgctcaatggtgtcagttaagagatcaccatcacttttggtgacgtcaatgaaggggtattgcaatgcttaagagaactgttaatccctttccactggtgtcactaacaattgtagtgcttgtttattcatagcaggtacgtgactaagtaatgttaacatcaaagcagaaagaggataatagagtgttctaaaaagaaaattcggtggttgggtgcagtggctcacacctgtaatcccagcacttttgagaggccaatgggggtggatagtttgagcctaggagttcaagaccagtctgggcaatatggtgaaacctcgtgtctacaaaaaatacaaaaactagtggtgcatgatggcatgcatctatagtcccagctactcgggaggctcaggtgggaggatcacctgagcctggggaggtcaaggctgcagtgagacgtgattgtaccactgtactccagcctgggtgacaaagtgagaccctgtctcaaaaaaaaaatgatttgagataacatcacttgtcattgtttgttaactgaataatctttattctagccagtgcctaaatacataataaatgatagtacaaatggatataaattataactaaacctaagtagtgatatttatcacaatatttctttactagaagaatttctttgttaatagaggcaaggctacttgtttagataccttaaaataacataagatttttggataaataaattaatgattctttgattctgactggcatattaaaaatattaagcgaagagatctttgcttcccaggttttattttttgtctaattaactactggtgcatttatattaaaacatattgtcaagggaaaacatatatatatatatgtgtatatatggtgtgtgtgtgtgtgtgtgtgtgtgtgtgtgcacacatatgctatacttggttgagtagtatccccttcccttgcccacctctctcccaaatttatgtccatccagaacctcaaaatgtggcctcatttgaaatattgtctttccagatttaattaagatataagatgtaaattgatacaagttcatgctggattacggtgggccctaaatccaatcactgatgtcctgataagaagcagacagaacacacagacacacagcatacaggaagaatggcatgtgaaggcaaagacagagactggagtgatgtgtctacaaatcaaggggccccaaggatttggggcccacatcagaagctgggaaagagacaggaattctcagcttctccttctgaatccctaagaaggaatcaaccctgctgacaccttgattttaaacttcttgtctccagaactgtaatataatacatttctgttgtcttaagctacccagttgctggtgatttgttatggcagccctaggaaactgataggtatactaaaatctctaatgaattgatgttaaatatatataagtataggagagttcatttaaattcttctgaaaatgtcttcttaaacttttaatgatacagtatataacaaccagtatacgtagttggtatcgggtttgacatttaaacaagctgacaaaaaacagctgtttaataaacatctgaattatataaaagttttattgtttattattcatgtgaatgacttaaactgacatctacatttagtgaagtgtgaatgggcctagccaataaactatgggtaatttttttaaagtctcatctttgaactcacaaaaaattatcaaatatcagctattatgtattcttcatgtgaagaaaatgtcatatttatttgatttgtgg

SEQ ID NO: 17602 - DNA, 23123 bp, Homo sapiens
gtcagggcttttgatagagaatgggaactagaactaggcaggaagttttcaagctgaacatgaggagacagtgtgcctttgaagccatttgcctcctggagagagacacccagagggagagtgtttagtaaattaatccactgagccaacagactaagctgctgaattatggtcagactcaaatggatcagatgtggagaagcctgtatttgaactgctggccattaggaatggtgtttgttgctatgggaactggtgctaaggaactatactgagagactctgattaaaagggggagggggaatggagaaaaaagcctgagaggacataaaaataaaaaagcaatccagttgttgtaaaacaaggctcaagccacatactgatggctgtgaaccatatattcctatagagtttgcataaataaattcatgctttccarttaatttgaggagaataaaatattgccgagggactgttaatttctatgatatttcaggcaaagaaccaaagtgtaggtgccgttttcatgagaattttagatatgcttgactaggaagtcattacatcacatttatctgtttggatgtgggagacattaacagccttatgaatattcatggtatctggttaattaagttaattgttctgcagaagtgcttgcacttccaaggacattttttttttttttttttttttgcctccatagtttctccctggtatttcatcagtaattctttacatgaactgctacttctgtccttacttttttgtatttggaacattttagcagctctcaggaggaagtggtaggcaaagtttctggtagtgttaagaaaaataactttcaggctaattaaaatgtttaccttgaggtagaacatttatagcttttgtgagaacattaaaattacgccattgttatttatgtgagcagcatgttcttttggcatgtagacatcttttcaaatagagtacagtttcctgaaacaaaatgtaatccatctttcagattatcccaacaaaatatagaacaagctatcgttttgcaattttacatatactttctcataaactttccttttttcttcagagtgtcaaaaaccacatttaaagactaagatacagattaatgagtagtcaatgactaaaataattttctgacttctagtcatgtctgttatcactgccaacttctacagaattagagaaaagttgcaaagcctgagaagacataaacaatttttaaagccatctctagcattctaaaaaaattttgtacttgggcatacccaccgtacttcaaactcacagggaataaatggtctttattttcttaagtcatgatatgtgtcattctctattgcacatgacattacattatgttttttaatagcctttctagaggaatgcttttacggtctactcataattaaccatggtaatggaggaaatgtgtttcatggagtactgtaatccatcgataatcctaaatatctgactctaattatgtggcctcctccaaaatctttaccacaaatctgattgggaagcacaatggattgacttgtttcttccttttctcctgatccattccagatttattagcaattagatggtcaaagggcaggctgtagagggccacaagatcattggaaagaccttgataaagatccactgagtaacaggtttctacactacttgttctcaaaacttagggtccatagactcaccttgtgaacttgctaaaacagagatacctgggtcctccctcctccaaacacattctgagtccatgagttggaggtagaacccaggaatgtacgtttttaacaagctcccaggtaatgatgctgcttggaccatgcattccagaggagtttctcaccaagtcactgtgcatacaaaccacctggggatctaataaattgcagactctgaatcagtgtgtctggaatggggcctgagaggcaacattttaaaaataatatattttttacttccattaatactgctattactgttttaatacctattatccttatttttaaatggacaaaaattgtatgtatttattgtgtacaatgtgatgttttgaaacatgtatacattgtgaaatggctaaataaagataaacatgcataaaattgacataatgatcacatactgattttacattgagaacacttaaaatctcccttagaaatttccaagtatataatgcattgttactaactattgttttagcctgttctcatgctgcaataaggaaatacccaagactgggtaatttataaaggaaagaggtttaattgacttgcagttcagcatggctggggaggcctcaggaaacttacaaccatggtggaaggcaaaggagaagcaaggcacattcttcacaaggtggcaggaaggagaaatgctgagtgaagtggggaagagtcccttataaaaccatcagatctcatgagaactcactcactatcacaagaacagcatgggggaaaccacccccgtgattcaattactcctacctggtctctcccttgacatgtggggattatggggattaaaattcaagatgagatttcggtagggacacaaagcctaaccgtatcaactgtagtcactaggttgtataacagatctcttgaatttattccttttacctgaaattttatatcctggaccagtatctccccagtccttcccacccattagccccagtaaccactattttactcttcgcttttatgagtttaagtttttcagattctacataaaagtaagtatttgcctttctgtgcctgtcttatttcacctagcataatgtcctccaggtttatccacgtgttgtaaatgacaggacctctttaatgccaaatagtattccattgtgtatataaacaggctgattgtccctaatctgaagacttaaaatccaaaatgctacaaaattagaaatgtttgagtgccagcatgatgccacaactggaaaattccacacctcatgtgacaggtagcagtcaaagtgcagtcaaacctttgtttcatatagaaaaatattttaaatattatataaaattatcttcaggctatgtgtataagatgtataaaacttttatgtttagacttgggtcccaccccccagatatctcattacaccaacagtgtaaaagtattcccatttctccacagccttaccagcatctattgtttcttgactttttaataatcgccattctgactggtgtgagtgtggttttgatttgcatttctctgatgatcagtgatatttagctttttttttatatgtttgttggccacataaatgtcttcttttgagaagtgtctgttcgtatcctttgcccactttttgatggaatttttttttcttataaatatgtttaagttcctggtagattctggatgttagacctttgtcagatgggtacattgcaaaaattttctcccattctgtaggttgcctgttcactctgatgatggtttattttgctgtgcagggattgttttcttgatttctttttcagatagttgtaagtgtacagaaatgctactgatttttgtgtgttgattttgtgtcctgcaacttaactgagtttgtttattagctctgacaattcattcatggagcctttagggtttcctaaataaataagatcatgcctacaaacaaaggcaatttagcttccgtatttatgatttgcaagccttttatttctttctcttgcctaattgctctggctagaacttccagtactattttaatgacagtggtgagaatgggtattattgtcttcttgaggaacaagacattgtttctcaactcatgagagtaattttaataagcactcaagtattgtcattcctgtttgacagtaggccgtattttgagtaacaagggtcacagcataacttgccttttggtgaatcagttggaaccagtttgccatttagttaaaataaacttttctttgcactggtattactagaagtaattgtgcttatttataattaataataattaaatatgcttattcttagttacctaaaaaattatgatattaatgacctcttggttgataatggctaagctgcctcagcttctccaatttagcaacccaagtacatatcagttcaaagtaacacaaattgaagcaattatgtatgatcacataggaatgcttctgattaacaaaatccagaggactggtctttgccttcataaccggaacacaccacatgcatggtttcacagctcttggctattattggacttacttattatattctttaattcaagaaaaattgtagcttcattcattctgttcttaataattttaaattctctttagcctcctgggaatgggaagggctagctggtatagtcccctgtatctcagatttcagttacacataaacattaaaggggcctgacttagggcgctctttgcctctgtggactggtggggaaaatccaggtgtgtcttaaattctaataatcatgaaaatcagaaatcataatgtttcaaatacaaatcttcatacatgggaaatacaattgaattaaacattttcttcaatgtaggagacatttgtcagataacagaggggattctcatttggctaagagcttacctctaagattcattaaatgtgtttagagcatattttttgtagtttgtagttattttatttttctgagttattatttggattattttctcttttatttatgtatgcatttgtcactgctccccagaggcacctcattttggcattgaagctaaaaacccattcattaaggttgggatggagtgggctttgatatagctagcatttgggaggtagaaaatagacattcgtgatcaaaaaagctgtaagcggttactataaactatttttaaatttctaagtattttaaatattgaacaaatgtgtagacatttgatgtgcatctatactgtgaataagaacttaaacttctaatattcacattaactttcctgattttataaattctcgtttatttttcatctgaacattgaagaatgacatctacataaagtaaaagcaaatgttagtttgaacacattctaccctaatagtgcatgttttaaaattgctttggcaggatctaccaatgtattggcacattctcttcatggagttcctcatgtgataactgcaacattgcacattataatgggtragaattcttccaaagcagttcatattttataaggaaatgttgatttatataaggaaggccatcttatttccatcagactttaagaaaaggcaggttctttgtctcttagagtagagaaatgtttgactaaaaaaccaaaaggcaatgctttactatgtggattgcctgtcttttcaaaatacttgctttgtaaagagcagtaaatgaagttttattgtaatctgtacagaaaaaaaatattgtagtgtgctcaaaattataattttataaccagatgaagaacattaatgaatactccttaagtatatccaacactgatgtaggactgtaccaagactctaggactaggattatgttattaatgaaaaaacataaccagaaaaaaatttcagccagtagatgtctatagatattttattatccctattggtaaaaagcatataagctcaggtatatgtaacactaaactactgttaaatctgtgtttaccttgcctatctactttaacttcgtttctttgaccatgttttataggaaatagcaataagctgaaaaatttagtactctgtgtttcttcactagtacctgaacaagttaaaaatggtaattattgtagttataggtaaagggaactgaagagaaagtgaggatgttcatggtctacagtacctttagatattctcctataagccaataaatatgctctcttatgtttgctgttttgatacaagtcctactgtactcactgattaatatttaatgtaatattcaagggcatgtacagctggtcgacgtctgcaccttcagcaccgctggcaagcttcttcgctttgggttctcagccatgtttggctttggtggaagaactttggctctggcagaaaaatatcgatggatgtcccctaaccaacggagagattttgctgttgttaaggcactggcaaaacttaagtaagtctttytcttaaaccaaaaattgtwtcccaggttcaatgactgttaataacaaatttcattacattttagggcagaagactgtgaaatatcatttttaccatttaacagctctgatgatgtgcaagaaaggtaggtaaaaacycaatgtaatacagataacctrtatctttaaagcataaaacattctgacaaacaattgatcagacttaggatctttggttatttttctaacatagtagtaaagaatatagaatcacagactcttacaggtcctagtaagcaaacaactactcactcagcctttttctctttttccttccttctttcctcccttccttccccctgtctctccctccctccttccgttctctttttcccttcccttcccctttctttcctttcctttgtttttttccctttctttccttttccctttcccttttcttttgagtgcctactatatgccaggcactttgaatacaacaatgcaccaaaaaatgaacaaaacacacagttttgtccctcgtgataattttggtctagtgtgtaatacaaatattaaagccatattaaagaagggttatagtctttaaagaaatagtacattattattccttataatactagtttacctttaaatgaatcaacacattatgttggcagcaacaaaattgtacacgtttttacttactatctaattgaagaaagtatttaacatatataatgatgagttctctaattttctcatatttaatagattttgtgtgtgtctgtgtgtctgtgcgcgcgttatctgttttatgtctttgttttgttttctttcttttaggagggcacagggatctcccaaatctggtgagtcgaaaagtatctccttgagaactgtgccaggttctgttgacattttgttctggtgagggaaaataaccaatcactttcattacctttagactgtaatgatcaatggcaaatgatccagggtcagttcttgaatgtcagcattatggcaattccttgcctgtgttcagtggcacctagaggcttggcacctaataccaggttagtaagcatttttattgaattgttgatacatttcttatagaccattttttttccagggtatccaattaactgttggttagctagaaacttaacaggtagtttatctttgtatattagagattctaagggatttgtcatcacagtaggttgagaacaactgttgaactggaataattatcagataatcattgactatttaacgtcactgaggctaaaataatatttcctaagttttattgatagaattttatgcctactttacttgatttattcatttagttgtggagaacattatattaaatactgatatttcttgtgaatgtctttgctttccaactttaatgcaaacataaatatccttagcatgaaaatcacacatatgtatatttgatactgtattagtctgttttcatgctgctgataaagacatacccgagactgggtaatttacaaaagaaagaggtttaatggacttacagttccacgttgctggggaggctccacaatcatggtggaagatgaaagtcacatctcacatggcggcagacaagagagcttgtgcagggaaactcctatttttaaaaccattagatctcatgagacttattcattaccatgagagcagcacaggaaagacccacccccatgattcagttatctcccaccaggtctctcccacaacacatgggaattatgagagctacaagatgagatttgagtgggaacacaaagccaaaccatatcagatacttttagtcaaaagaaacatttcagttctatttaatgtgaatagtagtgcatatcaatctcctgcccacattttcaattgaataaaatatgagacatcttatatatatctttttatccatgggatatagacattccttctcttgcatattcttcttaatcagctgtccattatggggctgaaaatatttctttcctgaatccaatcctgtagagtgtaggagaaaggatcgtgagtgttgtgaaatataggcaataaacggggaaatattcaaagttagagaagaaaaaagagaaactgcaaacttcgatattgaaaacccagatggcaaggtcctcattaattacatctagtgctaaaacttcaaaggagtattttgaaccttgtgtgatttagaaattgagcctggtggttttccccgacaccttcagaaatcctagatagctgtgtgctttcataatgtagtttccctgactaaacttgaagacgtggctagctgaccaaggagctatgtttggcaggacttgagacaatgtttatctaaccctgtttgtttaaggaccttcttgggagggtagacctgctcttctgggaacaatcgattcatagctccttcaaagccactccataaatgttctgcttgactagaattccactgttgactctgcaggcttaatcagtattaatgaatttttcagagaaggatgactaattagagatttcttctgtggtttataatcacaacatgccatctttgcaaagaccttttgatcaagactcatttgaccggagatttttcagagatgtagcttctgatgattcaggatgattgaacaggagatttcactttcttctttttcccccaccatgataaataataatttatgttagaatatctcagtgcaaattgccagtaggaactaatattcttatattctaagtattctaagattaaatgtgttcatatatgtgagacatttaaagcagtgccagccatgtaagttgtgtttctatttcaagtaaatattgcaaagcaggcataggatagtgcttttaatgtttataaattatgcaattaaagatgcacagtaacactaccatgaacgttttggtgctgtttatttttaattgggaagaagaagcatgatggaaagcatactgagcacctggagtattggtgctgatgaccattttttctctgtgtgcctttgaacaaatcacttaaacttggagttgtcttttccctctacatgaaatgagcgaatgatgagataatctctaaggtcccttacagctctgacttgagctttcataagatactaagagctctttttttattttgttgttattcttaaattaacttcatgtttgcactgaaatcaagctagaagtcatttgtatgtatttctgcaaactgcattctatagcttgatgcatttgtgagtggctgttttggcactaaatcacacctctgaattttcactctcttatattggatggaacagttatgcaagattaaaatgttcagtcatttaactgaacatgtgtggcagcatttgttcactccatttcatccatccaaaggccactttgatttatttcatttcctatgtcacttagaccttctgtctataaataaatatttaaatcacactttagattttagaaaatgttgagctatttgttacacaacttgtgcatattaactcttctataatacatcttttaacaacatagtttcacatttagaatttctaattacattgtattttaaattatgtcttgatatgtgagtaggacgcttgatggtttgctttgtaaaatgctctaatgtaagagcttattgagaaggaagccagtgatttaataaaactcatttgaaagcctgcatcatttaaaaaatagcaagatacggtttatgaattttaggtaaacgtaacatggtgatttatctatcttgtccaatactttcagtaaacagtatacttgttataaggaacagtatgtcataatttttggtataatctcttagtaaatttcttgatrtctaatagaaatatttaatttcagattaaataatggaagtatggctsttataattgcccgaaacacttctcggccagaatttataaaacacctgaaaagatatgccagtgtaaaaaatcaggtatagtaaattctttttgttacttatttgcaaagctattaatcatgtagaaaaagmtgctgcaagaattgacatcgaatcctgcctcataagaaggttttattttcttctgaatatattaatcttctttttcccaatctatttcatccaaattttgaaaagcatccgccaggattaatatagattggccttttttgaatgatgaattagtggttatgtatctgtaaccacaaagataaaataggaaatgtagtgttatattgcaatgtgaaataaattaaggataaaattccatactcaggctgttcttcagaatgaaaagaagtgaaatttgagagtttagccttcttgatattatggcagcagactttctaaagttatgatctttagatcttcctgacatttgtttgcatatctgcattgattgaaatagatctgtagatatgtatttaaaaatatgacagttttatacaaatattcattcaaaatgagaatatgtgaagatatacatttccacttaagtgatttgctttaaagagaaacagtaactattacaagccatattattttggcagctgttttgacctgattattaggaaaatgatccttgaactatgtgaatttctgaaattgtgagtctttgaagtacataggtatggttgtaaaaccctatagtttcacactttttctttttctttctttttttttttttttttgagttagagccttgctgtgtcacccaggctggagtgcagtggcgtgatgtctgctcactgcaacctccacctcccacgttcaagcgattctcctgcctcagcctcccgagtaggtgggattacaggctcacacctccatgcccagctaatttttatatttttggtagagacagggtttcaccatgttggtcaggctggtctcgaaactcctgacctcgtgatgtgtccacctcggcctcccaaagtgctgggattacaggcgtgagccaccacgtccggcccacacattcttaaaggtataaaatggtgcttggatagagttgggagataacagacgggaggaggaggagagtaaacccagccaatgactggcagctgaaccttgcttatgtaccttagccatagcaagtctctccatttttgcctcattatattttaaaactttcttaggccatcttcatgaagtttgatctgtcagtaacattatttgatcctcatgtattgaacaactaactgggctgcttagaaacttaaatcataaaaaattacagtcccactttctttatatgtcaaagtagatcagcaggtataatgtaggttgtgagcctacataacagttttatgtatgtgtttgggtggaatatggagatttattgattttcaaaggaatatatgccctttcacattttaataaatttctaaacattaaaaccaatttttaaaaaacccaaagcactatatattcattgctgtttttaagtcagaaaatagaaacaagaaaatgattttaaagcactcaaaattccatgttcctcaagattagtgtcattaccttggtagaattttttccgaatccttttttattaaataaatgagaagtaaagtaagtattaacctcattcatgtacctctatttgagaacttaaatagtattaacctattaatgtacccctgagaagttctgtatttattttggggaggtgtatgttgcacaaattgtttatggaaggtctcttttgaaattgcctatggggcaagtctctcaggcaatttttgtaaacattcttcttcttcatttttttaaatcaatatacctttcttctgattttaaaagcaatggttaccttacacataaagacagacatacagaaaataataaaaatctgtatcgataggaagacgttttctaagagataatattatgcaggatttatcatattttctcatgtactctacgaggcatatcttgcttttgacacaagaaacagttgcctgtgtgtgattcactggccttaactctgatttatttatcaactttcaaaaattaaaatccatgctatttttttttttttgcaaagaattctaaaatattttgcatagtgtatatagtaagaaagaytgattcccagggtgactgctttcaagcaatgttaatttgatttgttaattatccacacaggtgtgtttatttaggctctttccttcatggtgacattaaaaatgtgaatttatataaattttgtaagattatgaaaatcagatctatgtaaaaatcatgtctactgcataattcatagcagtgctggtattcaggaaggaaaatgtggcaattcagtttaaggagagtaacatctgcttctctgaaccatttttaccaggttgaataagcgaatgttactgtataacactgtaaaatagattgaaaccaccatgtgcggagtggctcctgttccttccccatctctgtgtaaaattagatagaggctgaacactacccttcaaagtccttgcagctccatcctattgctttgccccccttctcactgtccacacttttctctttcattgtgaccatttttggtagggagtttaaaaccttaaatgtgagtgcttcccccaggatttctttgcagccctctcatcttctcaggatgccgtctcctggatggcctcattgcccctcacttttgaactgtctgaacatcatgcactcccaagggttctgtcatctcgtcttatctgcaggacctctgtcttcttgtatgctgaagaggttctgaaattcaccggcatctggaggccaacatgtctacagccgaccttatcttttcccctaaagttgttccttctgcgttgctctgtgcgggtcaatggcaccactttctacccatccaggttaccctgaactgttccttcttcctcattcctcactaccagtcccctaacttgttctgttggtctcctcttaaatgtttctaaaatttctccctcaccttaattcaaactttaatcctttcttgcttacagtagcctccttttggccttcaggttctctggtcttgtcttccatacctctttttagagaaacttttttctaagacacacattggatttctctcctgcttaattcttcagtgcctttctcttgttgtcagaataatatggaatatcctcagtctggaacacgtggcctttgtatccaggtccctgcctgtgttgcaaccccacctcttattaccaccctccaccacattcccagtgttttggcattttattcattggctaaggttgccataacaaataccacagaaaagatggcttaaacaaacagaaatgtatttctttcatggttctggaggctagagctgcaagacaatgtcagcaggtttggtttgtcctgagtcttctctctctggctggcacatggctgctttctcacagcacccacaagtgagtggtctttcctctgttcatccccgatgccttttcctatgtccaaatttcctcttcttataaggacaccagtcgtattggatgagggcctaaagacatcattttagcttaatcgtctctttaaagatcttatctccaaatatagttatgttctgaggtatacagagcgaggatttcaatacaggaatttgagggccaaggggcatgatgttgagcacctaggagtcacactgaattctgtgtagttgcttgaccatggtttgcctctagttttgtaaatgcttcctctctccagactttcttctccaggctaaatcttatatgttctttaaggctcaattcaaatgggaagctttcccaacatccatagcctgtttgcctcctcttgtttcctccgttgaactccacacttgcaccatcatggcactcccctgtatcaaaattgtaactgtttacttctcctccccgtgccccaaacataccctcacacaggatactaagctcttggctcccgaaagtcccacttaacagcgtctgtggcttcacagttaaagcatttgaaggatggctagatcttcattttgtgaggagtgcacatgacaactgctgatttaagataatagacttactggtggtggctgtcaattcttgacattccttggcttacagctgcatccctccagtctctgactctgccatccttggcattcttctctcataaggacatcagtcatattggattaggkcccgccctaatgacttcatcttaagttgattctacctgcaaagaccctatttctaaacaggggacattcacaggtaccaggggttaggacttgaacatagttggggtggtggagggaaatataatttagatcataacaggcagttgtgtgttttaaatgaattatcaactaacatgaatgattatgtagataattctacaaggatgaggcatgtagccaaggctttatacccgaggtaggaggtctaacgcagttactgtcaaacagttttgcttggggccctctaattctgtacctcagtcacaacagctgatgccatcatatcatctactgtttaactgtgtttacagtataaactggaaagttggctggaccttggtatctacatatgtaaaatatgggtgttggggaaaatattagttttctgtcaacttttaaaactatgtttcattgaggtttacatgtggaaaaggggaaaaactatgtagatgatgtttaattaggaatgtatctcatgtcatttttctgaaaactgaaatgagtagttatacatttctgctcaagttatttggctatattttcttaattatgtcagaaaatacatagtgctttttcagtatagtttccttaggcaaacaagaaaaaacgcaagttgaagtttaccttgcaccattctatagtggtaagtaaacagtgatcttgcagcttgtgtccattgttaaagtgggaatggggcaggcaaacaccttttaaaatccatatttgattggctttctcttttaaaagaagacatacatcccattttatcttcagaagtttagacttgcgttcttccaaattaaattccaagtgtgaaacttgtactagtttgctttatgtcagctaaactaattgacaagttgataatggattatatgtcttctgtatctacaggccagtattaaagattatctttaattgaaaaatctacagtatcactattttatgtaacttctcacagatatgtactatttgtcataaaacaagatttctaggtgctagatctaaaagaacccaaaaggctttggataagagattccttcttccaaaaaaagttggagatccctgttcatagtctcaaagctattaaaatgtcagcatacatgctgatatttacttgtgagagagggctcagtgaactttgattcgcgttagtagctagagataaaccaagtataatgattatttgtatttatttttagttcaattttccatttgttgagacttacactgttgaggaagtaaaagttcatccaaggaataatactggtggatataatccagaggaggaggaggatgraactgcttcagaaaattgtttcccttggaatgtagatggtgacttaatggaagttgcatcagaggtccatattaggtaagtctatttatttcaccgcttattgtcaaccagtaaacataaatctaatattacaaygaaagctctcttctctgaactatcaaagcaggcagttggttagtttttaaaaaatcagtaaatcagggaagcataaagagacatgcacaaatttcaataaataaaaagcaactttacatttattcaactgttatgtagacccaaggcattttctttggttatgcgtgtctacattggctttctaatttattgttgtgcataaactacagataatgtctacaacttccattttggatttttaaaaatggatcaagatcttaaatcttttagtggagccatctgaatagtaaagtgttagatttttatccttccatcttagtttcctctcactcataattactgtaacatgttttgttcagtaatttgcttttattaggcctttacagagcattcaacttcccttgggaacaattttacatagcaactggtataaacaggtttaggaacctgcaaacgcattcttggtaggcattgtgacactcagtggttagaagaagcatgcaggggtgcccactagacatgggggcataactgactgttttacagaggtaatggagagcattggacaatcaaggaagtcagttaaggaggttttagagcaattattgttgttgatgatttatcaatcagaccttctcagttttctagattacagctctgttgggaatgctgtgtttgttatcaatttgtatttggcattggcattgtgtaccatacttattaggtgtatgtgaaaaacaacaaaataagttgatgaaataatgtattttctttacagattgcatccaagacttatcagtctttatggaggaagcatggaagaaatgattccaaagtaacatgtaattgtttctaaaagaaatgtacaaactagaattttaatataaagaaatgtggccatgctttaaacctgtggtccccaccctttttgggaccagtttcatggaagacaatttttcygtggatgggggaatggtttcaggatgaactgttccacctcagatcatcaggcattagattctcttgaggaacatggcactctagatccctcacataccagttcaccatatggttcgcacttctatgagaatctaatgctgctgctgatctgacagggggaggaactcagtaatgctccattgctctaacctcctgctgtgtggccaaacggatatcctaatagaaattgatgttactaacaattagcctctagggctttaaaagtcaagatgaaatatcaattcaaattctgtttttaratatcaattcaaattcttttttttacaatgtgtttattggacacacaaaaaaactttgcaaccatcataatacatcaatatttaacctagataattctgaaataatttggattctttcatttttcaggatttgagctcatcaattatgttaaatttcctatattctgttacaaatataatacagatttcataagtctgccttgattcactgctccctaatccagagcagttaaatttcaaaatcacatagttatatagcctacctgccaaaaaagaataacccatccctgtcttcttaaagtggtagggttttaaaattcatgatacaagtaacaaagtaagttgataacaaatactattttgaactgggcaaaatctagcccaatatgtaattgtgttccccttgtatctgagaggcctgtgttggacaaccatagtactctgctttcactgtgctcaaataacctgaaatatatagttgtttctgagtagttctgagtaggaaagaaccaaatgtaaatttccttagagaccatcctggagaagacagttctaaatcggggcttgatttttcatctatgatcctagatgttctcctgaaagaatgactagcctttttataacgatacaaagttttttaaaaatacataaatgtcataaagtttattcctgtgtatacacactctgggttcaggaggttttgtgcttacatttcactactcaaatgccttcgcaaatctcagaacattcctcaccatcactgcaggcctgtgaacagataactttcatcaattaggatggctggctagtggcagggacttcatataaagaaatctttcccagaattgtttttccacattgccttctaatttgatcactccctataacagatgttcaaaattcggccacagctctcttatgaagacagagtcagataaaatgatattctgcaattatctagatcataagcataaaataaatattacaaaaatgattgtatttaaagaaattttttaaaatccagaaagtcatttaaaatagaacctcatatagtatgaacaaactataaaaatattttacatttcatgaaaattttgctgtcgtctcatttatattcactgtatacaaattgaatcagtatctttcagctaaatttatgaatttaaatttatgaattttgtttcttcgtttccatgtaaggtaacacttatacttgtaaacttatacttgtaaagggtaacaaagaattacatccaaggaaatagttgtgtgatagtcaatattttacatagtacataatacatatgaagtataggccccctagtctttgcacagctttgattttaaagttattagtgaggtatggtttctgtattttctaaatcagcgtgtatcaggtaaagtgcaacactcacaatcttttgtttcagaatataacaaaagatttgaagattactcctgggtatgcttgataaaggtgtgttataggaagaatagataggaagaatggtaaatatatacctacataaaaacacatgtatatatacagaaagaaagatggtgaaatccataattataaaaaaataattatccagaagtcatttcactaagctcaaaccagtgtacatgttcagtctgaagtttgccagtttggcctataatactataatattcatagtctgctgaaaaaaaatggttgttggaacacagcccgtaggaaatgtattataaataaagggctttaaagtgataatggtccactcgttagaaaatttgggaacagctctctaaaaaattatatttttaaagaacatattttgaacaagtatcaaagatgtatttgaaatgaacctctgcccacccagtggggttcattttactgaggcaagcacatatggtaagtagtatttcaagtctaagacttctccagtataatttaactcagttatactttcatttcaagatatcttcaagggcttacttttcttgaataaattgaatgctttagtgtttctctacccatttaaaagctgagagattatctttggctgtattattacctttgcagttcttctatctcaaagagtaatcattgctgagattttccccttgcatgaagacataatatgtcacaagatcatgagtaaaagaagtccaaacaaaattcattttttcttgtaaacagtgtcttttaaatttctttactacaacctgagtctgttttccattctctcaatttgaaagaagtccttaatcatcattgcttttactgttgatataactccaactgtctcttctgttttcttcttgtaggatagatttgtattgtcttttaaagaagccagcctgaaaatagcataacataatcactagtgtatagttatgaacactctcttatctactatactcatttctaatatctaagcagttaacaccaatatttcttaaactgcatcccttgtaacatcagtcataaaggtttaacagaggtaatcagtaaaaattagtggggacataccgggttaaagaaacatttttgtttttaatgcagaaattctcagtgatacacaccacattctctccaaaattgacattccgtgtaatttgcaatcttttccaaatggttttttaaaaggaacgtctgtctttcaaaacaaattaagaatgcatatttttctagaaagactttggtgttgaagagaaatgtgagatcagtactgagcaacataaaaagttaacattcaaatagtgaaatatttaaatctaataacttggaagtcaaattggctttgagaaaatgtcatttttagtagactaatgttggtaattgttaaatgcttaccttccacataacatatgagatcaacagaagtacaataagtccaagtagcaagctacttgaaataatcactatggtgaaataacgtttgggtctttgatgatgtagtccttccagtagaacctacgtgagttaagaaaaataaaactcaaaaaccaaaaaaaaaaaaatcagtttaaaacgttgcttatatttcctttaaagccctgccataatccccagtagtatttagaactgcccagcccattttcttgctggttctaatataattgcaggaaacactggtaactgtttagcagaaacagtgagtgtaatgggctgtatccatgacttttcctccaatctattcaattctcactgctgcccaattcacctctctgaaagaactgctgtattgttccctcctgccagttgtggaaaatgccaactctcaaccaagtattgggggccctccatgagctggtcacactctactttcccaactcagttactcagaaggaagtaattatagacacccttgaaatgtgttttcctataattttaatgtagcagttaagagggtaatcttacgtgcgcaacattctcatccttgtttagttcaattactcttggatttggctctggaaaacctgttgctcttatttcaaacttgagtgctgaagtctcatcctgtttaataaaagaaggatcaccatagcctggtttatttcataaagacataatttatcaggatctttaccttctagctagaggttttcacaatttaccttccccaatttatttcaccacttaaaattaactgcagtgcctcctttggttcccaaagtgtggtcttggtattaatttatatagtatcattttattgaaatcctttgattaaacagctaccttgcaaataacttgatttaaatattagactacagaaagaggtaagttaccatttaccattgttctccaccccaccaccgcatattgaatctatcttatttgggctttttatttctttctaaattaaatacattatagaattcaaatataaaatcagtggatgaactcagaactttactatctaaagcaaggattttataacgcagaatccatgaagcttggggatctgtagaagggctttataaattctaagaatctttaggagatgttttcatgtgtgcatttgctgagggagatgagaatatatttagtcagattcttaaagagggatatgacctttaaaactattgtgtaaatgttatttaacattttagagccaaaaatgacaagcttcctatagatctagagcagtggttctcagcagggagggttttatcacctaagggacagtcaggaatgtctaaagaaactgtcaagtgtcagaacgtgggaggtggtactaccagcagtgagcgtatagaggctgaggatgatactaaatatcctacaatgcacaggacaaccccccaaaacaaaattatctggttcaaaatgccaattatggccactgatggaaaacctagacctagagaaaaagataaggcaaactgcaaaaggttaaatgacttgctgatggttcaatgactttgcttttagcacagttgaaactaaaatggatatttcttctttgcctgtctagtgtatcttcctcttaagcactgtttggcaatttcaagaattccacttgaacataacagctgccatttcctttggcttcctatgttccatgaactaagttcttataaaaatcatctcatttatccatattgaacagatgagaaagctgaaaaacagaactccacataaaactagtttcatctcaaactactcctcataaatatacatgctcctttgtaggaaaaagtccaagatatatttcattatttttaaaatttaaatatgtttttgttgttgaattttgattttatttgattttatgaaagccttagtttttcttcttagctatatttttaaaataaaagggcttcaataaaattcatcatcccttcatgctaaaaactctcaataaactaggtgttgatggaacatatctcaataagagctatttatgacaaacccatagccaatatcatactgaatgggcaaaaactggaagcattccctttgaaaaccgtcacaagacaaggatgccctctctcaccactcctattcaacacagtattggaagttctggccagggcaatcaggcaagagaaagcaacaaagggtattcaaataggaagagaggaagtcaaattgtttgcaggtgacatgattgcatatttagaaaactccatggtctcagccccaaaactccttaagcttataagcaacttcagcaaagtctcaggatacaaaaatcaatgtgcaaaagtcacaagcattcgtatacaataatagacaagcagagagccaaatcatgagtgaattcccattcactacaaacagaataaaatacctaggaatccaacttacaagggatgtgaaggacctcttcaaggagcactacaaaccactgctcaaggaaataagaggacacaaacaaatggaaaaaaatattctatgctcatggataggaagaatcaatatcgtgaaaatggccatactgcccaaagtaatttacagattcaaggctactcccatcaagctaccattgactttcttcgcagaattagaaaaaactactttaaatttcctatggaaccataaaagagcccatatagtcaagacaatcctaagcaaaaagaaagctggaggcatcaggctacccgacttcaaactgtactacaaggctaaccaaaacacatacagaggccaatggaacagaacagagacctcagaaataacaccagacatctacctaggaatacaactggtctcgaactcctggcctcaagtgatcctcctgccttggcctcccaaagtgctgggattacaggcatgagccactgtgcctggcctattttagcctttattacctgttaatttctaaagccatttcacttagtcaatgtagatagttgaagtgatagaaatacagttttagagttttactccaaaattttatttaaaatttaatttgttgaatgccttcatactatcctgcctatatgactgaatttatagattttatgtaaacttagccaccaagttgtcaatgttttagacttacttaccatttctaaaatggatggccggccttcc

SEQ ID NO: 17603 - DNA, 14172 bp, Homo sapiens
  misc_feature (1)...(14172): n = A,T,C or G, or insertion/deletion polymorphism (see Tables 1-2)
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaccccgtcttgactaaaaatacaaaaaattagctgggcattgtggcacgggcctgtagtcccagctactcaggaaggctgaggcaggagaatcgcttgaacccaggaggcggaggttgcagtaagcgaagatcacgccactgcactccagcctgggcaacagagcgagactctgtctcataaataaataaataaataaataaataaataaataaagtgctgggattacaggcatgagccaccgcgcccggctgaaagagttacgtctttgtttagttctggaaatgtctccatcttactccttccagcagtgcttctctgcttgtccattgtcgtctggaactcccactgggctgtggcctgcttccccccaagtgtgctctctgtgttgccgcagggtggtctcgtcgtcactgtctcccagtccccagtctctcttctgctgtgtctggccacttaaaagtttattccattcatttgagggattttttttccaatggctatatttttaacttgcaatatttggttttttgttttttttattttcctacaaagttgaccctggtaatagttttcatggagtgcaacatgtaactttatattagaaaatggaatgtcacatctttaccatgggacagagacacaggaagatgtcaaagtctgaaatagcaagtgaagctgaatgtagcttatgatagggagggagggctctgctggacagggacagtctctgagcaggtgaactgctgatctcacagaggtcagcaatcggcggattttcaccgtgtaagtagactgaagtcatccgtagaagcacagacgtactggactgtcacatctactagaaaataaagcatctgccacctggggggtggggagggtccagtttagcccaatgggggacaacccagcacatccacctttggaacccaccagttaaaggtattgtcagagtatcctgtttgggaagaattcccatttcaggcaccctcgatgaagagccaggccaggaacatgggatgagagagcgaaatggtggaaaaaggggagataggctaattccagaggcacctgcccagccaacactcagccctggctgcgcgcactgagtcctgtgtctgctgcaggtatcgggctttccgggatgacgatggacattattcccagacctactggaatcttcttgccatccgcctggccttcgtcattgtgtttgaggtagccgaggcacctgctggttctcccatccatggcatgaggccccgaccctgtgctttgcctaattcgagcacgtggtgaggggtcggtgccgtcacttcctgctgtgtcatcttggtcaaatcagagctcttctctgcacctgcgttttccctgcctggcctcatccctgggttgtggtgtggacattgtgggtgtctccacaggagccccagggccacgaaagctggggtggcctctgccccttctggggttccttttcctgcacagctgctttctgactccacccacagctgggagcaggtgccggagccccggcctgcctggccctgtgaaggccactctgggcgtttgggtgggcgtgagtgccttcctctgctcccagcatgtggttttctccgttggccgcctcctggacctcctggtgcctgacatcccagagtctgtggagatcaaagtgaagcgggagtactacctggctaagcaggcactggctgagaatgaggtgaactgtacagcccagtctcggccctccccccagccctctccctatccttgtcagtggctgctctacctccggacactgagtcacatccctcttcctcttgctgcccttttttggggacaggttctttttggaacgaacggaacaaaggatgagcagcccgagggctcagaggcaagtctgggagcagccaggcccctgccccgtgcactccctgaggtcacagggccctgcccagccgcccactgtgcctcgtggccatggcctgctcctggccctagtctgacttgtccctgcccccaaccctctccccagctcagctcccactggacacccttcacggttcccaaggccagccagctgcagcagtgacgcctggaaggacatctggtggtccttaggggagtggcccctcctgagccctgcgagcagcgtccttttcctcttccctcaggcagcggctgtgtgaaccgctggctgctgttgtgcctcatctctgggcacattgcctgcttccccccagcgccggcttctctcctcagagcgcctgtcactccatccccggcagggagggaccgtcagctcacaaggccctctttgtttcctgctcccagacataagcccaaggggcccctgcacccaagggaccctgtccctcggtggcctccccaggcccctggacacgacagttctcctcaggcaggtgggctttgtggtcctcgccgcccctggccacatcgccctctcctcttacacctggtgaccttcgaatgtttcagagcgcagggccgttctccctcgtgtcctctggacccacccgccccttcctgccctgtttgcgcagggacatcacccacatgccccagctctcggaccctgcagctctgtgtcccaggccacagcaaaggtctgttgaacccctccctccattcccagttatctgggtcctctggattcttctgtttcttgaatcaggctctgctttccccctagccactacaggcagcctctgacagtgccgctttacttgcattctgcagcaattacatgtgtccttttgatccttgcccaacttccctccctctcccagctcctggcccctggcccagggcccctcttgctgtttttacctctgttccttggggcctagtacccagcaagcacccaaatgggggaggttttgggatgagaggaggaaacgtgtatacctgtaacatctggtggctcttcccccagaagtttgtgttcatacataattgttttccacgctggatcataatgtgacgtgcagttctgccctgtgctggggagccacatgaagcttcccctggctaacttgctaccccgcagcaatcccagtgtggccgtctgcttgctaaaaaatggatctgtgctcatctgtattgatgtccttggagttctacaagtggaacttaagtgtcaaaaagaatatgtggtttttagctgagcgtggtggctcacacctgtaatcccaggactttgggaggctgaggcaggaggattacaaggtcaggagttcgggactagcctgtccaacatggtgaaaccctgtctttactaaaaatgcaaaaattattctgggtgtggtggcgggcatctgtaatcccagctatttgggaggctgaggcaggagaatcgtttgaacccgggaggcggaggttgtagtgagctgagatctcaacactgcactacagcctgggcgacagagcaagactccgtctcgggaacacacacacacaaaaagaatatgtggttttaatgtgctttgatgagtactgccaaacttactccacagaaaaggcctctttctgaacatcctcgcctgcgttctatttcacccaccgtgatgcctggcctgagggcggcgtgcttgcttgtagcatttcttgaggatttgctacttgttcacctgcctcttaggagcactgtgccctgcctccatggaagggctcttccggcagggatgcaggctcacagcgccctggggctggacaccaccggccggagcatggcggacagcacacacggcccggggcgggaaccttggaaactttacacagatggggagctcagccattccacgtgtgctttcgctcagcacaatgcttactacaaacccacgtgtacttccttccagctggttgctttttattgttgctgtcttaaactccaaagttttaaggtgaatttattgaaacgtacgaaaatgctcagttcatacaggcttccaggtgaacaaactgttgtaaccagcacgtgggtaaaaggcaagttccacatcacccgacgtggaagctccccgatgcccacgtgcgccctaccctgtgaccctctcccatccagggccctgatgcccacatgcgccctaccctgcctgtgaccctttcccatccagagtagccaccaccttagccaccaagcagagatggaactggggactttgcatttggcgtctgccgtgggacattgcgcgagctccatccatgccgagcatccatctcagcccctcctggctgctgggctgcttcgtgtttggcttagggtcattttgcagttgtgtgctttactgtgggttgcatatttagggcccaacagaactgctgggtcagggataaacatgttcggcatttttttttttttgagatggagtctcgctctgtcacccaggctggagtgcagtggtacgatctcggctcactgcaagctctgcctcccgggttcacgccattctcctgcctcagcctcccgagtagctgggactacaggcgcccgccaccacacccagctaattttttgcatttttaatagagacggggtttcaccgtgttagccaggatggtcttgatctcctgacctcgtgatccgcccacctcggcttcccaaagtgctgggattacaggcgtgagccaccgtacccggccaacatgtttggctttaagaggaactgccatacccgtcttcccaggtggggaccagcccagtcagcagcaggaacacctattccctcttgactcttcccgttatctcctgccactcaggtgactggggtggctcctcccactcaacgcccctccctcctcctcctccagccgaggcctccgcccgcaccccccaccacccaactcagctcgtcataactcacaggccgggtccagggtgccaggaatgccactgaggctggcagagtcctaaaagggagtggcaggtgctgctccacaaggacggttgtccaccctcaatgagggctgcagggcaactgctgactgtctggcagccagaggacagggacaggcagccaccctcttgccatgaccacacctgggtctccctcaatgtggctcccgaggggccgttgaacacagtgttgagaactgctgagaaaatcacaccaaagacgaactacccacagatgccagtcaccactccagggtgacgagaaagagaacacacaggcggcagcgtgacaaaatgagtcccagcatgctacatctggtttcgggttttattttagaatttataaaattccagtgtcatccatattcatgagcctttacacatgtttgcatataatctccaaattccaaagttaaggccaagggatggattgtagctatggaaacagatgatatggaagacatccaacaaggaggaaaagcacacgcacgcctcacccctgcctcatctctgcccagggctgtcctgacagcacagacgcttcagggagacaggcctggggacagtcatgtcatcacccttgcaacaaccacccaaaggaaaagagagcgctgaacagtttaggaaagggctcgcgtctaagacatcaagcgacatacagagatgtgcaaaacttggtgagaattaaaattgacctttgggagagggtaggggcaggatgttttatgacactgtagaaaagacaggaggaaccygctgcgatggagattgsggggagctggaagcaagcagccaacaggacagagttccagaactcatgcagatggggaagaggtgacagcccttccccactggcctcccccgtggaggtggagtagacagatcccgggaaaggcaggaaaagggccttgctttctttccctgtttcctaagccgtggtcacccyagcctatgaagctggaagctatattccttccaatcccaatttaccattcctgtaaacaggcccattcagggctgcctgagcaaatggggacttgccgaggcagctgcaactagacttgggctaagccgtctgggtctactcaagaattcgmgtctgaagatgaccaagcttgagttattcaactgagagtgaggtgtcaaggcggaagcgactgtccccagggaagggctgtgagatggatgggcgtgagtcagcttttccaaaactcaagtacctgggacaggacaactcrctagcagctcagtcacctccgtggcggacacagataaggatgttaagaccagaaaaccagagactagggccccgtcctcagccctcacagcatgacacagatgcctccctcggagagcagggtctctcggcatccagcggcgtggtctgcattctgctctacctcatgctctaggccccatgccatcgtctcggccctagaccrtgaaaactgccagtcacccgggacctgctcctaggggctggcctgcacagccggatggcctgtgggcggggtggaagtgcccactcccactccagatgggcctgctggccactgacccacctgtgctgagggagagcgccagcctccagcttaggtacacggcgcccacccccagctccacgggaaacccataaccaccagaaacatctcaatcaagagacgggtgtgtggggtggcactaactgcacagagaccactccacgccggctgaggtagaaagaaggcaactgaacacacagcagctagggcaggggcagggaggggctgcaggtggtgtgaagaagagcccagctgtcatctaaggcaaactgcccccactgaggacaagcgtaaggccctacctcccccaacctgtgcgcatctcaatcacagcagacactgtgacggccacaggggacccagatggtgcctaccaccttgcctccaggctccactcaccagacctcaggctgagggtctggcagtggaggtaggggcagggacccttggtgctttcagaccccacggcaggtaaaatcaggactgcctgagaacccgtcaccctctgcctctcaggtcaccccccagctccaggaacctgcctcctgctgtccaytgccaggtcttccttgcaccctgacacctgtgctgaggcgctctggcagctggaggaggctgattgcactccacaaacaggactgtctggaccaagggaaactggcaggagggaggtgggaaaggaagagggcaaacgtttggcttttataaagtcaaggacgtttatttcctgaggtcatgacacaggaagtggaatcctagccacggctgcggagctctcgtgatgaaggccagagtgctgactgacatgccgggtggaccaggagctggagtctgttatcttagcacgaatgctcatgaccttggtttagtgttaaacagtggagcaggtcctgagcgggcacggccaggcctggaggagcggccgcacacacagccaggcgctaggctccctgcgggacctcgggaagggggaagagcgtcaacaatttacggagggtccagccgctgggtcagattgagacaaaccattgtgtggttgggtttgggtcagcaggctggagagggttctgttctttttgatcattatcgtttggggccccaagggagggtcttgggagccacctgagccccaaagctgggaaattcctcagagctgctcatgtcaggagcctgtgcagagagaggacacggcttcaggaggggatgctccccaactcgcaagcagcttccgacgcagttgccaccctcaggacaccaagcccgcctgcccgcccaccctccctgggacccaggagggcagaagcccgcatctgaccttctcactgctgctggcggtccagggtgcgtcccgcaccacaaagcctctggaaggtgccttggcctcttcgtgtgctgggggtttcatgtatacctgcagcgcctcactgtccaccacgtcagctagctgcaggcagaagacaggaagacagggtcagtctgcccagcacccccagcatcccgcccgcctgctcacccctgcacctcgcctgcctctggaaacacaagtgccaccttgtcccctgaagctcctggctgggcctcaggccggtggacgtgccagggcgcctcagggctccaaggcccacagagactcacgtattcctcctccagattgaggatgtggtcgatggcttcctccacattctctgggagccccgtcacagtgacgcagttggggtctggggctccgctctgtgggaagcgaatgtccacctggaaggggtgtacaacgtcagatgaggggactccaagcgaggaaaagggttaaaattatgtgtcaatttctagtgaagcattttctgagttagcaaacgttttaaaatctggtttcagagttgttctgaagtcagtcagcctcatcaccacaccaagttaggtgtatctcaggagcaccttgttcccagcagacagagggccgcagcacgtactgtgcgctcttgcatgaaattcccacccacagaggacgagctcgccaggcagctgtcaaggagatgccctcctaatggccaccgtggcagtgcagcctcacacaggccgtcgcctgcactgacccgtggtgtccatgaggacagttccactgccagccctggggttgtggcctcatcatcttgaggggaaggccatgccctgctctttcttctggccagccaggtgcccccggtgagagaggattctcacccactgtgcttccagccggctcaccttgaattcgtccatgattttgcgaatggctttgccgcgggcaccaatgatgcgggcgtgaacgcggtggtccagcgggacgtcctcagaaaccatctgctcaagttcacccacaattctcagtatagcatccctggcagcttctgtgttcttttcgtaccctgtgatggtaatttggtcctggggctaaaaaaggagaatgtagtcagaaaaggggatgccttactgggattcccgtcaggggcaagagccggcccccactgctgaggaaaacagctcaggagagaagatggaaagcaacgtcacggctgatttaaaacaagaggttaacaatgtccactcagggccgggcacggtggctcacgcctgtaatcccagcactttgggaggccgaggcaggcggatcacctgaggtccggaattcgtgaccagcctgaccaacatggagaaaccccgcctctactaaaaatacaatattagccgggcgtggtggtgcacgcctgtaatcccagctactcccggggctgaggcacgagaattgcttgaacccgggaggcggaggttgctgtgagccgagattgcgccactgcactccagcctgggcaacagagcaaaactccatctcaaaaaaaaaaaaacaaaaaaaaaacaccccacaaaaaacctatgtccactcagcttccatctcttcccaaactctacccaaaagacagtgaattacagaacgaaaaaggacatttgtcctcaaagacaaaggagagacactaacaggcaagaattctggactcaaggacagcggggcaaagacaaagccccaagcccctcagcttcctgcttctttgcccacgtgggccacagtctggaggcatctttgtgctggaggctggaggctggctggcattcctcagcgagcccctccctcactcagagatcccacctgctcaggccttccttgggccacacaaatggacaggagacaccataccagacttgggatagcagacaagcagaccaagcagacagttcagggcatagagaaggaaacgtggtaacaaaacacctgtagcccacaatcggcgaaaacaacatgtccacaacacaaaaaccaccatgcaacaggactagaggacggggacaaatcacaaccatcacgcaacaggactagaggacagggacaaatcacaacacggaaccatcatcacgcaacaggactagaggacagggacaaatgcctggaaaggaaatgagcagaaagacctaacctagagacaacagagcagcagcccaagaagcttctgtccagattgaagcaaaatgccagagtgggaggcagcagccccacccaccgtggcccagcagagctgacagcctcaggcaccacccgcgtgctgccaggtacagaacctcaagatcggaagcacagctcacaggaaaaagctgcctgtgaagaaatgactgctccaccccacttggctcatggtgtattagatggaatagtctaattgctaaacaatgactttttttttttttttttaaagacagagtctcactctgtcgcccaggctggagtgcaatggcatgatctcagctcactgcagcctccgcctcctgcgttcaagcgattctcacgtctcagtctcccgagtagctgggattacaggtgcacgcgaccacgcctggctaattttcatatttttagtagagacaggctttcgccatgttggtcaggttggccttgaactcctgacctcaggggatccacccgcctcggcctccaaaagtgttgggattacaggcgtgagccactggtgactcacctataatgacttttaagattgataattatatagaatagtagagggaaataaaaggcaataagggtgaggggcttaaaagagctaaactcttgggctgggagcggtggctcacagctgtagtcccagctacttgggaggttgaggcacgagaatcacttcaacccgggaggcagaggttacagtgagccgagatcgcgccactgcactccacctggggcaacaagacaaagactatctctctcaaaaaaaagaactaaactctcaagatcaagactaaaaattaaaaaatgtatgtggggagggaagaggacgtgggagctggaggaggcagggtgcaggagggccctcctggcctggctggtgtgtgtgtgactcaaagatccaaaagggaacaagaagctggggaggaagaaggggaaggggaaggggaagcagcggaaaaccctgggcggcacatccacagtgggagcgaggggcgtggaggggctctgctgccagggggtttgctgtttctggaaaccagcacaactgtggccaccaaggcttgctagtctcccactgtgggcaaagctgtgctggacacgcctaggaagcagacaccccagcaggatgccagagccaggaaagaccaagcctgggaagtgtgtgcaagagggggtgttgggtgaggctgccctgcatgccaggtggcagggcccagagaggggatggggctgcctttcattttgttctgagtgaagcaggaggccatgagggccagtggcaggggggtggcactgcaatttggaggaagtaacaacaagagtttactaaggaccatctggcaagcacaacggtgtttgcagctggggctgcagagaaatgtccacctgaccccaagaggcccaggtgacaggtgaatgagagcccttgggagcctcagagaggcccgggtgacaggtgaatgagctacacctggaggcgccactgatcaaggacccagctggagctcctgctcattttctggaaggagacgcaggagaaaatgctccaggccccagatgatacatagtgccagagacctcacccatctggcaagtaccgagacacagcccaaacctcaagccagaattaggtcctgagagacttgccactctcaacttggccctcgaacccccatctaggcacatctggttactgctcccaagtcacaggaaaggtcaacaagcacctctgcccccgacacgctccaaccgaggctctcacctggttcccatcgtccttatcaggaaactggatgttcacgtcatgctccaaccggatttgggtaattactgccccctttctcccgataatcttgggatggtatttggggtctacagtgacactcagcttaaaactccttaaagcctacaaatgaaaggagcaagaatgaggcaaagattgagctgatccaccctgtgactccattccccttccaccctggtcataggacactggagatgctgcagtgttctgtaacccgtggtccggaatggtccgccatctctctggtccgacctctgccaccttccattatctgctaataatgagaaccagggaacttggctgctccacaaggaggtctataaatccttcaaaagagggcttgggaccacttgcgaggatcgtgctcaggaactgacagagctaggcagtgagtcacgagcttggggccccgctctcctcatttgtcaaacagggatctgatggatacgcacagaaatgctctggatctttttaggactggggcagatgcagaccaagaagagggggcagccacagcccctgaacacccatggccaaaggctacaggtatgacctggctgcaggagacaacccagagtccacgcaggggtacactgacaccatgtgaggttcacgagctccaccccattcaccagactcaacgtgctcacgggaggagtggaaagccaacccccttagcaaaccagcaccccagcacagtctgctccaagttccagaacccctgctcctgtctgcagcactctgctcacacaatcctccaaatgtcagccctgccagaggctgggcgtctgcagcgctccgctcatacaatccttcaaacgtcagccttgccagaggttgggggggtttcatccctgcttaccaggaagtcattcgccctttgaccaccctgtgctagaggttagtgggggtccccgatgctcgtcctcactgcatagcacatgcttgggggcctctcgcaaccttgacctttcttgtaggtctgaggtaccactctgatttggttttgagagaaactgcaaatttacacggaagtccaactttgtcacttttttatgaaaaagagaaaggtgccatgctcttggctagttccacagcaagacccctggatgctgactgcgtcctggcactgcctgcatctcacctccagccagatgtcgctgggatgctgggatcctgaagaacttccctagattctgacatgtgcccaaagctgagcaccatggctctgggcagtgccccggccacctcctgctcacccggtcctcctgctcggcctgtagctccttcacacgctccagcagtccagccttggcccggtccaaatttgcagcgaggcccgtgatggcgatgatgtcagactgcagctcaggtgccgggacatgtatgttcacctacgtgaagagggggctgacttgacgttcaggaccccagagaacaggaaagagtccattggccctgggacccagaagtggtgagagggaaggccacccgccgtgaagggaagtcagtgcccagtccgagcaggaggaggcagagtcaacaggaagttgagaaaggacactggcactcgg

SEQ ID NO: 17604 - DNA, 43871 bp, Homo sapiens
ctcactgcaagctccgcctcccaggttcacaccattctcctgcctcagcctccagagtagctgggactataggcgcccgccaccatgcccggctaattttttttgtattttagtagagacggggtttcaccgtgttagccaggatggtctcaatctcccgaccttgtgatccgcccacctcagcctcccaaagtgctgggattacaggcatgagccaccgcgcctggccctgtcaaagtaaagtttataagaatgcagatattaatattaaatagctaagtataaaatgttttttccaactgataaacataaatagaacaaagcacctatatacaaagggtaatttgactttttaaacatgtaatagataatagttaactttttaaaataaagttgttactttcaattagttaaaaaaaattaccttcagatagtggctcaggtttaaattccaggcctcaagcattctactacccccagaaatgtcctttcttgtccactgaagttcttccttttgggggcactaaatcatgatagctgtagcttcatttatgtgaaagctttaattgggtcttcacagcagcattttctctgtaatgagaaggtatttaatgtatattttattttcctacacataaagataattattactttttgttatgcaggttttattttaaaataaccattatcagcctggtgtggtaaaactatcaattgattcatttaagagaactaaagatgaggactgactttacaggtaactacatgtatcttgggacaggtgacaatctctctgtgcctgtttccttgtctaaaatcaggtatttggaatatttaaattctcacgttttataactatcactaaaacaaagatctctagcaaattacatttttcatcaatgaaaatacttactattagggtatcttttggagccacaagaagcttgaaaataaaagctcttctccccatgccctacctcccaaaccctagaattgacaggcttatttcttaagcaagcgtattacaattaaagagagcagaaagaaaaaagaaaatattaaatatggagcctaaacagttaatgattggatttcagaaaacacactaaagcattaaattttgccggcaaattgctttctagaatgttttgttatcacatttaaaaagtggattttatcttatatcaaaagtaaagattggaaagcatctgtaaaattagcagctcagcgcttttttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaatttttttgtattttcagtagagacagggtttcaccgtgttagccgggatggtctcgatctcctgacttcgtgatccgcccgcctcggcctcccaaagtgctgggattacaggcgtgagccaccgcgcccggcgagctcagcgtttttattctgggaagaaagggctttttattgtttttagacagtgaatgtatggcagaggggtagagacgattcaggttgttgtcatgtctccttcaaggaccatacttgggccactgctgttaggatcttattcaacagcaattctatcagttcaaaattttggaggcaatttcttatgtgtaatatccaaaaaaaatggtcttaacatccaaccatgttgttgagtatccttcacagacttctgtgtattaaaatattattgttacaaccaataaccttagaataaatccccaaatagggtaattaaagagaaagcagcttgaagttgtttctttaaattccagataccttggttaatgtcctaagatgtaaaagatctttaaatctattcattatcagcgccagatcttattaactacattaaaaagtattgctcggcgggatgctggtggctcacacctgtaatcccagcactttgggaggccaaggtgggcagatcacgaagttaagagattgagaccatcctggccaacgtggtgaaaccccatctctactaaaaatacaaaaaagttagctaggtgtggtggtgcgcacctatagtcctagctactggggaggttgaggcaggagaatcgcttgaacctgggaagcacaggtcgcagggagccaagattgtgccacggcactacagcctggcgacagagtgagactctgtctcaaaaataaataaataaataaataaataaataaataaaatattgctcaaaagtactttagaaagtaaaatttaccgcatcttttagaggtaaatgacataacattccttttataatatgtacaaaattactatgaatcagtggtgtcaaaaatgaaatcaagactaattcacaaatattttaataggataatttattttttaagaatcagtttttaaagttatgttaaacatcgaacttttaaatgcatgcaattatatataaacaataacctatattaatttttaaattttctgctggatgcagtggctcatgcctgtaatcccagcgctttgggagtctaaagtgggcggatcttgaggtcaggagttgggaggccagcctggccaacatagtgaaaccctgtctctacttaaaaaaaaacaaaaaaaaacaggctaggtgcagtggctcatgcctgtaatcccagcactttgggaggctgagcagatggatcacaaggtcaggagattgagaccatcctggccaacatgataaaaccctgtgtctaccaaaaatacaaaaattagctgggcgtggtggcgtgtgcctgtaatcccagctactcgggaggctgaggcaggggaattgcttgaaccagggagttggaggttgcagtgagccaagattgcaccactgcactccagcctggtgacagagccagactccatctcaaaaagaaaacaaaacaaaatacaaaaatcagctgggagtggtggcaggagcctgcaatcgcagctattggggaggctgaaacacggatcacttgaacctggaaggcagaggttgcagtgagatgagatcatgccactgcattccagcctgggcaacagagcaagactccacctcaaccagtacagtggctcacgcctgtaatcccagcacttttgaaggccgaggtgggaagatcacaaggtcaggggatcgagaccatcccggccaacatggtgaaaccccttctctactaaaatacaaaaaattagccgggcatggtggcaggcacctgtagtcccagctactcgggaagctgaggcaggagaatcgcttcaacctggaaggcggaggttgcagtgagctaagatagcgccactgcactccagcctcgcgacagagggagactctgaaaaaaaacaaaaaaccaaaaacaaaacaacaaacaccaccaccaccaccaaaaaaccctccaactcaaaaaataaaaaaataaaaaaaagcactttttaattttcagggaaaaaaaatctaaggctggtgttcacaatgtcaattttatttatggtttattctcactataagcttccctgcaatccatttctacccatgttttactctgcacaaactttttacctttttgctctgattttttgtttgttttttttttttgagatggagtttcactctttttgcccaggctggagtgaagtggcgtgatcttggcttactgcaaactccaccttccaggttcaagcaattctcctgcctcagcctccccagtagctcggattataggcaccccccaccatgcctggccaatttttgtatttttagcagagacggggtttcaccatgttggccaggctggtctcaaactcctgacctcaggtgctccacccgcctcagccacccaaaatgctgggattaggctgctctttgagagctttacaaatttatttaatccttacaatgactctgaggtagatcttcttgtctctgtttgtagataagaaaactggaactgtcaagaaacttgcttaagatcacagagtgcattaggcttggatccataatcaaattggaaaaaaagaaaaacacaaagaacaattaagactccaaagccctaatgcatagtctttgtatcctatcacactgtggcattatatatataaaacaaaaaactttataataaagagaaatgtattttccaaactgtggttctccagataacaatgtgtctccatgaggaccatatagtaaatacatcccataaaaaatgattaccaaccaaaagcttgcaattaatgttccaactaaagaaaaagactcaaagtaaaagcatcagctatcctaggtactgtttggaggcaacaccaaacacgacacataaatcattgttgaaaaaaaccgtaaaacataatgctgggtatttagttatgttgaatgctaaaactaatctttccttaactaaaggtctccgtcaaatgaaaagtgtattttagtcaagtcaggatttctgttttgcaaactcaaagtcttatattattaagcatatattcaggttatttattttcctgatcataattttcaaatcaaattaagatcaaactccactgaccgtcaggtactgtatattctcattttgataaatttcaaattaatgataaaaatgtattaacctgctggtcaattatacattttataaatatattttaaccaatgacatattatcagtaagtacagattcaacggcaagatttcattaagaaagtgtttcaagcttcagatgcccaagacttatttaatgtgtaaatcttcaccactacaataaccacatggttaaacgatcaccacttccattagcaagctcaagcctaataagtgatctcctgggacttcagcacagaggttttctaattttattcctccactcaatgtggctattctcccttatctattcacgctggcaaagcttctagttaaactggaattagtaactatttgatgataataattaacatatactgagtgcttccgatgccgcagttaattcttatagttgataaaagtgtggcacaaaaaggttaatcaagtagcagaggcaggatttgaacccaggaattctggttccagggcccggattcggagctacaaaggtgagtaaactgaaaagagtcctacttttattgtcattgctctctaataaaaattattttttcttccaattgtttaaatctcttctcattctctatttaaatattaggcgttcatttaaacattaggcgtctaccttacagtaggacatctttaaacaacgtaaaaaaggaaagctttgtcttcaccttcacacataccggtctgcccataaattttgcaatccagttctgcctgattctaaactgcttgtctcttgaagcgaatgccttaaaaagtgacattgggatcaggatagttatctccatccatcctccctcagaaaaacaactatattagagtaattcttgggaccattgagaacaatacacaggcctttgggtaacttcaagacaaaaaaggcaaaaagtcggggagaaggtgtgggaggatgattttccccttctaaacgtaaggtataaaagggctcagaaagcggaaaaagaaccctaaaaagcaaggtgcgggacggcgtgagggaccacacattgggcgctccgcccaaggggtccggctccttctccgcggcgatggcgcgtccttgggctcagcaaccctcctgaagacacctaacctcctccttctccagcctgcccctctggggcctgcgagccccgtcccgggccgggggtcggaagccgtgccatgtgggaccccgaaaaggcccccaagcttggcgcggaaggcgccgccagtgaccggctgcggctgggggcggaggccggcagttgctcggagctccggcgggtcaggaggtgacgggaggaggaggaggcaggaggaagacaggggggttgggaggtagcgtccggtaggtctgcgcagacagcgctgccagacctctgactcccccagtcctgccgccgccgatagccccacaaggcgacatgggaagtccgccggagcagaggggagaaaattcaaaacgagtctactcaacctcgtcttggctccgaggccccgccatggagaccagcataatgcgcaggcgcgccccaccgggagcgcgcagagcagtcccacgacagtaggaccactatcggccaccgtcgaccgtttcctctctcatccgttcttttctttgtatttccgcctctcgcctctctctaaaagccgcagttagaggcgagatttaggaaaaacctctgccgagtgagcctctggttgggaatatgtatgagaaaaaaaaactggcaaggcgttagtcaagcaaagctgaaggcagaggaaatttgatatctggctggagtctagaggatttaatgcaaataagatactctgagggcagcgtggcaaaaaaagactacaattcccggtggtcacagcgtttgagaagcgatgctttctgagacttgtagtaactaggagctgtgtttgaactatccaggctcaggacagcctcttgaaaaaaaattttttattaataaagcggatttgagtgggatctttttcctmatcgattacgggcccacacgtatgggaagaattctaacaatgattaaagggacatgctacctttacgactatccttttctaatcgatgactcctaaatctaggagtaggtagtcgatgtttgtggtctgggcgtctgtagaagggcaacctcgtgctttctgcagaggagaccggagggcagaaggcagagtccaggcttagactgcagttcctcgcttacctgtgcagtctaattttgagctgcctctttgtagtcttaaaaggcaggagcttcgtgtwgtgggtctgctaacccgtacgtttccgtgggcaagtcgtgtgtactcctcgccatggctcagctccaaacacgcttctacactgataacaagaagtaagtaagcgttccagccttctctcccttccccaggttcctttccgaccacccctttggtatgaccttgtggatccctggttgtttctgctgtcacccccacccttttttctgagattacctgctttctaaccagcttcgtaggttctatataatttgaattgtgagtgtggaggaggctgaagggcttcaggtttgctttctgaatgaaacattttatatgtgtaatttaaaaatgaacagtgggccttgttatagggtgtctgctagtggtggttcacagtttttgaaaacggaaaaaaagtttttgaaaatgaaaaaacatatttaccatttatgtatatctatatagatatataaacattttaaccagtggtctcaaggtctgttagcactcattcgaaaactaattatatgctgccttgtggtatatattgcattgttagctttctttgtgtttgcctggtctcttccaactatattggaagtctcttgagggcagggactatatattaattaagcttcttggattggctgagtcaacaaaaaatgtcaaatttttcagtgaaaatgataatatttgtcgtgttaataagctaaagttagccataaactaggaaactcccacctgagttacatctgtggttttgtttgtagctttatgaggagagctagtaaatcatcttctctccccttgtgttgttgctgaaagtatacataaatcgtattatcaatgcacctgagtatatgtacttacttacatacattgccttaatacttctctaggaatgtggtgatgcattaacataaccactgtgttttttaattgaaagtaggtttttttgtttttcttaaaataaaattttttgaaatatgtggggcttttttttgtttgtttggtttggtttttttggagacagagtctcactctgttgcccaggctggactgcagtggtgggatcttggctcactgtaacctctgtctcccgggttcaaacaatcttcccgcctcagcctccagagtagctggaattacaggcatgtgccaccaagcctggctaatttttgtatttttagtagagacaggaatttgtcttggtggccatgctggtctcgaactcctggcctcaagtgatccgcccacctcggtctcccaaagtcctggaattacaggcatgacccactgcgtccagccttgagataattgttgattcacatgaagttgtaagagataataggccactgtgttttaacccctgaaatgaatggatacatgtcatatgtgtgtgtgtgaatttaggccctccaaaaggtaaaaaaatgtagaaattaaaattctttgccgagtgctgtggctcatgtctgtaatcccaacagtctgggaggctgaggaacgcaaatcgcttatctcaggagtttgagaccagcctgagcaacatgatgaaaccccgtctctaccaaaaatacaaaaaatttgccaggcatggtggtgcccacctgtggtcccagctacttgggaggctgaggtgggaggatctcttgagcctgagaggcagaggttgcagtgagccaggatcaatgcaactgcactccagcctggggaacatagtgagactctatctcaaataaataaataaataaataaataaataataaaattcttgctttttctttttgcttaatattatggtcagtaaaatggaggcggggggctaatataattgtcacacacacacacaagaatatacatatatgtgaattatatacataaatatatagctatagccttattgctcaaagtgtggtttgaggatcatcagcatcatatttgcaaagttgtgcaaccatcaccacagtcaattttagaacatttttcatcatccttgagctgtttgttaaataatacccccagccctaggcaaccactgatctactttctagctctgtaactttctctcttctggacgttttgaataaatggaattatataatgtgatcttttgtgactggcttctttcacttactatgatttttaaaaaatggtttcattatatcatagtatatattagcacttcattcctttttgtggccaaataataggccattgaatggaggtaccatatttttccattcatcagctggtgggcatttaggttgtttataccttttagctattatgaatagttgttatgtgaacactcgtacaagttttcgtgtggatgtatgttttcgtttctcttgcatatatgcttaggagtggagtttttgggtcagatgtaattccatgtttgagtttttgaggaactgccagactgttttccaaagcaactgcaccattttacgttactgccagcaataatcagggttccaattgctccatattttcactgacacttgttattagctgtctttttacttatagcaccctagtggatgtgaaattatatttcattgtgtttgattagcattacctggatgactaatgatgagcatttgcatgtccctattgggccattttaaaatttgtgttgtctttttattattgagttgtaagtgttcttaatatagtctagatacaagttccttattagatacatgatttgcaaatattttctcacagtctctcttataagagtctcctaatctgcctcctgtcatgtgttcctctatttcagtgcccattgtgcagccagaaagatctaactaaataaaatctgatgatacttctaatttgcactgctgtgatagttcttcattacccacaaaaaagaagtaaaaatgatttcacatgatatataaagcactccatgtgtatctctttagcctttggtcactttggagcaaagtcagattttctggaagtggctgggcagtttaacaactcctagctattgttttgatgttctctctggtttcgtccacactgcttcttccagcctacccttccctcacctggcaaaaactcacttctcttttgagacagggtcttgctgtgtcacccaggctggagtgcagtgcagtggtataatctcagctcactgcagcctcgacctcctgggctcaggcagtcctcccacctcagcctcccaagtagctgggactacgggcacatgccaccacgcctggctaatcacttttctaaatgttgcttaacagttatcttttctgtggatcgtttctggccctgctcccctgccctccttttctgtggttaaaatgacctatggtgtctttgttctttttatacatgtcacctaatggcattgttcttatataacttcattctatttgattactaaacttcaacctcatcttagaacagagaccatgttttaattcatttttgtttacaacatgtagcaaaatgtctggatgtctggcatttatttacccaataaatgtatgttgaattcgtaaaagcatgtttgttcaaatatctgtagacttgatcttgacatatcatttcctttttatagatatgccgtagatgatgttcccttctcaatccctgctgcctctgaaattgccgaccttagtaacatcatcaataaactactaaaggacaaaaatggtgggtatatatgcttaggagagggcacagtgtccctaattattctaaaatgcattaagtttttagttccttttttggccttatgatactgtatgaattttgtagtggtaaaatttgtaagttataaagtacaggttcttctgctggatgatactgtaaatactgctttgaaagaaaagttttcagaaaaaaatttctgtttaatctgtttttaaggccatgtggaaatatggtggttgtagttaaggaataaagattttggtataaagttgtaatayagaggtaatcaagacattgattgttctacagagggctgagttatgcaggcataaaacaagcgttttagtgcttaggccccatttactagtgaagcacaaagcaaaatgacaatatcagtatttgagtgtttagtgtaatatcaaaatgacagtatgaataccagtattttattttttgtgtccagaattcataaaaaaaggatataacaaaacatggaagaatataaaacatttaaaagatacaaatattaaatatatactattgtactaatataagttatttgcccattaaattaatatgaacaatgtatgtaaaaatatcaatgaaataagattggctatgagttaataattgttgaagtttgtaatcccagcactttgggaggccgaggcgggtggatcacgaggtcaggagtttgagaccagcctgaccaacatggtgaaaccccgtctctactaaaaatacaaaaatcagccaggcgtggtggcacatgcctgtaatctcagctgctaaggaggctgaggcaggagaattgcttgaacccgggaggcggaggttgcagtgagccaagatcgcaccattgcactccagcctgggtgatagaggaagtctcaaaaaaaaaaaaaatgttgaagtttggtgataggtgtaaggaggctccttatattattttctgtatctcattgtagttttgattgatatttctgaacttttccatatgtatgaaattttctataataaagtattttttaaaaagtaaagaaacattacataaaatagagaaaatttaaacatgaaacattaagtgattctcctgcctcatcctccagagtagctggaattacaggtgcccgctaccatgcctggctaattttttgtacttttagtagaaacggggtttcaccatttggcgaggctggtctcgaactcctgacctcaggtgatccaccctcctgggcctcccaaagtgctgggattacatgtgtgagccaccatgcccagccagaggcaagtgtatttttatgcagatgtttccaatgctgcagagctcttctgactctaccgtagttggaggaatgaggaggtaagagttataaactaatgtgtagtattttccccatcttcgtcttcaaataatcacataatttttttgtgaaatttgaggtgatgtttttgagcaactttattggcttggggtgggggaggaggggacagggtttgcaatctttttattgctagttacagttcaatattcaatattcaaggatatttacatagcatttcctgttgctccttgtttttgttttcatcatggatatatagagattctgatgcatagttacctttataaatttcaaaactgttatatagtctatttgttgaacaagtctttgaactagaataagaaatattctttttaatttttgtaggtacgtggtaggtgtatctatggggtacattagatattttgatacaggcatataaggtgtaataatcacatcagggtaaatgaggtatccatcacctcaagcatttatcctttgtgttacaaacaatccaattatactcttcgttgtttttaaatgtataattaaattattgactatagtcatccagttgtgctatcaaatacaagatcttatttattctttcaattcttttgtacccattaaccatccatttccacttgcctctcacttcccccactacccttctcagtgtctggtaactctccttctactctgtatctccatgagttcaatgttttaatttttagctcccacaaataagtgagaatatgcaaagtttgttttctgtgcctggcttatttcactgaacataatgacctccaattctacccatgttgttgtaaatgacaggatctcattcttttttatggctgaatagtactccattgtgtagaagtattgatttcctgatttctctacttttgagtatatacctagcagtgctattgctggatcatatggtagctctatttttagttttttgaggaatctccaaactgttctccatagtagttgtactaattgacatccccaccaaggtttatgaggggtcccttttctccatatcctcaccagcattttttatggcgtgactttcagataaaagccattttggcctggcgtggtggcccacgcctgtaatcccagcactttgggaggccaaggtgggtggatcatgaagtcaagaatttgagaccagcctgggcaaaatagtaaaccccatctctactacaaatacaaaaattagccrggcatggtggcaggtgcctgtaaacccagctactcaggaggctgaagcaggagaattgcttgaacccgggaggcggaagttgtagtgagccgagctcgtgccactgcactccaacctgggtgacagagcaggactccgtcttgggaggggtggggaaaaacgccattttatctggggtgaaatgatatctcattgtagttttgatttgtatttcactgatgatcagtgatggtgagcaccctttcatttacctgtttgccatttgaattttcttttgagaaatgtatgttcaaaccttttgcccaatttttaatcagattattaaatttttacctacagagctttttgagctccttatatattctggttattaatcccttgtcagatgggtagttggcaaataattattcccattctgtgggttgtctcttcactttgttaattgtttcctttgctgtgctttttaacctgatgggatcgcatttgtctatttctgctttgattgcctgtgcttgtgtggtattactcaagaaatttttgcccagaccactgccctggggagtttccccaatgttttcttgtattagtttcatagttcgaggtcttacaaatatttaagtctttaatcccttttgttttgacttttgtatgtggcaagagataggggtctagtttcattttttttgcatatggatacccagtttttccagcaccattattgaagagactggctgttccccagtgtaggtttgagttcactgtagatgtgtggatttgttttggcttctctattctgttccattggtgtatgtgtctgtttttatgccagtaccatgctgttttggttactatagctctgtagtataatttgaagtcaggtaatgtgattcctccaagtttgttctttttgcttaaggtagctttggctattctggttcttttgtggttccatgtaaattttaggatttttttttttctgtgaagaatgtcattggtattttgataaggattgcattgaatctgtaggttgctttgggtactatggacattttaacaatattaaattcttccaatccatgatcctggaatatctttccatttttttgtgtcctcttcaatttctttttttctttttcttttcttttttttttttttttttttttttttgagacagagtttcactcttgttgcccaggttggagtgcaattgcgtaatctcacctcatggcgacctccacctcccggtttcaagcgattctcctgcctcagcctcctgagtagctgggattacaggtgcctgccaccacgcccagctaatttttgtatttttagtacagccttggtttcaccatgttggccaggctggtcacgagctcctgacctcaggtgatccacccgtctcagcctcccaaagttctgggattacaggcatgagccactgcacccagccctcttcaatgtctttcatcgatgttttatagtttttgttgtagagatctttcacttctttggttaattcctaggtattttatttgtggctactgtaagtagaaatactttcttgatttctttttctgattgttcgctgttagcatatagaaatgctactgatttttgtatcatgcaactttactgaatttatcagtcctaattggtttttggtaaaataaagattatatcaaatataacattatatcattgatttttccaaatataagatcaaatcatctgcaaacaaggataatgtgacatcttcctctccaatttggatgcccttcctccctccctccctccctccctcacttacttccttccttccttccttccttcctccttcttccccccttcatctgattgctctagctaggacttccattgctgtgttgaataacagtggtaaaagtgggcatccttatcatgttccagatgttagaggaaaggctttcagttttttccccatttagtatgggggtctattatatatgaattttattatgttgaagtatgtttttctatacccagttttttgagggcttttatcatgaaaggatgttgaattttatcaaatgctttttcagcatcaattgaaatgatcatatgctttttgtccttcattctgttgatatgatgtatatattagggttctttagagggacaggactaatagaatagatgtatatatgaaagagagattttttgtttttttggttttttttgagacggagtcttgctctgtcgcccaggctggagtgcagtggcacgatctcggctcactgcaacctccacctcccgggttcaagcaattctcctgcttcagcctcccgagtagctgggattacaggcgcgtgccaccacacccggctggctaatttttgtagttttagtagagacggrgtttcaccatgctggtcaggctggtcttgaactcttggcctcccaaagtactgggattacaggtgtgagccactgcgcacagccgagagggagtttattaaggagtattgactcacacgatcacaagatgaagtcctacgataggctgtctgcaagatgaggagcaaggaggccagtccgagtcccaaaacctcaaaagtagggaagccggcagtacagccttcagtctatggccaaacacctgagaatccctggcaaaccactggtccaagaatccaaaagctgtagaacttggagttcaatgtttgagggcaggaagcacaggagtaagataaaggcctgaagactgatccagtctagtccttccacattcctctgcctccttttatcctagccatgctggcagctgattagatggtacctacccagatagagggtaggtctgcctcttccattccactgtctcaaatgttcatctcgtttggcatcaccttcacagacacacccaggaacaatactttgcatccttcaatccaatcaagttgacactcagtgttaaccatcacagtgtattacattgatttgtgtatgttgaactattcttgcatccctgggataaatcttacttggtcatgatgatcttcttaatgtgttgttgaatttggtttgcaagtattttgttgaggaaagaattattcctgtaagagaagctttgcaattccagtatgttacccaaatagttgggtaacatttttctaaacatatagaccgaacattattccttctgtatagactgttaccatattgcaactctgaaagaaatgaatgtaagtacagtattggttctcaatagctgttaatcccgataattaggtaaaagactgacaaggagcattatggtggatagaatcagactgatataatccaagccctatgatgggtcttaatatcttaaaaagagacacaaccagaacctatttacatcctgatgggatgtaacaggaaatagacaatactgcctgtgaatattcttgtcaaaaaaaacccaaaaaaccctgaaatctaaccaggcatttaccatttacctctgactagtttataggatatttgtgtgataaagaagcatgttaaaggacaccttggagatggagtcaacaaaacccagaatgttacaaaacagatgacccactttcatcaacaaatacatggcaaggagaaaaaggaggaggaactgttaaagattaaaagaaacattartcaaatataatgtatggattatggatgctgatttttgaaagctcactgtaaaagaacattgactatttgatgttagaaggagtgattgttaaattttaaaatattgtgacaaatttttgaagtccttatattttagagatacatactaaagtatttacagatgaaatgatataatttctgagatttgctttaaaataaaccagccggggaatggagggtggaatatagatgatgtcccattagttggtggatgtcaaaatgggcaatagtgatgagattcattgttatttctacttttgtgtatgtttgaaataataaaagttttctaaaccaaaataattacaccaacaacagtaaaaagacattatactaacagaacaaagtatttctgatcttaaaaatcacagagaaactcaggccacactgggataataggtacctgtttgttttgggagttctcatatacctctgccaatattactttagacactaagagtgataattttgttatgtattttcctcagagttccacaaacatgtggagtttgatttccttattaagggccagtttctgcgaatgcccttggacaaacacatggaaatggagaacrtctcatcagtaagttcaaattcttatcttctgtatttcacttgaggcattatcggctattgtaggtaaactccttttagaatcacactgaatctatctttagtagcaaagattctttttaatatattggctatatatgttgtgtgtgttatgtattgtgtgtatattttatgtgtgtattgaatatatatakwgtgtgtrtatatatatatgtatattcctgtatattcaattttgaagccctctktttttgtgagagtgttttattcaagaaataaatgaacacattctttatatttgtggaagaactggcaagaaagggaatagcaaatatgtgtgtacaaatactggtgcacaaaataactgggcaaatataaaaactatgggttaagttactgttatttttcccttttattttcaaagtttccttatattgcttttatgattaaaaatataacttataattgttgcttgttttgtgattttaaaaattgtggtaaaatatacataacataaaatttagaattttaaccatttttaagtatacaattcagtggcattaagtgcctttgcagtattatgcaaccatcaccattttccagaattgtttccttatcctaaacagaagacctgtacccattaaacaatgtgctttttttcttaattttaatgttttcttttatcttcttttttttttttttttctgagacagagtctccatctgttgcccaggctggagtgcaatggcacagtcttggctcactgaaacctctacctcctgggtacaaatgattcttgcgcctcagcctccaaagtagtgggattgcaggcatctgccaccacgcctggctaatttttgtatcttcagtagagacagagtttcaccatgttggccaggcacatcttgaactcctgatcttaggtgatccacccgtctcggcctcccaaagtgctggggttatgggtgtgagccactgcacctggcctaaggctttcttatattcctttcccccccatttgcagcataagttgtacaaggcgattaatatttcttctttttaaaatttttgttaggagacagggtcttgctttgttgcctgggctggacttgaactcctaggctgaagcagtcctcctgccccagctttcctaatgttaatagctgggactacaggtgtgagtcaccatgccaagctattatttcctaatatcactcttagcttacagttaggtcaaataaagttcttgactttttgaatggctccaaatttgctgagttataaaggggactaatatgaaggatataaaggagatatattaaattgggggttatcttcataatgtaatattttaaaactagaccacctgacttgttgctggtttctcttgtgattaggaagaagttgtggaaatagaatacgtggagaagtatactgcaccccagccagagcaatgcatgttccatgatgactggatcagttcaattaaaggggcagaggaatggtattgccagattaatgcccttctcttttttttgttttgtttttacctccttcagtctttttaaatccatatatacatatttttctgtgatttaatgttatttgtaaattaattttgtgatctctgtatcagtggccatggcaaacagaaagatcttttcattcagtgtcttcaagaagaaacaggtggctgggtgcagtggctcatgcctgtaatcccagcactttgggaggccgaggagggtggattacgaggttgggagatcgagaccatcctggctaacatggtgaaaccctgtctctactaaaaaagtacaaaaaattagccgggcgtggtggtgggcgcctgtagtccccgctacttgggaggctgaggcaggagaatggcgtgaacctgggaggtggagcttgcagtgagctgagatggccccactgcactcaagcctgggcaacagaatgagactctgtctcaaaaaaaaaaaaaaaaaaaaaaaaaaaaccacaggtatttattaataggtactctttttctgttctgttcaatatgtggtagtaacaattattgttgcctttttttttttttttttaaacggggtctctctctcttgcccaggctggtcgcaaactcctgggctcaagcagtcctcctgcctcagcctcctgaataggtgggatttctctacacccagcaatatttgtcttctgaataagtcatgtatcttagagcatttaatttatttggttcgattatgttgcttttaagaccaaggatatagtttgtttcataaaggaaaaaagtaacttttatagccatagatctcctggcctaataccttaaagatgcatagcatactattttagggctagaaggagcagactggactcagcaaagaaggtacagatatcttagggcaaatcctcactggccttacttgtaggaaaacaactcaagagtagattatggtaggagcttctttcaaagaatgccttcttggagttattacataaagttatatttctcctagttttacttttagtttaaatggttttcactggttaagtacaaaatacttcaggtggacagccaggcgcgtggctcacgcctgtaatcacagcactttgggagcctaaggcaggtggatcacttgagatcagaagtttgagaccagcctggccaaaatattgaaacctgtctctaccaaaaatataaaaaattagccaggtatggcggtctgtgcccatagtcccagttactcgggaggctgaggcaggagaatcacttgaacccaggaggcagaggttgcagtgagctgagatcgcgccactgccttccagcctgggcaacagagcaagactccatctcaaaaagaaaaaagagtactacaggttgggtattccttatctggaaatgtttggtaccagaagtattttggatgtaggattttttttgggtgggggtggttttggaatattaacatatacatagtgaaatattttagggatgtgatccaagtctaaacatgaaattcatttatgtttcatatacagcttatacacctagcctgaaagtaattttatactatgtatatatatgatatatattttttatatatatatatatatttttttttttttttttttttgaaacggagtctcgctctgtcacccaggctggtgtgcagtggcgcaatctcggctcactgcaagctctgcctcctgggttcacgccattctcctgccccagcctcctgagtagctgagactacaggcacccgccaccatgcctggctaattttttgtatttttagtagagacagggtttcactgtgttagccagaatggtctcgatctcctgacctcgtgatccgcctgcctcagcctcccaaagtgctgggattacaggcgtgagccaccacgcccagccatgccaggtattatttttaggaggttgagaaacgtcaagtgatctgatctagtatggcttgaaatctcaatcttcatatcaaaaaagagtttaaaagtataatcctcaaagttactttgtcattgccaaagaaacatttcagggtttggaaaaactgctttttgtgtttcataagatttttttttctcataggatcttgactggttcttatgataagacttctcggatctggtccttggaaggaaagtcaataatgacaattgtgggacatacggatgttgtaaaagatgtggcctgggtgaaaaaaggttaggacagtttgcctacacttagaggaatcctagatagggatttggaaataagccatttttggtgctggggaagaatggggagtgggtgggaagtatctcatacctcagttattatgaggtctttcaaaaaatacagtgttcaagaagaaaaagattatataaaaaattcataaattgttagaagtgtatctttattaaaattacatcagataatatacattttcaagttaatattgaatgtattacattcatcttttattttcttctgtttttgtttgtttgttttgttttgttttgttttgttttgtttttgagatagtctcgctgtgtcacccaggctagcgtgcagtggcatgatctcggctcactgcaacatccacttcccaggttcaagcgattctcctgcctcagcctctcgagtagctgggactacaggcacctaccaycacgcctggctaatttttgtatttttagtagagacggggtttcaccatcttggccaggctgatctcgaactcctgacatcatgatccacccgccttgscctcccaaagtgctgggattacaggcgtgagccactgcacccagcctgtttgtttgttttttgaggcagagtctcactctgtcgcccaggctagagtgtagtggctccatctcaactcactgcaacttccacctcctgagttcaagtgattctcctgcctcagcctcctgagtggctgcaattacaggcgcctgccaccacacccggctaatttttatatttttagtagaggcagggttttgccatgttggccaggctggtctcaaactcctgacctcaagtgatctgcctgtgttggcctcccaaaatgtcagtatttacaggcgtgagccaccacacccagtcatcgtcatctatttttgaagaatcttttctttataccacatcagccttttaaaacctggccatatgagttatctttttaacatctttttcaataacaacaaaaaaatttagttctttggtttcagaacatgatgtattctaaatggtatactgatttgtttcttattcttgtgttctcctttctccagatagtttgtcctgcttattattgagtgcttctatggatcagactattctcttatgggagtggaatgtagagmgaaacaaagtgaaagccctacactgctgtagaggtcatgctggaagtgtagattctatagctgttgatggctcaggaactaaagtaagtagctagaatattattagtactctgttaaatttgaatttgagcttgttgctaaacattttcttctgcatatattcattgtgttggcctagtttcctaacaatcggtgacaaaagataggatttcaaagcaagagtaaatactcatacaataggagatagtcacttgctcagtttgaatccctggtttagaaccttatataaactccagaaattttaagaaatgaggtatgggccgggcgcggtggctcacgcctgtaatcccagcactttgggaggccgaggcgggcagatcacctgaggtcaggagttcaagaccagcctgacccacatggagaaaccctgtctctactaaaaaaaaaaaaaaaaaaaataagccgggcatggtggcgcatgcctgtaatcccagctactcgggaggctgaggtaggagaatcacttgaacccgggagacagaggttgcagtgaccgagattgcaccgttgcactccagcctgggcccaacaagagtgaaactcagtctcaaaaaaaaaaaaaaaaaaaaagaaagaaatgaagtaaacaagccattcatttatataaccttcttacctcatagtaattgacatatttccagtctatatcagctactcttaagtgctgtcatcaactgaaaacgcctagttgatagtctgagcattagcatacactaaagttagtgctaatagagttttactatagtatcaatctactctttatcatgacaaaatggtaaaagttagttaaaaggtaacaaacctgagggcaataccatattgatttattaatatgaagggttataaatccacttagaatttgaaagtttcctaagccacattgaagtattctggacttaagagtgtttctttgacagttagggtaacaggatgcttgtattcaaaggtgaagatttatgatttttcatattgagccgaaaagttttatatgttgtttagtccaaactttagtggattaactgtacctcttctttttggttaaggagagatagaaactcaacttgaacttatttaaccttaaaagtaaatggattgtgagatccaaggaaagattgaacaaccacatcacaagaagggtaatggtgcatttgggcctcaggaaccagtggaatagaggcttgaatgtggtccgcacaccctctcgctgtcttgtccctcaagttgactttattctctctcacttcagattggctttcttcaaaagacatggcaataagcttggccttcaagatttcccagattttatgttctgtcctatctgcccctggaaaaaggctaatttcagttctgtggaacacaagttctttgaaaaggtcctgaatgaggaagagacctactgttgtaggcaaataatatgaatcatattacatatgtcttttcccttcatatacatctgtttagttttgcagtggctcctgggataagatgctaaagatctggtctacaggtaaattaaatatttattttaccttgacttaataatgttgtttcaaaaatttaaattcggaggctatatggtggcttacgcctataatctcagcacttcaggaagccagggtagaaggatcacttgaggccacgagttcaagagcagcctaggccacatagtgagaccccgtctctactaaaagtagaaaattaaaattagcaaggtgtggtggtatgcaccggtagtcctagctccttgggaggctgaggtaaggggattgtttgagcctaggagtttgaggtttcagtgagctatgataccatgccactgcacttcagccagggtgatggagtgagaacctgtctcaaaaaaaaaaaatcagtttagtgaaaggggactttttaacccatattttgccataaaaagagaccagtatggcaacaaattcatatatttctttgtgtttcaagattttttttttcctaccccaccacccccttacttacaggatagtgtcactgaattgcaagtatcaaaaacatgtttggtgcaataggacataaataccttgattctcaaagttctcttattcaggaaacttggaagtaaataaaaatactttccgagccattttgacttaagtaatgtaagaatgacttttgagtcattttactgttaatttcttaggtaagctggtttacttaaaaaaatttttcaatgcagttttaccaatattaatatttttactctgaaagcatagattaaaaggagcaaattgagggaggaggaggaaggactttgagaggaaggtgctttcatagtagtaagaagacactgatgagaagaaaagaggaaaaaacacacacccatagatacttacattttaagacctagtagctacaactatttattgcataggtaaacaaatcagaatacctctgttactttttaggtaattgctgtgttacacagtataataccccaaatgcatttcacaaagacttgagggggatcaagaaaagcttaaccagttttgaataattatgtgtaagatggtgggaaatatataatccgttttagtagattttacaaaaatgatgaaagcaaataatttggtggcaaaaagtgatttagtttagaaaattctttagtagaattttttattttttgatagggctgagtaaatgagattgtatatgattagctattaactttaagtggtttataatctagtttgagaaatattaatatccataaaagccacaaaacgttttaatgttttacatattttgttacatatttaatgtaacataatatgcatgttactatatataacatataatgtaacatacattacatatttaatgttgcatattttatgtagttttcaatctgggtttgctgcttaaccaagtgatgtataacaaagattttaaaaactcaaaaaaaccagaaacatttttggtagaaaaatgaaattaagagaataaacatggctgaaatgtatgtgcgtttatcatgtgtttactttatccttccctccttcataatgtaaatgtaatgtcataactctcctacaactaacagtaagcaatttttcatagctatgataaaatgataaatatttataatgatgaccttaaagatagcaagattttaaattacttagattttagttttctaatatagtttatgttttattttttatttttagagattggtaatctaggtaatattttatatataactttctgttaaccaaaatgatgaggaatattcattccctaactgtgtgataacgtggaaaaactatatctggaaatgtaaagaattctttcagacagttcacgattaatactgtttttaaaatgtcaaatctaattctctatgacacagtccctacagatgaagaagatgaaatggaggagtccacaaatcgaccaagaaagaaacagaagacagaacagttgggactaacaagggtcagtatttgtgagaactgactgtacttgccttaggcctgtgttgacaaatagatggtaatttaatatggtcttttttgtttatgttgccttctgtcttaccttgctgctttaaccatgattatcctttttttcagtagacttgtaaatttttattataagcaaagtattgttgctacatttatttgtatctttgaatgtagtggcattgagccaggcttatggttgctaggttgatgatttagttattatgtttgatctcatgttgcattctggaccttttaattattaaaacttacactaaagtgaagcatctaattacctggctgttggataatattatctgtttcatgcactgagtatgtaatttttataagggatcctagttatatcttctaaatcactagaaaccaagagtttaatttgggatttgattctgtcatttagctgttagattccattaagtcaaactcagaaagtttatccagattttttcttacttttaaaaatacttaattgataaagattgaacatattcaacgtgtactacatgattagatacacataaacattgtgtaatgattactgcaatcaaattaattaacacatccatcaccacccatgctgtacattagatccccagaacttgttcatcttataaccgaaagtttgtgcccttggaccaacatttccccatttcctcacactccagttcccggcaaccactgttgtactctgtgcttccatgagtttgacttttcatgcagattattatttatcctgttacaaagatatttgttataatgtgacctgacctgtatttatatactttttgtgaagggcaatactgagtcaggtttagaaaaacacttttcattcattttctaatagctataatgaatgtgcagtaaataaagcacacatttgcacattaattcttatagtcaccaataaaatatcttgtaaaaattgttgaaaatgaataaaatgggatcataaattatttatcaaatagaatgtaatattagcgcttactggttccagctgaaagtaatgatttataatttcttaatacatttaaacatagactgatgaattgcaagaggaaagatctggcacttactcaacttctttactctggtaggctaaattaaagctagaaatggaggccaactgtggtggctcaggcctataatcccagcactttgggaggccaaggcgggcagattgcttgagctcaggagtttgagagcagcctgggcaacatggtgataccctgtctctacaaaaaattttttaaaagttagctggatgtggtggcttgcacctgtggtcccagctacgcccagcccaggaggcagaggttgcagtgagccaagattgcaccactggactctagcctgagcaacagagtgagaccctgtctcaaaaaataaaataaaaaataaagctagaaatgccttaccatttggatattgtgccagtgggagtttatattcatgcatgtccctggtcaaacttttaaagaacatatctgagtaggaaaagatttcctgagttataaaaatgttttactgagaaggtagctcttttattctctttttttttttttttttttttaaagagacaaagtcttgctctgttgcccaggctggagtgcagtggcacaatcatagctcactataacctcaaactcctggcctcaggtgatcctcccacctccacctcccaaagttctgggattacaggcttgagccaccatgctctgccaattttttctctttttaaagtttggcatgtagcttaaatgttgctcaatgaaaaaaaaaattttttttttttttttgagacggagtctcgctctgtcacccaggctggagtgcagtggcgtgatctcggctcactgcaagctccgccccccgggttcacgccattctcctgcctcagcctcctgagtagctgggattataggcacccgccaccatgcctggctaattttttgtattttttttgtagagacggggtttcaccctgttagccaggatggtctcgatctcctgacctcgtgatccacccgcctcggcctcccaaagtgctgggattacaggcgtgagccaccacacccggcctgctcaatgaatttttataaatatgtatactcaagtaattactacccaaataaaaatatagatataccagtaccctagatgtctgcctctagcctgcctctcaaccagtagctccctaaaggtaatcacttttgagttgtgccatcttagattagttttacctatttttaaaatttcatatgatatctgtaagatagatcttttcattaatatatggcattccattgcagcatcaatatgccacaatttatccattattgagatagggtctcactctgtcacccaggctggagtacagtggcctgatcatggctcactgcagcctcagcctccccagactgaggtgatcttcccaccccagcctcctgagtagctaggactataggtgcatgccaccatacccaactaatttttctttttttttgtagatattgggttttgtcatgtcacccaggttggtcttgaactcctgggctcaagtgatctgcttgcctcagcctccgaaagcctctcaaagtggtgggattacagacttgagccaatacgctcaggctatttattattcttttgatggacgtttctttccccccttttgagaggagtggtgcagtggcataatcatggctcagctgcagcctcaacctccagggctcacaaaatcctcacgcctcagcctcttgagtagctggaactacaggtgcatgccaccatgccctggctaattttttttttttttwaagagatggggtcttgttatattgcccaggctggtcttgaactcctgacctcaagcagtcctcccacctcggccttccaaagtgctgggattacgggcgtgagctaccatgcctggctgttactccacatctttaccagcacttgatatggttacttattaaagtcatgattaacttttaataagccctggatctttgataattatgaaatgttcatatttttagctaatttttaagttgttgttattcatttttttatagagatggtgtcttgctttgttgcccgagctgtctcaaactcctgggctgaagcagtcctcccacctcatagcccattttttaaaagtgttggctctattttacttattgatttttttgttgttgttgttttgctttgtttttacttactgatttgtaagagttatttatgtattctggattcaagttctttgctgaatatatgtatttaagtattttctcccactctactttgctgataccatttatttctaggtgcatactttcgtaagcttgctcccatagttcatttcgtttgagagaaataatagtatattgagtttctcatttagcttttttcctcctttcactgatttttcctgagaaatcatttagctttttatagggtttaaatttatacatgcataaattattagtttaagtcatgccagaaacctttgaagtgccaattacaatgaaaatgttgctgcgttagaaataatagaaaaatttggggcccgagaaggtggctaacacctgtactttgaagccaacactggaggatcacttgagcctaggagtttgagaccagcctgggcaacatagcaagaccccatctctaaaaatttaaaaattagccaggcatggtagtgtgcatctgtattcccagctacttgagaggttgaagtgggaggatcacttgagcccaggaagtcaaggctgctgtgagttacgattgcaccactgcactccagtttgggcgacagagtgaggccttgtctcaaaaaaagcaaagaaaaatttggattttagcaaaataatagaaaaaagagaaaaaacatatcaaaaataggtatcttctctttgcatttctttctactgcctgaaatgtgttaatgtgaataatgctgccagttcatttacctgtcatttgcttgatatattaacatacaatagtcttttcctccttaattctcaaaattgcttttttccctccagtacttctgttccacttagtttgtagtgacaatgtcaatgttgacttttctacttttaaagaaaagttttattagaggaaaattcactttttggtgtataactatttagttttgatgaatatatagaatcatgtaactgctacacaaccaagatatagaacagtccatcattcctgaaaactcatattgccccttcttgtcaactttcctcccacctctatcctctgaaaaccactactctgttctctgtccctgtaatttttccagaatgtcatataagtgcagtcacacagtatagtgtatatagctttttgtatcgggcccttttcacttagcataaagcatttgacattttttgaggttgttgggggttattgatgctgagtagtattctgtggtatggatatgccacagttggtttaatcattcaccagctgaaggatatttgattgtttccagtttggcagttataagtaaaactatcaacatttgtatttaggtttttgtgtgaacctgttttcatttatcttggataaatgcctaggaatggtatagcttattcatatgataagtttgcctattgtttttaccatgtcattttctttttttttttttttttttgagacggagtctcgctctgtcgcccaggtcggactgcggactgcagtggcgcaatctcggctcactgcaagctccgcttcccgggttcacgccattctcctgcctcagcctcccgagtagctgggactaccagcgcccgccaccgcgcccggctaattttttgtatttttagtagagacggggtttcaccttgttagccaggatggtctcgatctcctgacctcatgatccacccgcctcagcctcccaaagtgctgggattacaggcgtgagccaccgcgcccggcctaccatgtcattttctattctagagccttctgattacctctatgtcaccttttcattttgttttagatgacatcagagattgttctgtttctcactcctctatcaggttcctttacttctttcaggaaaatgctaagagacctcagggatcatttggtctaggagttggcaaattacagcccaacagccagtttggctgtcacctatttttgtgctacagagagctaaggatggtttttacaattataagtgttgtaaaaacaaccccttattaaaacaactgtgggccaagtgcagtggggcacctgtaaccccagcactctgggaggctgaggcgggcacatcacctgcagtcaggagtgaagaccagcctgaccaacatggtgaaaccccgtctgtactaaaaatgcgaaaagttagccaggcgtggtggcacgtgcctgtaatcccagctacttgggaggctgaggcaggagagtcgcttgaacctgggaggtggaagttgcagtaagccaagcttgtgcattgcactctagcctgggcgatgagtgaagctccatctcaaaaaaacaaaaaacaaaactgtggtattattcatacagcagaatattactcagcaaagaaaaatatacaacagaaactgtgtatggtctccaaaggctgaaatatttacttgctggttctttactgaaaaagtttgctttctgatccagttataactcctaaatattacagatgaggcaatatttaaggaagttaaatgtagcaaagttatataaaagtagattgactatcccctattccagaattcttttcctcttttttttttttttttttttgagatggagtttcactcttgttgcccaggctggagtgcagtggcgcaatctcggctcactgcaacctttgcttcctgggttcaagcgattctcctgcctcagcctcctgagtagctgggatgacaggcatgcaccaccacgcctggctaattttgtagttttagtagagacggggcttctccatgttggtcaggctggtcttgaactcctgacctcaggtgatcacccacctcggcctcccaaagttctgggattacgggtgtgagccaccgcacccagctagtttttttgtttgtttgtttgtttttaagagacagactctcactgtgttgcccagggtagagtgcagtggcacaatctcagctaatggcaacctccacgtcccaggttcaagcaatcctcccatgtaagcctctcaggtagctgagactacaggagtgtgctaccacagccagttcatttctatatttttttgtagagacagggtttcagcatgttgcccaggctggtcttgaactcctgagctcaagtgatccacccacctcggcctcccaaagtgctaggattataggtgttagccaccgtgtgtggcctcctctctttttttttttttttagagacaagatctctcttgttcacacaaaaacctaaattacaattataaagtgttgtaaaaaacaaccccttattaaaacaactgtgggccgagtgcagtggcccactgcaggagtgggcctggctggagtgcagtggcgtgatsgtagctcactgtagcctcaaactgctgggctcaagtgatccttctacttcagcctcccaaatagatatgactatagtcatgtgtcattaagcccagctaattttatttttagtagagacggggtcttactatgttgcctaggctgttctcaaacccctgggctccagtgatcctcctgcttcagcctcccaaagcgttgagactacaggtatgagcctctgtgcctggctcttcccactctcttttatatactccttatatttaaggtaggtactctacctagttacctagtttggggcttttagtttagaaagacattagagattgtggagtattaataagtgaactgtgtacattatttaaagattaaataataggacttaaagatactgaggaatgaggtggtaagaataacttactgagattaatttacctggaggagttgtgtagaaattggcggcatattttgtgtgaaggtgctgaaacctatatctgtctgatcacaaaggtttttgtgttaactgtgaagcagtttcactaataaccagtctaagggaggattcccactggttggaggatagtaaaggtcatcgtatgccaggcaccaggaatagaagtgtgaatactttcacccaccgcatcctgggctgcagttttaccagttgcctgaatctggtgaggaagagcacacacgcaacacgttacatgaaacgggtttattacttacagataggcagcaagggacaacagaagccgaggatccattgtgagccagtcccccaaggctcaagaaagctgccaggggcaaatggagtgttaactgcatatgcctcacttgcagtacagctgagggatcccaaaaaacagcctgccctggtttttgtaccctggggtcacttgactctgggcaaagtttgaaggacatcctgtttctaagagctggaatagagcccccaggctatgctggccagttgctccctatctcaggatgttatattcccagaatattctatagttattttgagaactacaggcaagaagaaaagagggggggagaaactgtatccatcagtccaaggccattgggaaaccatccagcactaatctttaatataacatttgtcagctgggagagttaagtttgtgttaatgctgatcaaaatgaaaagtagaacagatgaggagcagcagaatatagtggaaagactacagacgagtaatatttggggtcaaattcaagtctgccacttataagctctatgaccttgggcaagttatctttatcagcctcagtgtcttgtataaaataaaaacagaaatatccattccattgtaaagaaagaagaaataagtcaggatatgaaagatgggcagtttgtctctgtcatgtgggctttgtaagtaataagtactattattgtttcaattattctgtaatgaaaacactttccycttttggggttcttcctttctagactcccatagtgaccctctctggccacatggaggcagtttcctcagttctgtggtcagatgctgaagaaatctgcagtgcatcttgggaccatacaattagagtgtgggatgttgagtctggcagtcttaagtcaactttggtaagacaaattcagtgttcttttaagtgataaacttctagagatggtttttagtctaccatggttaatgttctttccttttctttttcagacaggaaataaagtgtttaattgtatttcctattctccactttgtaaacgtttagcatctggaagcacagataggcatatcagactgtgggatccccgaactaaaggtgagtcatgtaaaccactgggggaatatatgtgtgaataacatctatttctcatctctctggagatgtacaaaaaaaggaatttctggccaggcgtggtggctcatgcctgtaatcccagcactttgagaggcygaggcgggcrgatcatgaggtcaggagttggagatcagcctggccaacatagagaaaccctgcctttactaaaaatacaaaaatcagctgggtgtggtggcgcgtgcctgtaatcccagctactcaggaggctgaggcaggagaatcacttgaatcccagaggcagaggttgcagtgagccaagattgcacyactgcactccagcctggtgacagagcaagactccatctcaaaaaaaaaatttctacaaatattttttgggttccttctacctacttcccttttctaaaattcaacgcttgtcttttttgctttgttcagatggttctttggtgtcgctgtccctaacgtcacatactggttgggtgacatcagtaaaatggtctcctacccatgaacagcagctgatttcaggatctttagataacattgttaagctgtgggatacaagaaggtaaattctatttatgatctataagagaaacatatcaattacctgttatagaaaggaaatgaatactgaaattcttatctaaaaccagaagagtaaaaaaagcctcatggttttgcaacctcatgtgacaaatactgatatgcaaaagaaaagccaggatcaaaaaaatttttggccaggcacagtggctcacacctgtaatcccagcactttggaaggctgaggcaggcagatcacctgaggctgggtgttcaggaccatcctggccaacatggtgaaactctgtctctaataaaaatacaaaaattagccgggcatgatggcgcactcctgtaatcccaactacacaggaggctgaggcaggagaatcgctcgaacccaggaggcggaggttgcagtgagccgagattgcatcagtgcactccagcctgggcaacagaccaagactccatctcaaaaagaaaaagaaattcatgttaatatgttgttttgttgcatatagatagctagacaaacagtatataaggccatagtttgggggttaaagtagtcaaggaagtgtgaaaatgggcctaattataaataaattcttaaaatgaaataacatttttttctgaatatatttgttataataaatgtctgtggtctaccaatgatacaggaaaaagaggagagatgatcaaataaacagaattttaagattaagtggttattggggcaaggttggtaaaccctgtaaagttttcagataagtataagtgattattcaaatgtttgttttaacactgtgaatgcatataatatgttaatattttcatcttttagttgtaaggctcctctctatgatctggctgctcatgaagacaaagttctgagtgtagactggacagacacaggggtaagaatttattagttatttgatgaagaggaaagtgactagaataaatctggtgtttgtgtttataaaatgtattagtttcgggccgggtgcagtggctcacgcctgtaatcgcagcactttgggaggccaaggtgggcagatcacgaggtcaggagatcgaggccatcctgactaacaaggtggaaccccgtctctactaaaaacacaaaaaattagccgggcatggtggcgggcgcctgtagttccagctacttgggaggctgaagcaggagaatggcgtgatccaaggaggcggagcttgcagtgagctgagatcgagccactgcactccagcctgggagatagactccatctcaagaaaaaaaaaacatttattagtttcaatatatttgatatttataattctgtattatttcacttaatattatttataaaatgtcacctctcattcaaagaagaaacaaatttgtcctttaataggccaggcatggtggcttatgcctgtaatcctaccactttgggagggaaagggggaagattctttgagcccaggagttcaaaaccagcctaggcaacatagtgagatgatgtctctacaaaaattaaaaaattagttatccatggtggtgtgacctacttgagcctacttgagcctgaagcaggaggatcacttgtgcctgggaggtcgaggatgcaatgaactatgatcgcgccactgcactctagcctgggtaacagagtgataccctgtctcaaaataataataatactaggaatagtaaatttgaaattttggagcatttttttttcttgtgagtatagtgggttttttgttgtttttgctgttgttgttttaagaaacaaggtcctttattgcccaggctggaatgttagtggtgcggtcgtgactcactgcagccttgaactcctgggttcaagcaatcctcccgcccccatgtgtatcttctttatttatttttagagattgaggcttgaactcctgggcttaggtgatcctcttgccctagccttctgagtagcagggactacaggtgggtgccaccatatctggcaaatttttaaattttttgtagagacgtggtctcactgtgttccccaaggtagtcttgaactcctggcctcaagcagttctcccgcctcagcctcccagagtgttagaattacaggtgtgagccactgtgcctagcccccacgagtatcttcatgaaacattttacctccaaaaactcactacttaagactaattggatcaaagtgtttaccagttggaaaaatcttgcataagtctgcattataaaatgtgtttaaagaattacaatttaattatttttatgtatatacgtaagctcttactgcctaagaattctttccaaatataaggcctagggctacttgaataatttgtaatatacaattaatgtgttgtcctttaaaaatttttaattttctttaataggtaaaactgtatccctttcaaacttatgtatcttggcagatgctttatagaaagtgcaacagcatattatgtctcaaccaaatttaaatgatagcttttaatgttttaataaactgtatcatagtatagtagtgaaacaacgttggtccctttactcactctcaatgcaagttaactgctcacccataattccttttgtaatgaaaatcattagtatttaattaggtttagctatgatgtgaaataattatatttatttatgttttcttgtctttttctctccttttacacagctacttctgagtggaggagcagacaataaattgtattcctacagatattcacctaccacttcccatgttggggcatgaaagtgaacaataatttgactatagagattatttctgtaaatgaaattggtagagaaccatgaaattacatagatgcagatgcagaaagcagccttttgaagtttatataatgttttcacccttcataacagctaacgtatcactttttcttattttgtatttataataagataggttgtgtttataaaatacaaactgtggcatacattctctatacaaacttgaaattaaactgagttttacatttctctttaaaggtattggtttgaattcagatttgcttttttatttttatttgttttttttttttttgagatggagtcttgctctgttgcctaggctggagtgcagtggcgcaatctcaactcactgcaacctccgcttcctaggttcaatcgattctcctgtctcaacctcccaagtagctgggattacaggcacacatcacgatgtcctgctaatttttgtatttttagtagagacggggttttgccatgttggccaggctggtcttgaactcctgacctcaggtgatctgcccacctcagcctcccaaagtgagccactgtgcctggccgaattaagatttgtttttgaaatgctgtaaaaggttatattggaaatccagtaattgattgttgagatttttatttctgttagagacttagatttttttaagttagctattttaaaaaagcattcaaaaagattaatgaaaattgtaatagagaaaaagttagaaattcagttccttttggcagaataaatgttcaagaaaattaggctgtgagggtactcagaacattaaaaaaaatgtaggctgggcatggtggctcacacctgtaatcccagcacattgggaggccgaggcaggtggatcacctgaggtcaggagtttgagaccaccctggccaacatgtcaaaaccctgtctctgctaaaactacaaaaattagctgggcatggtggcgaccgcctgtaatcccaactacttgggaggctaaggcaggagaattgcttgaacccgggaggcaggggttgtagtgagctgagattgtgccactgcactccagcctgggtgacagtgcaagactctgtctcaacaacaacgataacaaaatattgattcggcagggcacggtggctcatgcttgtaatcccagcattttgggtggccaaggcaggcggctcacctgaggtcaggggttcgagaccagcctgaccaacatggtgaaactttgtctctactaaaaaaaaaaaaatccaaaacaaattagccgggtgtggtggcacactcctgtggtcccaagtacttgggaggctgaggcaggagaattggttgaacccaggaggtggaggttgcagtgagctgagatcataccactgtgctccagcctgggcagcagagccagactctatctcaaaataaagacaagtagattgccaatttttgaagaattcatcaagatattttaaggaaggcactttatattaaatatatgtcagatcctttagaaattgcatacagttggttgggcacggtggctcacgcctgtaatcccagcactttgggaggctgaggcgggcggattgcctgagctcaggagttcgaaaccagcctgggcaacacagtgaaacctcgtctctaataaaatacaaaaaattagctgggcgtggcagcatgtgcctgtagtcccagctactccggaggctgaggcaggcaaattgcttgaacccgagaggcagaggttgcagtgagctgagattgtgccactgcatttcagcctgggcaacagagcaagactctgtctcaaaaaaaaataaaaaattgcattgcatacagttttcactgtaaccctaatctttcctcatgtgtagataagaataaattttttagacaaaacctttcatcagtattaaacattctacagattttatgatatcattagcatttatctttatgcatgtgttatataaaaatatttaaagtaaatgtattttttaaatgttatttccattattaatggattgatactccttaagtagagcattcacaaccttttagtaatatttgggaaatatgtttggtctcattattagatggtattacatctcaaatgatgttcctgttgcagaagtctgcgaaacaatatctaaacttggctgcagttgagagctaaacagtgtattgaaccagttaggagtttagttctctgtagaaaaccagaggcagtccagggctgatgtaggttttgttccacattctttaggatcctaggctccctccatccctggtatgtggtcctcattttcatatagaccaagagctagagctccagttaccatttcttaaagtatattttaatgccaaatagtgaataaaggtggccagaaaattcatgcacagaatccttctttttctcattttgtgctgattggtataaattttattgtatttgtagtctctggaaatcttctaactttgagaggacaaagatgaattcctagtcctgttttggatggtcttcaaatgatccttaagggcagttatttaaaatgtctttcttaactcacccaacctaggctgaccgaatgtagtctgtataaactagatggttaaagataaagaagcctatatatcagatgcatagacaaagaataaaatggcatccagaactggtccccacctattcccaatcctggttccacagcagaatacattcatagttcaggcattcttccttgagatagatataatgtaagtgaccaagtctcttggacaagtattgtctctgatcaatccctgccaaactcctttccttggttaactcaagtggttagatcttactccctgaacagaaggaatatgagaggtcaatacatgcctagactattcagtcctctgatattgctccacaccctttccctcaaaagccatgagacctttcaatggtcccagttcctctaccagaacaccagagatgcctgctttacatggacttatatattcccaagaatcacttggataaatgagtggtgctgctttcccgtggttggggaaaagctaggaacctgacaatgcagtgctcagaacctgctgaccggtactagttatgctgtcttgccatagtagtgcagttctttaaaatgttgatacttgctctcttatcaaaggttggtttttttgtttttttgtcaagacagggtctcactatgtcacccatactggagtacaatggtgtaatcttggcttactgcaacctccaccttctgggctcaagctggcctctcacctcagccttccaagtagctgggaccacacccagtcaattttttattttttattttttaatttatttttattattactttttttgtagagagagggtttcgccatgtagcccatgctggtcttgaactcctgggctcaagctgtctgcccacctggacctcccaaagtgctgagattacaggcatgagccaccgcacccagcccaaataaagttttaagaaattacttggccaggcatagtggggcctttgtagaaaaacatagcttttctatgagaagatgatcaatattttcttttcctttgaatttggaattaccattttggaactgttgtcaacaatgcataataatatatcagaatgcttcctagtatattattggagaaagaacaaacaaaagtttaaattgatataaaatgcatataatggaacaagcaaccctgcaaaaaaaaaaaatatatatatatataccatctgggaatttctgataataacattgaaatctgttcacacagtctaaaattcttttgatgtatcgtagttttgaaaaaaaggtaacagtttactatatataacaaatataaggaaaatattaaattttttgaaagatactagtttttatttttgttcattttttagagacagggtctcactatgttgcccaagctagagtgcagcggcccgattatagctcactgcagcctctaactcccggactcaagggatcctcccacctcatcctcctaactaggaccacaggcgcatgtcaccacatctggctgattttaaaatttttttgtggagacagtcttgctgtgttgcccaggctggttatgaactcttggcctcaggcagtcctcatgcctcagcctccctaagtgctcggattataggcatgccactgtgcctggccaaaaatacagattttttaatagatattactatggctcctattcttaaaggaaaaaatatgacattttaagactatatgcaagggatattccaataatatcttttttatttaaaaagccactaattagaatcagatttcattaggcaagtgaaatccagattttactagccagaaactgccaggtgtagaaacagcaagaacattttagtcacttcattgttgacatttttgactatcatagattaagtatcaaacacaataacagtattttgttatatgaaccaaatatatctctttttacgagacatagtctagctctgccatccaggctcaactcctgggttcaagggatcctcctgccccagcttcctgagtacgtacctgggagtacaattgcatgctgccacacccagctattttttttatttttgtggagatggcgtcttgctatgttgcccaggctggactccaactcctgacctcaagcaatcatctcaccttggcctcaaaagtgctaagattacaggcatgagccactgcatccagcctgaaccaaatatatctttattataacttaggagagaaacgtttttggctggttagttttacagaattaaacctaatggttgttctaatagcagttccaatgatttgcagatttgaggaagtaaattattttcttacagtgtccataaaagtaacaatgaaactatatcctaccataataatcctctataggtaataaattatttgcattttataggagagaaaaatatatgttaaagtttttgaacagtcacacaggcaggaaataaatggcagtgaatttgaacttggacttatcttggacaagctcttaactggtatatattttgtcaatcttatgtcgtgcacaagaatgatgtttttataaatggaaagaatgagtgtggaagtgtcttcacttgcctaacagaaaggttatatgtggctgggcgccgtggctaacgcctgtaatcccaacattttgggaggctgaggtgggcatatcatctgaggtcgggagttcaagaatagcctgaccaacatggagaaaccccgtctctactaaaaatacaaaattagccagtcatagtggcacatgcctgtaatcccagctacttggaaggctgaggcagaagaattgcttgaacccaggaggtggaggttgtggtgagccaagatcgcgccattgcactccatcctgggcaacaagagcgaaactccgtctcaaaaaaaaaaaaaaaaaaagtaatacataaatttaagtgacatttgtgggtactaaattacaataatatgttcagctttgcatttttttgcctttaaaattaatttcaattttagcgtgccactaaacgtattactgtaatagtatataaatgtataaagatcaatttctgtatattctaataggaattgtatataagcaaaaatgaattttagaaattatcctattattcatgtaattatgtcattcatgttatttaaaggaaaccacaatgcagacaggttaagtacctagtgtgaaggtatgtaaccaattaatggagctgtgcgacatacatctgagtaataaagactacagagaaagtatcttgttaggtactatctgatacaaagtttagaaacatgtcaaacaattctatgtatagttggtgaaagtgtaataacatggctgagacttaataccagatgaagttcagtggtttcagggggaggaaataatttttaaaacgatgtcgataacacttcacatttaaaatcatcataataattctaattctagaattgtgtctaattctaatactgtttctagctttgcttgaataaacagaaatgtagtagggaagagacagaatgtttagcttgcagtatctaattactcatttgggtatctgggaagatagctctccatggccccactgtcactgacctataatgcttctcctgacgtcttcggtaaaatccaacagattacaaagaaactggaatgccttgaagaaatagagctttttgtgtgatgtcagattcaatagac

SEQ ID NO: 17605 - DNA, 13070 bp, Homo sapiens
gcataaggaagagtctagattgtgggaaaagggcagcctggaccaccatgtcaaaagctaagtggggtgaagaaagtatcaaagagtggatgtagaccagtgcaatgtatctaagtaagagtgccataaggagggggtctgcttggtgctaaggtctagttcaagttgtcaaagcacatgtaggaggagaaaggtatccacgcagggcaggggtagcaagtactcctgtgaggcttacaagcctaggagcatctgcattaggggttaggataataagaaaataagtaaatatgctgagataacaagccaggtttctcaccgtctaatgtactctgctggacttgtaatgggaggtagcagtaggaactcatggttttcaatattgatagatatggaaattatagaaaggaatatgtgcactatatgtaaatgtacatcattatatacatacatacattctctagctctgtccattgagaggcctaggagcagctatatcccaactgcaaggagcagcatgttcagcacccagaccttggcttctaaataccattctccactaaaatgaactagggggtccttggagaaatggctgactccagaactaaagcagaaaaaggacaagataagcctagaacataatgtgccaaaaagcaaagaagtactcaacgactgacgagatatgtccaagaacataaaacctgcttgaaaaggcttctgttagccaaatcttaaacaaactgagtattaaaataatcacagtaatagattttaacccagcaaatttttaaaaaccctaattccatattgataaataaagtgtgataaggaataactttatagcagcaaagcctggaaggtatcaattgatcaaagtgaaccatcatctgaatgacggcaaataaaactcaggtgctgcctgtcagaatgcaatggcgagaaaacacagcattatttgtacaatattcctgccaaagatgcttaacttaaatatcctaaggaggaaaaaaaatcaggtaaggcctgagggacattctactaaataaatgtaaaatataaattccaaaagtgatgaattaacccagactaacaaaaactgaagaacatgacaattaaattcaacatgtaattttgaactgagtcttttggctaacaaactttaactgctggactttagcagctctctcccagtaactaacagaacatgtagttcagtgagtacataaaagagttaaagaatacaattagtggccgggcgttgtggctcacacctgtaatcccagtactttgggaggtgaaagcaggaggatcgctcgaacccaggagtgtgagactagcctgggcaacatagtgagactctgtctctacaaaaaaattttaaaataagcctggcatggtggtgtgtgcctgtagaccaggtagctcaggagactgagttgtgaggattacttgagctcaggaggtgaaggctacattaagccatgatcacaccactgcacaccagcacgggcaaaaaaaaaaaaaagaaaaaaagaaaaagtgaatacaactaaacaacttgacctaactgacatttataaaataatccaaccaacaatagccagaatacacattcttttcaagtacacatagaacactcaccaaatagatcatatgccaagcactgaaacaagtctcaataaatttaaaagggcagaaatcatacagcatatattttctaaccacacttactagatattaatgatgaaaagatatctggaaaacttcaaaatattcagaaattaagcaaaacacttctaattaactcatgaatcaaaaagaaataaaggaagttagaagtatctttaattgaattaaaatgaaaaaatatatcaaaagctatgctgagaaaaaagtttggagcttcacatgtttaggtcaaaaatgaatatctaaaatcagtcaccaaactttctactttaaaaagctaagataagaagagcaaatgaaaaccaaagtagtagaaagaaataataaaaagtaaaaatgaacaaaagttaaagtgaatagtgaaaatcgataaaaccgaaacttcactatttgaacagacaatgaaaacaagtaaatctctacccagtctaattaagaaaaagaaaaattattataccaatatcaggaatgagaaaaaagaaatcaccattgatccttaaaacaacaaaagaaaatattaatagaactttggtcaattaaacaattaagaaaacacaatttaccaaaacttattcaagaaaaaatgtttagtatgaatagcctacttatgtttttttaaataaaatttgtaatttaaaaccttcccacaggctgaggtgggaggccacttgagcccaggagttcaagacaagtctggacaacatagtgagaccctgtctctacaaaaaaaattttttctaattagcctgatgtgatgacatgtgtgtatagtcccaactacttgggaagctgaggtgggaggatcatttaagcctaagaggttgagattacagtgagctgtgactgtgaccctgcactctgcactccagcctgggcaacagagcaagaccttgtctccaaagaacaacaaaaaacccttcccacaaagaaaactcaactctagattagctttactggtaaagcctatcaaatatgtatgataaaaatatcaatcttacacaaactctttcagaaaacagagaaggaaacacttcctaacccatttacaatgaggccaatatacctaaaaacgacatagctattccaaaaaaaaaaaaaagaaaaccatggactaatatctctcataaacatacaaatgtttaaattagcaaactgaattcaacaagaaaaaaggacgatacatcatgaccaagtgtgatttatcccaggaacgcaagagctgtttaatatttgaaaatcagcataattcaccatattaagagaataatgacaggatattcatatgatcatttcaatcgatgcagaagaagtacttgatgaagttaaatatccattcatgttttttttttttttgagacggagtctcgctctgtcgcccaggctggagtgcagtggcgcgatctcagctcactgcaagctccgcctcccgcattcacgccattctcctgcctcagcctccgagtagctgggaccacaggcgcttgctaccacgcccggctaattttttgtatttttttagttgagacggggtttcaccttgttagccaggattgtctcaatctcctgacctcgtgatccgcccgcttcggcctcccaaaccactcacgttttttaaacaaagtctcagcaaactaggaagaacacttcaacctaataaaagtaatctatgaaaaacctacacctaattcttttttttgaaacagtctcactctgtcacccaggctggagtacaatggtgtgatcttggctcactgcaacctctgcctcctggactcaggtgatcctcccaattcagcctcccaagcagctgagactacaggtgcacaccaccatgcccagataattttttttttttttttttttggcagagatggggtttccccatgttgtgcaggctggtcttgaagttcttaactcaagcaatcccttgcctgcctcggccccctaaagtgctgagattacaggcattagccactgcacccggcccctaacataattcttaatgatgaaagagtaaatgcagtccccttaagatctggaacaaagcaaacatgtctacttgcatcgcttctattcatcattgttttgtaggccccagacagtgcaataagaaaaagaaataaaagagatacagattggaaagtaagtaaaacatatggacaatacaatagtgaagaaacctaaggaatctacaacataactactataactaatcagtaaagataacaaagtcacagaatacatagtcaatataaaaagaatcaactgcatttctatattctagaaagtaacaattagaatttgacattttaaaacataccatttatgatagcatccaaccaaaaccatgaaatacttaaggataaaattaacaaaatgtgcccaataactttacactgaaaactacagaacaatgctgaaataaagaaaacctaaataaaagtaaaggtgtactacattcatggactgggagccattattgtttagatgttggtttgtcagtcaagtcaatatacagaatcaatgcaatctcaatcagaatcagttgacttttctataaaaaaaaaaaaaacaaaaacctaaaaggtggattccatactttatatgaaaatgcaaaggacctaacatagtcactacagtattacaaaagaacaacaaaattggaggacatacacaatttgatttcaagatttactataaaagatacagcaatcaaaacagtgtgacactgatttaaagacagacactaggtccatcaatgaaaacccacaagaaataagacttacacaaacacgtaccaagagaaatgaaaaaagacttgtacaacaattttcctaaccactttattcatagtaattgaaagcaagagacaacacaagtaaccacaaaaaggaggatgaataaacaaattttgatattaattaaaatgactaaacattaatcaatagggaaaaagaatgaactgttgatacattcaaccaacatggatgaatcccaaaacatgttgtgcaaaagcagccagacacaagagttacatgtaactccatttacatgaggttctcatcaaggacaatgacaatctatgaagaaaaaatatcagaacaactgttgtggaggaattgactgggaagaattacaaaaaaacttcccaggattactaaaacatttggtatcttgatggattatggattatacaagtttatgcagttgtcaaaactctgaactacaaactcagaatctgaacatttcactttaaacttttcctcaattaaaaacagaatgtatattttcactcaaaaaaaatctgattgcctactataacccaggtattgagaacacaaaatttaaaggcaggatacagaaaaaaataccttaaaatataatgacaagacagtcttgcaagcaaagaaatgcaaagttattatagttaccataatgaaaaatcacaagaaagagacatcttttaaggtgaaacatgagtaacagtaaattgccaaataaataatattataggcatatacgacatgaacaaaagtaacagaaaaaacccatagtggacctaggcaactaaattaatttgatatgcttaaagcataaaatggtggcgaaaggggctgaactacagttaaaaaaaaaagttggataagggacgggattatgacggctatttccgcccatgcaaaaaagtacattttagctgtttagtaatgaggaaccactggggaagtttcagtaagggaatgacatgtatacatctcgtttggaaagatcactgtagaaactatctgaaagatacactggagaaggcgcaggctactgtcagtccaataaaaatgccagtctattgcaatctatagactacctcatccaacaaaaacagaatgcacattcttttcaagctcgcacgtaacatttcaccaaggtggacaacattctgggccataaaatacaatctaacaaacttaagagaatagcaatcatatggcgtctgctctaagaccacaacagaattaaactacaactaataacagaatggtagctagaaaatatctcaaaatacttggatattaaacaacacacttctaaacaataatggttcaaagaatttttttttttttttttttttttaaagacagagtttcactctgtcacccaggctggagtgcagtggcacaatcttggctcactgcaacctctgcctctggagttcaagtgattcttatgcctcagcctcccacatagctgggattacaggtgcatgccaccatgcccggctaatttttgtatttttagtagagatggggttttgtcatgttgcccaagctagtctcaaactcctgagctcaagtaatccgccactttagcctcccaaagtgctgagattataggcgtgaggcaccacacccagtccaaagaagaaatcttaacagaaattttaaaatatattgaactaaatgaaaataaaaatacaactatcaaaatctatgcaatgtagctaatgcagtgcttagaggaaaatttatagtatgaatgcatatattagaaacaaaaaatctaaaatgaatacgcttccactttaggaaagtagaaaaagaagagcaaattaaatccgaaacaagcagaaaaaaattataaaaattagagcagaaataaatgaaactgaaaataggaaatagagggaaaaaaatcaagaaaatcaaaagctgtttctttgaaaatatcaataaaataagcaagcctctaccactgggcagggggaaatgcagagttgttcgaacatgagtttcagtttcagttttgcaagatgaaaaagttctagagatctgttgtacaacaatgtcaatatagtttgcactactaaaatggacacttaaaaattgttgctctctcctctgctcgcattttcactctgccatgccctgctctgaagagacacccaccgttacccmcagcaaacaggctggtttgcagaggaaggcagcatgcagctccgttttgccccattctctgagcaggccacaaccctgactcagggatccacacaggccacaggctatgacctcaacrgtgcctatgatgatacaataccacctatggagaaagctctagggaaaatggacattcagatagctcttccttctggatgttacagaagagtagctccatgrtttggattagctgcaaaacactttattgatagatgaagattactgaggaaatgttggtgctgtactgtttaattttggcaaaaaaaagtttaaagtcagaaaaagtgatygtattgcacagctcatttgtgaatgaatttttaatccagaaatagaagttcaagctttggatgatgctgaaaggcattcagaagagttaggttctattagaaagtattaaaatttatgctaagaatagaaaatgagaactcatacctttttcttaaaagagtttttgcttaaagcattttggtaaaacttctgtaatcttaatagctttaccttctaaaagtactgcattttcttatgatcaaagaaaagagtacctctgttcagatcacacagaaattttttctgctgatagttgtatgtaaatctgctttgtcctgatataagacagtgtctttttaaaatcaaatgtacatcaattacagaccccaaaaaaccctatataatttaacttagtaaatgatacaccaaaaaaaagggaattgttaagacagtaatttttttaaattactgtcttaagacaagaaaaaaagaaaaaaagagaaaacacaaattactaatatcagaaatcaaagagaggacatcactataaacccctggacattaaaaggataataaaacaatactatgaactttgttcccacaaatttgacaactttatcaaaatagaccaattccttggaagacacaatctgtcaaaactcacacaagaagaatcagataatctgaagagacctatatttataggagaaatcaaatcaacaataactttccaaaacagaaagcaccagacccaaagcagttcactggtgaattctaccaaacatttaaggaagaaattacatcagttctctacaatctcttccagaagatataagcagagggaatacttgctaatttattctatgagaccagcattaccctaataccaaaaacagacaaagacatcaagaaaactatagactaatatttctcatgaacacaaatgtaaaaatcctcaaaatatgatcaaatcaaatccaaccacatctaaaaagaactatataccacaaacaagcaggatttattccaggtatgaaagttgcttccatattcaaaaatcaactaatgtaatccattacatcatcaggctaaagaggaaaaagttactgcaatgggctaggtaaagctggtgaatgtatgtatcagagcacaactacaagtagttatccgctcattcacaccatgtgccaacacctggactacagtgaaaagtaagacaaaactcctgtccttatggagtctacaatccatcagagaagcatcgtacaagtaaatcacaagtccctatcacagggactcaacctagagtcaagagaagtgacaggctgatgatgatggagcactatctagaggttataaaacaggtatgaagtatgactgagggtaatatctcaagcaggatatattaaagtcctaaagcaaaagaaaaagtacatgttagatgaactgaaaggaacccaggtttgatatcatagaaagaagagacaagaatttacatgatggttgtggtttcactgattattgggtaaaaataaaggtagaagaaggaaaaacatatgggtgcttatgaaacatcttaaatgacgtctgaggtagataggaaagagtaaagggctgatatactttaaaaagataaacagatcaagcaagcggaggatacaaagagaacagagaataggagcatattagaaaaatttaagaaggcaagaattacagaatttgtaggaaaaacccttgaatgtgtgatatttttctagttacgttgaagattcaaatgttttactctttaaggagaaacctagaagttagataaaatatcttttaaaattaagcatttaaaatttaataccaaaataatcctgagaaatattgttatcctgaaagaaataagcttctaaaataatataatacaagaacttaattttgcctttcaaatatgatttatgtcaatattttagtatatctattcaagaacactatttagccctgaaacattttctgaaatttcttcgatgacttgcagtattacgtaacaaaaaattatgtttctaagtttaatatcttataaaggaattacttacagggacattaagtgcatactgtagtccttgaggaagtctttcatgtgtttccatctgctcttcatcatttttcactgtctcctcatggaccatgagttcatcatgtgatatcatatcctgttgtctcatttcactttcttgtaacacttcatctgcagcaaggatctcctggtgaggcatacttcgatcttgaagtactgaatcctgtagctctccagacacagtagactggccagacactccacccattacaaccattgtcctggaagactgcatttcgtctatgccgccacatttaagaaacaatccttccagtttgtcgtcaatgttcatgcttaagtataactgcctagaaaaccaagtttggcaacaaaacatagtaaattagttttatatgactacttcattttaaattttcaaattaagaatttgaacattcaaatacaaagattttattgatgtactttggaactgcctccaattttaaaattataataccaatatcggtttccaaaggctggtagaataaaacacaaattttcattttcatataaaggcatcaaatcctaactactttattattgaaaaataagcctgacataaaaacaaattagggaaaagtatttgtaacatcagtcaagggatccatattctttaatatattaataatatattgaaatgtgttaaaaatagagatgaattcagtaaggaataaactgacagaacatcatcaagcaaatcatttttaaaaatttagaaatagtcattaagcatataaaaaagagtctcagcagtaatccaagaaattaccattaaacagcactatcatatttcatctaccaaactgataatgactcttaaaaaatacatccaatgttgaagtattaaaaaaagacactcatctactgataataaaagtatgtattagatcaactattttcaaaagccatttggtatcaaatgctatgaaacgtatcaaaagctataaaaatgtacatattctttgaacaaggaattctacattttggaatttatcttgatgaaataaaaaatgtaaacaaaggtagacacagaaaatcactacagtagtcaataccataacgaaaatgttaagtatatttcagtttagtcacttctttcccaaattaatcacctaagtaatgaccaactttgatcatagttttcagcagtcaaatacctaagttaaattccaacacactactgaaatcaaaatactctttcctttactaaggttatcattaacagagaaaactttactgaaatgaacagctcaaaaaaaccttataaacagcaaaatacacaaatgtgtaattcataacttgctaatctttcttccctggtaccaggtattatcaacctagaatatatacagtatatctgtacaaaacatctgatttcacttttcaaaatctttaggtagtaaagttaaaatctaaaggtcaaagattgctgggtatggtagctcacgcctgtaattccaacactctaggaggccgaggcgggcatatcgcttgagcccaggggtttgagaccagctagggcaacaaggcaaaaccccatctctacaaaataaaaatacaataatgagctgggcatggtggcacgcacctgtggtcccagctacttgggaggctgaggcaggaggatggcttgagcccaggaggttggggctgcagtgagctgtgactgtactactgcactccacctaggtgacagaataagaccctgtctcaaaaataaacaaataaaaataaaggtcaaagatgttacatacatcaccaaatagctgctctcttcaaaaatttcatttatcacatttcttagaaaacaaactaaaactaaatgaaacaagtctcttaatgctaaaatttcattattctgtccatttatttggaaatccttaagaatcaaytggtgaaaagtatttgtaacatcagtcaaaaactccatatccttaatatattaaaataccttaaaaattagaagagatcaataaactgacaggaacactatcagacaaatcactaaagaaaacttagaaacaaccattaaatatataaaataactatatttttatgttttaaatatataaaacattggccgggtgcagtggctcacgtctgtcatcccaacactttgggaggccgaggcgggcagatcagcaggtcaggagatcgagaccatcctggccaacatggtgaaaccctgtctctactaaaaatacaaaaaaattagctgggcatgatggtgcatgcctgtagtcccagctactcaggaggctgaggcaggacaatcatttgaacccaggaggggaagggtgcagtgagccgagatcgagccactgcactccaacctggtgacagagcaggactccatctcaaaaaaaaaaaaaaaaatggagggagtaaatatatacataagtatatacatttatggggtacatgagatattttgatacaagcacgcaacgtgaaataagcaaatcatggagaatggggtatccatcccctcaataatttaccctttgagctacaaacaacccaattacactctttatttttaaatgcacaatcaagttgttattgactatagtcatcctattgtgctatcaaatagtaggtcttattcattttttctatttttttgtgtgtgcccattaactatccccaccttccccttctcagcctctagtaactatccccttttactctctatatccatgagttcaactgttttgatttttagatcccacaaataaatgagaacatgcatttgtctttctgtgcctggcttatttcatttaacataatgatctccagtttcacccgtgttgttgcaaatgactggatctcattctttctttatggctgaatactactccattgtgcatatgtacattttctttatccactcatctgttcacagacacttaggtggcttccaagtcttagctattgtaaacagtgctgcaacaaatacaggagtgcaactatcttttaatatactgatttcctttttaggggaaatatacccagcagtgcgattgctagattgtatgctagctcaatttttagttttttgaggaaccaccaaacttttctccacagtggttgtactaatttacattcccaccaacagcatagaagggttcccttttctccacatcctcaccagcattggtaattgcctgtcttttggatataagccattttaactggagtgagatgacatctcattgcagttttgatctccatttttctgatgatcaacaatgttgagcaccttttcatatgcctgtctgccatttatatctcttcttttgagaaatgtctattgaaatcttttgcccattttttgattgaattactagattttttttcctatagagtrgtttgagctccgtatatattctggttattaatcccttgtcagatgggtagtttgcaaatattttcccccattctgtgggttgtctcttcactttattgactgtatcctttcctgtgcagaagatttttagctcgatgtgatttttttaaattaatcttatgcctagcatcaagccaaaacaataaatattgaggaagtagtagtactctggggacagataatattttggaaaaaaggcataaagtactagagtgagagacttggaacaggaagagagcacaccttgatacagaagtagtaaagtgaagacaaagtggaaatactccaaatgaaaaacaaatgacctcttcaaaaatattcctgaaaaccaaccacatgcaaagaaaaagaaatctcacttcctttttactaagttccttattcctatggccccaaattaaggcatatatttggagttaaactgtctggcctagaaactgtttttgaaataccctgaaatttccccaaaataccagcaagtactaagataccaaaacagactccaatatcaatggacacaaggttttaaataagacaaagttttaaaatgagctttggaaatatctatcaaaatgaaaactgtatgtactct
